United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 3

SEQ ID NO: 9644 - DNA, 564 bp, Glycine max
  Peptide Sequence Number=SeqID_101329
atgacattgaccatcccacaactgtttttgaagcctctccaggttatgtgggatgctaccatgttcggggtgtttaatcaaaacttcccgttgtacataaagcacgaagatctctctgaaattgcacacggtggtcaatgtctcaacatatctattatacagttgtggattttgcatctgactgagacaagtctgcgagcggggaattccgatgtgtatggattcctcgagccacactccattcagagatctgggcaatcgcaatttgaatcggaaagttacatcaagagttggatgcagagttcaaaacgagatgtctaccttggagcttacctgaatggcggacactggcaaatggtcgtcattctgcctaaggaaaacctagttgtttggttttgttctttacataacagaccagacaactaccttaagggaataattaaaagtgctttgaaaggacttgatgatactccacaacctaaatccaaggttgctgctagtgtaatagacaaaaaggaagcactgagtgcggttattacgtcatgcactggatgtccacgataa

SEQ ID NO: 9645 - DNA, 129 bp, Glycine max
  Peptide Sequence Number=SeqID_101330
gtcctccaagtccttcaagtggatccttgaacagccttgctcttggtcatgcactcatcaataggtcctccaagtccttcaagtggatccttgcccttgctcttggtcatgtcctcatcacaaaagctc

SEQ ID NO: 9646 - DNA, 219 bp, Glycine max
  Peptide Sequence Number=SeqID_101331
atgcccttctatgccaaatttttgaaggatatgttaaccaagaagaacttgtacatccatagtgacataattgttgtggaagctttgaaaagtactatttttcaccttcacgctaagcgcaccactcatgggctaagcgcgaggaagactctagaagaagatgagttgtacaagcacaccgcttcagttcatccgctaagcgagaaaggcatgcgctaa

SEQ ID NO: 9647 - DNA, 228 bp, Glycine max
  Peptide Sequence Number=SeqID_101332
atgaagatgctcttcataccacatgatgtaagctccattggagctttggaatggagaaggaagagagagaagagactccacttcaaggagaagatgagtctagaagaagctcaccatcataggaggccatggataagagcttggaggaagaaggagatgaatgaagggaaagggagagaagagcacgaaattttgtgctctaaaagagctctgaaatctgaagtttaa

SEQ ID NO: 9648 - DNA, 132 bp, Glycine max
  Peptide Sequence Number=SeqID_101333
atggatgttttcgagaaattcaaatggaagggaccaatcactagaaccatgagcaagaggctccaagaagattgggctagagctgctgaagaaggccctagggttctcatgaaccttagggtagatttctga

SEQ ID NO: 9649 - DNA, 111 bp, Glycine max
  Peptide Sequence Number=SeqID_101334
atggccacccctatgagcactgtttgctacttggataaagatgaagccagtcaatcagtagatataaagaaatatagagatatcaagccaatcccaaagaatctcacttaa

SEQ ID NO: 9650 - DNA, 207 bp, Glycine max
  Peptide Sequence Number=SeqID_101335
atgaaacacagctccaaactcgaaactggaggacacatgaatgacaacgcaattcattcatgtggctccgaaaaagggatgagaatggaggattgccttgagggttctcacttaggcaatcatggaacacaactccaaactcgaaaaagtggaggacacatgaacagccctaagcaatcattcatggggctctcggaaatgggatga

SEQ ID NO: 9651 - DNA, 138 bp, Glycine max
  Peptide Sequence Number=SeqID_101336
atggctggaagaaaaattgggggcgagggtttttcgagagagaggcttgttgcaggtgcagggacgcgttgtaatcaattacacaaatatggtaatcgattaccagagagcaacatagccagaaataactgcttgtaa

SEQ ID NO: 9652 - DNA, 183 bp, Glycine max
  Peptide Sequence Number=SeqID_101337
atggaagcatcgttgcatcaattagtgaggttccgtaacattcctaaaaatgggggtgcaaatagcaaccaggcccacttgggccctccagaagattcctccagaaggctgttgcttctggaggaagcaaccctgctcgcctgggcgagctgggtggcaagcttctcccccaatttgctataa

SEQ ID NO: 9653 - DNA, 294 bp, Glycine max
  Peptide Sequence Number=SeqID_101338
atggtgggttacacgccttcaagctttgccgatttagttttcatcggtgacaggatcaaagtgggtctaaaaagaggcaaatatgatcatcctactttgatgaataagaagcctggggcaaatggagagaataagaaggagggaggaacccatgttgtgactatcgttcctacatggccaaatttcccacccgctcaacaatgtcaatactcagccaatatcagcccttctcactacccaccaccctatcagccaagaatattcaatcatccacgaaggccacccttaaattag

SEQ ID NO: 9654 - DNA, 207 bp, Glycine max
  Peptide Sequence Number=SeqID_101339
tggcgtctcctctccctcttccttctccattccgctgccattcatcttccaagaagcaaaggaatccattgatgaagaagatcctaggcctacaagctccaatggagcttgcatcagctccggactcgatggtggaggatgcatgaatggcaatcaattcatggggcttcgactaagatttgatggtggaacagaatggtccaccgg

SEQ ID NO: 9655 - DNA, 300 bp, Glycine max
  Peptide Sequence Number=SeqID_101340
atgtcacatcctatcagagcgttgtgtctcgacgtccttcagcacaatattcttaaaacagttcacctagtcatctgctcccccgaacacagagttcaagatcatcacaggatccaaacacaaacaacaaaccgggagtcactctcactaagtaagatcatagggagaccagtcagggtcacaatgttttgcgagaatgctccaaccatatgggatcagcataggcttaaaggagcactcaaacccggtgacccccaaggcctacactccgaagaatccgtcagggcctctccctcctaa

SEQ ID NO: 9656 - DNA, 432 bp, Glycine max
  Peptide Sequence Number=SeqID_101341
atggccaaatcatcaaagaaacaaaagggatcttcctccaccaccactactgctggccaccgccgccatggaagctctggaggcccactagcaccaactggttgtcagattggctgggcccatcttgttcggtaccggatgcataaggcattacgggccaatgcacctcttccatatcctcaccatattaccctctttcttcatcatttcaaagttcccttggatgatgaaccctttgtcaagaaggacgtggatggtcagtgggtccgcaagcaagatttgccaccgcctattctcgatgagcgtacaccatctcctccaccacaaagggatgcttcctcttctcggctgactgatgtccaaacaaagcttcgcgaccttcgatcatttcctttgtttggctcttgtcttggtttgaatagacttgcttga

SEQ ID NO: 9657 - DNA, 642 bp, Glycine max
  Peptide Sequence Number=SeqID_101342
atggcctctaggaaacacaagagtatcagttcaagacccacaactcaatatgatacaagaagatttcactccttagatgcatggaaccggtacacggaaaatgtattggggagaaacatattgccagagaggaaggtggaaatgtaccacactgagtttgatgattttaagactgagttggagaggtgtaatctccataaacgtctcaccaatttggttgatgggagcataaatgtggctttggtgaaagagttctatgcaaacctatacagctctgagggcccttcaccaaagcaagccagggttagaggccatatagtgaagatcgacgctgacagccttaacacattcctagaaacacctgtggtgttggcagaggatcctagggagattgaggctgccctatgcatacctggtcaagggttcatcttgaaccctgagggctatcctgggaggatcctgaggaaggacttgttgcctttagcccaggtttggagtgttctctcatactccaacctagcccccacatcgcacacctctaacctgatagtggatagagctagcctgatctttggcctagtctcccgcatggacatgaacataggagccctcatttttggccagatgacttctatagcctag

SEQ ID NO: 9658 - DNA, 789 bp, Glycine max
  Peptide Sequence Number=SeqID_101343
atggaaggaaggaagggccagagttttgtctttatgtcaagggtttacaaacgtccccttgatgggaacgagggaaaggataagggacttaggggaagcagcaatgggatcatcagcgcctatcacaagtgcctgaaggctagaacgcaagagataacttggctcctgaagccaaagattccaaatgaggaagaggctgaaacccctgaggagagcgaggaggtccaagctttgaaggtggaacttgaaagagcatcagcagtcaaggaaaagttcaagatgatgaccattaaggtccggaaagagtatgacgagctgagggacgtcaacgtggccatagtcgaagccttggaacgggaagtgaagagggcccgaaaagcagaatggggcggaaacaacgaactcaaacttcgaagggccgagagagaccagtcaagagtcaaaggtatgatattagaggacaagttgaaggcttgtcaaaggtcaaagaggaacttgaccgagcaattgagtaggactgaagcaaacatgtgggctatcattgaccaatacaaagaaaagctaaatctagctgcaagccatgagcaaaggctagaggacgagcacacaaagtgggctaagcgtgcatccaccgctaagcgcagcttcagcgcgacagaagaatcaggcagggcatcaatatcaagttcgtgcgctaagtgtgagattagtgtgctaagcacagcagatgtcttcagccaggctcagcgcacggctggcgctatgcctgaatccactttcgcgcgctaa

SEQ ID NO: 9659 - DNA, 417 bp, Glycine max
  Peptide Sequence Number=SeqID_101344
atgggtctttgccagttgttcggggttcccgtcacacctagtaaggtgattcgactgccgatcacccaggccttcacaaagaagtattgcacgcctagacaggcggccaaccacagggggcacgtgcagacctttgagtgcctctaccagctcatcctcagtctgcagagccagggtttcgctccttttccgtgtcctactccagatcagttcagggcagaggtcgcatggcccagagattggctagaggcccaggcaggggaggcgcccgcagaggctcccggcgatggagaggaggcccgcatggatgaggagatgacggatttgctcgatttcttgggaggaagcggagccatgtgttcgagggcaccgcattttttgacatatctgtttttgttttgtttagtttgctattga

SEQ ID NO: 9660 - DNA, 537 bp, Glycine max
  Peptide Sequence Number=SeqID_101345
atggcatcgagaaaaagagctagaacggaggacatcccttcatcatccactgcagctcctctatcagtaaccataggacaggatatccaaagctcacaaactttagtccctatgctacacagcttatttcgaggacagtttattatcatgcacagcctacaagagttggctaataacaggccaatcataactatggagcattttcttgagcaagttgcctggcctgaagctcaacttccattggtgagacctaacgaggctgctccgcctgagcccacacctgtacaggttgatccagagctagctgacccacaatctctagtggtgaatccattgtcttctcctgagcgtgaagtagttcccccatctccacctctgattatcatctctgatgcatcatcaaatgaagcggctgcctctcctgattcaccagccagagaaacagctaaccttcctacttccccagttggaggaattgctgatctttcttattcgtcatctggagaagttgttgctctcaccgattccctagtttag

SEQ ID NO: 9661 - DNA, 315 bp, Glycine max
  Peptide Sequence Number=SeqID_101346
atggaaggaggtgaagaggttccgaaagtaagaacccaaaacatagatcgcccaatgagatcattgggaacttactacataatctgtacattggagtacattagcctatctgtgaatgttagaaaacattttctgaaaaattgtcctttcgctaagtgcaagattcgtgctaagcgcatctttggttatgcgctaagccgagagtctcaagcgcttagcacccaacccttgcatctaaggctgatttggtctgctaagctggccaaggctgcgctaagccaacttgaattcgatctgaatttggctaagcagtag

SEQ ID NO: 9662 - DNA, 195 bp, Glycine max
  Peptide Sequence Number=SeqID_101347
atgaagaaacaacaatggaagaaaagcgaaagacaaaggagaagaggtgagaggaggcgccatccactagggaataagccatggaagaaggagcttcaccaccaagatgagccttggataagaagcttggagaggatgcttcaatggaggaaaagaaagagggagagaaagagagaggggggaacacgaaattga

SEQ ID NO: 9663 - DNA, 997 bp, Glycine max
  Peptide Sequence Number=SeqID_101348
atggcttctaggaaacgtaaaagtattggttcaagacctacatcacagtatgacacaaggagattctcttccttaaatgattggaccagatacacagataatgtgctggggagaaacattttaccagagaggaaagtggacatatatcactctgagctagatgagtttaaggctaaattggagaggcgtaatttccataaacgcctcaccaatttagtcggtgggagaatagacctagctttggtgaaagaattctatgcaaatttatacagttatgaggaccatccaccaaagcagtccagagtcagaggtcatttggtgaagattgatgctgacagtctcaacacattcttggagacacctgtggtattagctgagggggagaccttacccgcttactccagataccgcaggttgcctacagactacatagagatagaggttaccttatgcatacctggccgagggttcatcttgaactcagagggccattttgggaagaattgggctgccttgatggcttctaggaaatgtaaaagtattggttcaagacccacagcgcagtatgacacaaggagattctcttccttagatgcttggaccagatacacagataatgtccaggggagaaacattttaccagagaggaaagtagagatatatcactctgagctagatgagtttaaggctgaattggagaggcgtaatttccataaacgcctcaccaatttagtcgatgggagcatagacctagctttggtgaaagaattctatgcaaatttatacagttatgaggaccatccaccaaagcagtccagagttagaggtcatttggtgaagattgatgctgacagtctcaacacattctgggagacacctgtggtattagctgaggaggagaccttacctgcatactccaaataccgcagggttcatcttgaactcagagggccattctgggaagattctcaggaaggatatgactacactagctcag

SEQ ID NO: 9664 - DNA, 501 bp, Glycine max
  Peptide Sequence Number=SeqID_101349
atggccatggtagtcacagcctaccaaacatcccatgagtgttcggaagaaaccattattgatatcttaagtggcaggattttccggatagttaaaagtcaacaacctttttggaaagaaaaatttctagccggtcttccaagatcattaggagataaggttagagataaaattcatagccagcctgctaatggagacattccatttgagagtttaagttacggtcaattaatttcttatgtccagaaagtggccctaaaaatctgtcaagatgacaaaattcaaagacaattagccaaagagaaagctcaaacaaagagggacttaggatctttctacgaacaatttggactaccaacttgtccaaaacaaaagaaacaacaaagctctacaaaagaaacccaagagaataaaatttcccacaacaagagatttccaagaaggagatactcgcacaaaccctcgactagcaaagaaatagaaaatcctaaacaaaaataa

SEQ ID NO: 9665 - DNA, 954 bp, Glycine max
  Peptide Sequence Number=SeqID_101350
atgttgcaggtcacagagcccttgtggttctgcaattgtcaaagccctgttggtgcaaggatatacaatctaataacacggacacatgctgcgctagacctcacttcacaaacagccgttgcagactttttggcaaatgaaaaacctgagtatgtttttttggctgcagcaaaagtcggaggcattcatgcaaataacacctaccccgctgagtttatccatgaaaacttggccattcagaccaatgtgatacatcaatcctacctgaatggtgtgaagcgtttgctgtttttagggtcaagctgcatttaccccaaggattcaccgcaaccaattaaagaagaatacttacttactggtcctctcgagcctaccaatcgcccatatgcactagctaaaattgcaggcattgagatgtgttggagttataaccgccaatatggcacacattttttggctgccatgccaacgaatctttatggccctggcgataactaccacccagaaaacagtcatgtgattccagcattgattcgaaggtttcatgaagcaaaagtaaatagtcaagccgaggttgtgatttggggaacaggcacccccaagcgtgagttcttatatagcgaagatatggctgaagcatgcacacatattttaggcttatcggatcgcaactttgcaagtctcatagccgctgacagaaatgatggtagccctcctattttaaatatcggctataacgcagacatttcaatcgctgaattagccgaaaccattaaagaagtaacagcatacgaaggaaaagttgtgtttgataccagcaaaccagacggcactatgcgcaaactaatggattccagcagaattaaccacatggggtgggcagctaaaactgaactaaaaaatggcttaaaggctgcttacactgactttatcaactcgaaaatcgccttgtaa

SEQ ID NO: 9666 - DNA, 719 bp, Glycine max
  Peptide Sequence Number=SeqID_101351
ttgtcctctttccgaatatggaagggttagtggacctagcagcgattgacgctttcctcgcctttcatcatggcaaggaaagcccggtcgtcgccattttggccatgtatgacacgttcgaccggggatgctcgtctatccgctacaaggtcaccgctcgtgcgtcgaaaaagaaaagaaaggacagagagcttaggggaagcagtaatgggatcatcggcggctatcataagtggctgagagtcccggacacaaggattggattggctcccaaatctaaagactgtgagggacatgaggttaaagcttcggaagaaagtgatgaggtacaagccctaaaggcaaagcttgaaagagcccgggtagtcgaagagaagttcaagtccatagccatcaaagaatcatcacgggtcaaaggcatgatcttgaaggacgagctaaaggcttgccttaggtcgaaaagaaatttgtcccaacagttaagcgagactgaagggaatatatgggccgtcatcgatgagtgcaaagagaagctaaatctaaaggcgactcatgagcaaaggctagaggatgagtacgccaagatatcagcagaaagcgaagcaagggaaagggtaattgattcattgcaccaagaggcaacaatgtggacggaccgatttgctcttactttgaacaggagtcaagaacttcccccattgctagccaaggccaaagca

SEQ ID NO: 9667 - DNA, 393 bp, Glycine max
  Peptide Sequence Number=SeqID_101352
atggctgactttccaagaggatcggcccaatgtgaggaccaacccgctcgccaatcatggaggggagcagttaatgcagttggatccgataggccccacaggtccaaacctttaagagatgtggcaacccctaggaggtttatctttgaggccctacaaaagggaggtgtaattccccatagtgggtgtaaggaggattcttgtctgctacattccggcgagatgcatgacatggagacgtgtttggaagtagaggaattgttacagcggatgatagaccaaggtcgactggaagtcggcattgaaggaaaagaagagcagcacatatgcatgcaatctacggaggggagcggtgttgcgaagcccaaaccccttggtgatatacttcactaa

SEQ ID NO: 9668 - DNA, 297 bp, Glycine max
  Peptide Sequence Number=SeqID_101353
atgttaagattctatgcaaacctatattaccttgaggataaagcaccaaagcaagttagggttcgagggcacctgattaagttcgatgcagactccctcaacaccttcttgaagactccagtgatcttggagcaaggggagagcttaccttcttactctaggttctgcaggttgaggccaggccctcaagagctggcagcccggctatgtatccctggaaagggatttgttcttaatgctgagggcttaccgtggaagctcttgaggaaggatcttacaactctggcccagacctag

SEQ ID NO: 9669 - DNA, 371 bp, Glycine max
  Peptide Sequence Number=SeqID_101354
gaggttaaagatgcaaatgctctcgttcctgtacccaccgacgaggtagctgtgtctccagcaaaacctgcagataggccagatcctgaggttatgtgggatgctttcttgttcgggctgtttaattcagacttccctttgtacataaagcatgaagatctgtctgaaatagcacacggtggtcaatgtcttagcatctctgttatacagttgtggatttttatgcgagcgaggaattccaatatgtatggattcctcgagccacagtccattcagagatctggacaattgcaatttgaatcagaaagttacatgaagagttggatgcagaattcaaaacgcgatgtctaccttggagcctacctgaatgg

SEQ ID NO: 9670 - DNA, 129 bp, Glycine max
  Peptide Sequence Number=SeqID_101355
atggcacgccagcgtgtatcatcccccttcgaagaacatactgcagcagaccacagattcacctccgctccttatgttcccatgaacccgggtatagggccctttttcactcacagtgtgtgcaaatag

SEQ ID NO: 9671 - DNA, 90 bp, Glycine max
  Peptide Sequence Number=SeqID_101356
atgaagatgctcttgataccacatgatgaagagatagaggagacgccacttcaaggagaagatgagtctagaagaagctcaccaccatag

SEQ ID NO: 9672 - DNA, 437 bp, Glycine max
  Peptide Sequence Number=SeqID_101357
gactctgccagtcgttcggagtccccgtggcacctaccaaggtgattcggccgcccatcacccgggcttttattgagaagtactgcacccagagacaggctcagggggatgctccacaggccgcgggcgcaccaccaccacctcatcaggctggcccggctaggtcatttgcatggagcagtatttacggcatttggttcgccagcaggcggccaaccaccgggcacatgtacaaacccatgattagccagggcttcgcttctttttcatgccctactccagaccagttcagggcagaggtcgcatggcccggggattggcctgaggtccaagcaggagaggcacccccggaagttcccggcgatggagaggaggcccacgaggacgaggagatggccgatttgcttgacttcttgggaaggagtggagctacatga

SEQ ID NO: 9673 - DNA, 492 bp, Glycine max
  Peptide Sequence Number=SeqID_101358
atgaggctcagagtttatgagcagttcgagcaaagagatctgatggaagcttgcttgtggggcttctatggaggctggatctttgagcttcaatggggtcctttaatggtgattttccaccatggagatgcagcggaagacaaaggaaaagagagcggccgccaccgcggtggagctccaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 9674 - DNA, 459 bp, Glycine max
  Peptide Sequence Number=SeqID_101359
atgtaccctccactagaactgatccacaagagatgtaccctctcttgttctcagtcaacaacccaagtagatgtaccctctacttgtaccacaaaggatgtaccctccaatgtgttaagacaaatatctcaggtggttaaacctttgatactttgtgaatggggatacaaaagaattctcaagcgggagaagggagacacaaaagaattcaggcggttagtcctttgttcttttggaaaagggagaagagagacacaaaaagaattcaggcggttagtccttggcgaattatttttggcaaagggagaagagatgaaaagaatgaatagcacaagttttcaaggtttagaaaaccagaaaactttggaaagcttttggcacaaaaaagaagaagaagttcaaagagattcaaggcttgtaaaggattgtataagattgattggattgattggattgtaa

SEQ ID NO: 9675 - DNA, 399 bp, Glycine max
  Peptide Sequence Number=SeqID_101360
atgaaaagagaaaaatatacctcctatagtagtcataactcttgcaagagcctaagtgaagaacttcgtgactattacgaaggaaggcataggtcacatcttagacctcactcacataggagagaaaaggaaaaaaagcctcaagaggctcacattaacctcccattcttctataggaaggacaatgtagaggctaacttacattgggaaataagggtagagcaacaacttaaaaacaagtctacttcaaaatcttatggctctcactcttatccaaagaaagcccaaggtctaggcatcttaggggtgacaccttctaatctcaaagatgatagtgggaagacaatagacacccaagcccctaaggctggtatgcaagagaaaactatctctatatag

SEQ ID NO: 9676 - DNA, 228 bp, Glycine max
  Peptide Sequence Number=SeqID_101361
atggcagaggaatcgagaaggaagagacagaggagatgccacttcaaggagaagatgagtctagaagacgctcaccaccataggaggccatggataagagcttcgaggaagaaggagatgaatgaagggatggggagagaagagcacgaaattttcccactaatccaagatcaattccaagattctccactaagtgtgcttaggtgtcatgaggcatgcaaagcatga

SEQ ID NO: 9677 - DNA, 471 bp, Glycine max
  Peptide Sequence Number=SeqID_101362
atgtcttgcctagcgactataactccgacctccctctgcctaagtgccagttggtgtatggcgcctactaggcaccctctggacccagagaagtccaatagggccctggggtttccggctctgatcacaggcctctgccagtcctacggagttcctgtcacccccagcaagtactacacacccaggcaggcgcagggtgatgcacatcaggccacgggcgcaccgccaccacctcaacaggccgatctggctgggtccctgggcgtggagcggtatctacagcatttggttcgccagcaggaggccaaccaccgtggacagtttggggctggggtcgcatggcctagagactggcccgatgcccaggcaggggagcagcctacaggatcccccggtgaggcggatgaacccaatatggataaggatatgactgacctgctcggtttcttgggagggagcggagccacatga

SEQ ID NO: 9678 - DNA, 282 bp, Glycine max
  Peptide Sequence Number=SeqID_101363
atggaccaattaaagcgcctaagcatcccctcagaaattcctagattctttaaccacgcttgccacccacgtctgggccatccaacaaggtcagtgcactccaccccccatgagcatacactacatacgacgtatgaacgtggcccaaagcaagtgccaaagaccctggaagatcagtgcacttcgtccccccaagaacatactcaacatccaacgtatgaacgtggcccaaagcaagtgccaaagaccctggaaggtcagtgcacttcgccccccccatga

SEQ ID NO: 9679 - DNA, 751 bp, Glycine max
  Peptide Sequence Number=SeqID_101364
gtttgcactcctgaggccttatcctcaggagttggctgctaagctctttatcctagggacgagattcgagctaaatgctgatggtcagccgttgaagatattgaggaagaatatgatcactttagctcagacaacgagtgttctttccttctctaacttgattcctacctcccacacatctgatgtcaccttggacaaagccaagttgatttatggcatcattatgaagatggagatgaatatgggggacctcatctcccaccagatctcttttactgcacaacatgatacatctagacttggattccctgccttgatcacaactctatgcaaggttagaggagtccaatcatattctagatccctggagaacttgagccctgccattaacttggcatatattaagaagaaatgttggaatctagatgatccaacaatgacatttagagggccaaggaaggctaggggcaagagatcagaggtcctcactgcttcagctccaccagagacaacaactccttcttcttccatagctttagtacctcccattcagattccagctattcctcctccatctactaagataccacttctagctcctttatctacaggacctttagatttttcatttacaccacaaatgcttcgttccatgccccagagcttacacagggggcactccattatcatgcagagccttcagggtttaggcttggcatccatcatgagcatggatgagtttgacgcatag

SEQ ID NO: 9680 - DNA, 225 bp, Glycine max
  Peptide Sequence Number=SeqID_101365
atgttttcctcaaataaatgttggtggcgaatccgtgcgccttcttcccttggaagatgcacccgtgagccccgcgtcgtcctcccgccgaaggaagcaagcttcatgatgatgaatcaagttgattcaagtagttttgatgataacaaagatgatgacaaaaagcccaagagaatacaagagaatgatttcaagaacaagattcaagaatcaagagaagtttga

SEQ ID NO: 9681 - DNA, 138 bp, Glycine max
  Peptide Sequence Number=SeqID_101366
atgaccgatcgagccgacattgcgcaatttctttttaaaaacggtcgcttgccgataatgatgagaatcctgaaattggccaaatacaggctaaaggcccaagtggagaagggcaaaggcccaagtggagaaggataa

SEQ ID NO: 9682 - DNA, 587 bp, Glycine max
  Peptide Sequence Number=SeqID_101367
atgatcaagtcaaggttggtgttgaggaaagttagagatgcagatgcttccattcctgtacccaatgaagaggttcagttaggagttgtgggaccaacaaaacctgcagataggccggatcatgatgttaatgatcccctatatttgatgacattgaccatcccacaactttttcttaagtcgttgcaggttatgtgggatgctaccgtgtttggggtgtttaatgacaacttacccttatacataaagcatgaagatttgtctgaaatagtacacaatggtcaatgtctcagcatatttgttatacagttatggattttgcatatgaccgagacaagtatgcgagtggggaatgtcaatgtgtatggattcctcgagccacagtccatacaaagatctaggcaatcacaatttgaatcagaaagttatattaaaatttggatgcagaaatcaaagagggatgtgtaccttgcagcctacttgaatagtgcacattggcaaatggtcgtgattttgcttaaggaaaatatctggttttgttcgttgcataataggtcagacaactacctcaaaggaataattaatag

SEQ ID NO: 9683 - DNA, 433 bp, Glycine max
  Peptide Sequence Number=SeqID_101368
atggttggagcattctcgcaaaacatcgtgaccctgactggtctccctatgatcttacttagtgagagtgacctgacaaacccattgtgtggtgtgtcttgttatgtactcctaagcgccctagggtggtttttcactgacacgggtgtcacacaatgtgcctacacaaaggttgctccatttgttcttcaattgatccaagacggagtggcactaaacactattggtagtgccacaaagaaagcaatcctatcttcggctgtcttggaattaaacatggagatggagaacttgacgaacaacacagttaatgcactttggaaaggagcagctgagatggtactaaagacgtgttcaacatactatgatgcttctggcattgtgaaagatcttgacaatgataacatgttgaagtttgagtacattattcaag

SEQ ID NO: 9684 - DNA, 702 bp, Glycine max
  Peptide Sequence Number=SeqID_101369
atggatcttgccataattttggttaaccatttgacagttgacactcctttgtcttatctcacatctgatttatgtttgtttgttgcagtcactacaactaatcaggcaattaaggcactagaaatgttgaggaaaaacataaacaagtttgaccttcttactagcgatgtaaatatgcctgacatggatgggttaaaacttcttgagctagtgggacttcaaatgggcctacctgttattatgttgtcagcatacaacaataaagagcgggtgatgagaggtgttatacagggtgcttgtgagtacttaaccaaaccagttcgaattgaagagttacagaacatatggcaacatgtactacgaaggaggattgatagcaaggataagaataagattgcaagtaagggtaaaaaggctgcaatatggctggctttccccaagagaatactcgacttgatgaatggcgaaggacttacaagagaaaacgtagcaagccatctgcagaaatacaaaatcggtcccagaaaacctacttggcagcctagcatggttgctacgttgggtagtagtgatccttacctgcagatggatttattaaaaggctttcacatttgtctatcgatcaaaatctctgaggattgtggttttgaggttgatgaggtcgtgaaaatttacatgttgcatcttgacaaaaacgagtga

SEQ ID NO: 9685 - DNA, 585 bp, Glycine max
  Peptide Sequence Number=SeqID_101370
atggacatagactatgctataaggaaagacgaaccacttgcaatcactgatgaaagtagcccagccgacgttgcactatatgagcggtgggagcgatccaactggctcaacatgatgttcattaagaccaaaatatcggatgagatacgtgattctgttgaccagcatgaaaaggtccaagacttgcttaaggccattgatgaccagttcatcacttcagataagactttagcaagcagcttgatcatgaagttctcttcatgtgaagaagaaaggcttgtaatggagatgggtgaaagtgcattactgactactgcttatgggaagaacaaagcacctaagtctcaagctaatctgaaggggaatggtaaaataccacctcaagctgatattaagaaggtggcaaagtgtttcttttgcaagaagaagggacacatgaagaagaatttcctcggattccagaaatggcttgagaagaaagataaatcaatctcattaggtatgcaaaacctaaggaaaccagtgagaagtgagcaaatcattttatcaggcaataagctaggctcacatgtggaggccatatga

SEQ ID NO: 9686 - DNA, 273 bp, Glycine max
  Peptide Sequence Number=SeqID_101371
atgagtgccatccaccttgaggtatggcaaccaaattcaagtggaccttcttctagtaattctgacttaccacagcctcatatccctcttccattcccacctagagcaattccaaacaaaaaaaaaatggaagaagcggaaaaggagatcttggagaccttcaggaaagtagaggtgaacatacctctgctagatgccatcaagcatattccaagatatgccaagtttctaaaggagcttgtgcacccacaaaaggaagctcaaaggcaatga

SEQ ID NO: 9687 - DNA, 198 bp, Glycine max
  Peptide Sequence Number=SeqID_101372
atgtttgcttacagtcctctcgctaagtgcaagcctcgcgctaagcgcatcttttgtcatgcgctaagcggagagcctctagcgcttagcactcaacccttgcacctcaagttgatttggtccgctaagctagccaaggctgagctaagcccattccaatttgatctgaatccggctaagcgaggacctgctagctaa

SEQ ID NO: 9688 - DNA, 258 bp, Glycine max
  Peptide Sequence Number=SeqID_101373
atgcattgtgtaatcgattacatggttatgggtacatcctttgtggtacaagtagagggtacatctacttgggttattgtaactgagaacaagagagggtacatctcttgtggatcagttcaagtggagggtacatccacttggttgttcaaagagaacaagggagggtacatcccttgtggatttttgacttgtaaaggattttacaaggttgaaagaaatctcaagaaccataggttgcttggggactggatgtag

SEQ ID NO: 9689 - DNA, 228 bp, Glycine max
  Peptide Sequence Number=SeqID_101374
atgcatgcattgttagggtcattcaacagtggaaactggtctgattctaaagtccttgatagtacggggctaagttgttgtactgtcatgaggaatcgggtcctggttgagttgagtcttacaagaggaatctgtggacggtgcttgatcaggattaggctaggctatcatgaggaatcggggtctagcagtccaggagacaacataggaatacatgagcattgttag

SEQ ID NO: 9690 - DNA, 858 bp, Glycine max
  Peptide Sequence Number=SeqID_101375
atgtctaagatagtccaaatctcggcacaggaattagaccacagaaagcaagtagaaaatggggtggttggaataccgagaaaatgtttggaggtaaaagcaagaatcttggcaggtagaggcgaatgggccccgttgatagacattctcgccctgttgatcttcggaggagtcctctttccaaatgtggatgggttggtggacctagcagcgatcgacgcttttctcgcctatcataaccacaaggaaagccgggttgttgcaatgctagccgacctatatgacaccttcgaccgaagatgtgagaagagtagtacgaggattgtttgctgtactccaactctttatctctcgagtttgagaaccgctaaaagggaggaagttgaggcaccggaggaagacgaagaggtgcaggtccttagggcagaactcaagcaagcccaaacagtcaaagaaaggttcaaatcagcagctgttaagatccgaaaggagaatgccgagctgagagatgtaaacatagctaccaccaaggccttggagcaagagacaaaaagggctcgtagggaagaacagggccggaacaagttccgaggggctctgtggggcagtaacagcgagcttaagctccggagagaggaaagagaccaatcacgagtagacagtttgatcttgaaagatgagttgaaagtttgctcaaggtccaaaagaaacctgtctcagcggttatgcgagacagagaccaacatgttagctatcatcggcaagtaccaagaagaactaaatctagccacgactcacgagcatagagtggcggacgagtatgcccaagtgtacgcggaaaaggaggctagaggaagg

SEQ ID NO: 9691 - DNA, 324 bp, Glycine max
  Peptide Sequence Number=SeqID_101376
atgtatgataacataatatctgaagaagttgatatgaatgaaaaaaatgaagacaaagctggtgtgaatgaggaacatgttgattgttcttactgggagtatgttgatgctttacattctatgcaaaatagtaattcttcagtgaaacatagtgcatcatcgtctgaccaagcaattctaaaaaggactatgccgatgttggatcaatttcatccgtgcattcatgattccattgaaaacattgtcaatgtcaaagctgatagtaactgtggatattgtgtaattgttgccttattaggtatgggtgaagattcatggtctttg

SEQ ID NO: 9692 - DNA, 939 bp, Glycine max
  Peptide Sequence Number=SeqID_101377
atgttccaacatcctccaccccgaatgtttctgtgcctaatgttgataaagatgttccaacatcttccgctccaaatgctgaagccctcccttcacccagtgaagaggaatcaacagaagaagaagatcaagccacagagaagacctctgcaccaagggcaccagaacctgctccaggtgatctcattgaccttgaagaggtagaatctgatgaggaacccattgccaacaagctggcacctggcattgcagaacgattacaaagccgaaaaggaaaaacccccattaagaggtcaggacgaatcaagactatggcccagaagaagagcactccaatcactcctaccacatccagaaggagcaaggttgcaatcccctccaagaagaggaaagaaatttcctcatccgattctgatgatgatgtcgaactagatgtctcgacatcaaagagggccaagaaatctgggagaaagtggaaatatgtgtatcaacgcagacttgcggttgagagagaactgggaagagatgccttggattgcaaggagatcatggacctcatcaaggctgctggactgctgaagactgtcagcaagttgggagattgctatgaaggcttagtcagggaattcattgtcaacattccctctgacatatctaacagaaaaagtgatgagtatcaaaaggtgtttgtcagaggaaagtgtgttaaattctcccctgctgtgattaacaaatatctgggcagacctactgatggagtgatagatattgatgtttctgagcatcaaattgccaaggaaatcactgccaaacgagtccagcattggccaaagaaagggaagctttcagcagggaagctaagtgtgaagtatgccattctgcacaggattggagctgcaaactgggttcccaccaatcatacttccactgttgccacag

SEQ ID NO: 9693 - DNA, 791 bp, Glycine max
  Peptide Sequence Number=SeqID_101378
tggtggtcgacgcctttcttgcttatcaccacaacaaggaaagcccggtcatcgctgttttggcagatgtatatgatacattcgacgtgagatgcaagaagagcagtacaagaattgtctattgtcaccacatgtgctctgaaaagggtaaagcaaatcaggaagcgctcttagcaggcataatgggagcgtttgttagttggttcccacggtggaaagaaggaggagcaggagtgttatgctcatgcaaaggattcccaaatgtccccttgatagggatgaggggctaccctatgagaggtgcatcttcaaaggaaatcatcacgcctttcatcacgcaaggtttcattgatgctaaagcgaagatactgcagaaaatccgtaaagcatggaatagagtggaaagaaaagataaggatcttaggggaagtagcaacagtgtcattggcggctatcacaagtggttaaagtctagaacgcaagggataacttggctcccaaagctaaaaagtctaagtgggaaagaggctaaaattcctgaggaaagtgaagaagtgcaagctttgaaagcaaagctcgaaaagacaagagtggtgaaagagaagctgaagacggcagtcactagggtcaggaaaaagtgtgatgagctgaaagatatcaacttgaccacggttgaagctaatgagctcaagcttagaaaggctgagagggacaaatcaaggatggaaagtatggtgctagaggataagttaaaggcttgtcagtggtcgaagagaagtttgacggaatag

SEQ ID NO: 9694 - DNA, 537 bp, Glycine max
  Peptide Sequence Number=SeqID_101379
atggaccaccagtgtgaattcagccaaaggaggagccaggcagacggtttcgatgaggaagccatcgcccaactgctgtgcatactggggcaggattttgcccggaccgctgtggggagacgggtgcggatcatgcgcaccagcatgactaccctgacccagatatggatgacactgctgctcaggaatgtcttgtctaacgaccacaactccgacctccctctgcctaagtgccaattggtgtatgtcatcttgacacggatgagcattcacgtggcccaggtgattgttgatgccatttatttgtttgtaggaatggcgtctactaggcaccctttggacctagagaagtccaatagggccctggggtttccggctttgatcacgggcctctgtcagttctacggagttcatgtcacccctagcaaggtaatccgactgtcgatcacccgagccttcattgagaaatattgcacgcctaggcaggcacagggagacgtacatcaggacgcgggcgcaccgccaccacctcgatag

SEQ ID NO: 9695 - DNA, 369 bp, Glycine max
  Peptide Sequence Number=SeqID_101380
gctcagggtgatgctccacaggccgcaggcgcgccaccaccacctcatcaggctggcccagctgggtcgtttgacatggagcagtatttacggcatgtggttcgccaggaggcggccaaccacagggcccatgtgcggaccaatgagaccctttaccagctgagcctcagcatgcagagccagggcttcacttctttttcatgccctactccagaccagttcagggcagaggtcgcgtggcccggggattggcccgaggcccaagcaggagaggcacccccagaggctcccgacgatggagaggaggcccacgaggacgaggagatggccgatttgcttgacttcttgggagggagtggagctacatga

SEQ ID NO: 9696 - DNA, 246 bp, Glycine max
  Peptide Sequence Number=SeqID_101381
atgtgtggtgtcgcttgtcaatgtcgggactcatatgcgattctcctcaaatttcagccagcccgcatcaattggactttgcaccttatgcttcaaggtcatacagtgctcaatggaatgccccagggctcctccatgatatgcacatgttgcgttcaagtcgtatcctcagaaaatggaggtggaggaaacctagcagaggtggtgtttgtcattggaagtgcgctaggtaggctctatggttga

SEQ ID NO: 9697 - DNA, 168 bp, Glycine max
  Peptide Sequence Number=SeqID_101382
aaaataagcaacatcaacaaaaggagccgctcaaaatacgaggacttgcattgcatgggaaccaataatcttccaagacggattcatgagatggatgaactaaaaaagaaaatggttgaagcagagagttcgcaaaatttacaaagcacccaagattctactaattga

SEQ ID NO: 9698 - DNA, 153 bp, Glycine max
  Peptide Sequence Number=SeqID_101383
tctaattcatgcatgttgatgcaagctccattggagcttgtaggcctaggatcttctttatcaatggattcctttgcttcttggaagatgaatagcagcggaataaaggaggaaggaaaagagagaggagacgccacttcaaggagaagatga

SEQ ID NO: 9699 - DNA, 267 bp, Glycine max
  Peptide Sequence Number=SeqID_101384
atgcatacgcatacgcatacgcatgcatattgttgtggtaaaacaggggcaggatctcttgggctaccttctggggtagagacaaaacgtgaacggcagaaaccaatcaaggtacttaaggacggatgcaagtggggatggggtcacgaaccgaccgatcgttgccccttctctgcgcgaaacaagcagagaatgtcgctgcaaggcagccccgtatcctttgtattttgcagctttcttttactatttgtttgttttaaaaagtaa

SEQ ID NO: 9700 - DNA, 2322 bp, Glycine max
  Peptide Sequence Number=SeqID_101385
atgcagaggcctccacctgaagattttctgttgaaggagaccaagccccaccttggaggcggaaaggtttccggtgatagacttaccagcacctatgatctcgttgagcaaatgcagtacctttatgtgagggtcgtgaaggcgaaggacttgcccgcgaaagatatcactgggagttgtgatccttatgttgaagtcaagcttgggaactacaagggaaccaccaggaatttcgccaagaacacacatcctgagtggaaccaggttttcgccttctcgaaggaccggcttcaggcctcgatgctggaggttaatgtgatagataaagatgttctgaaggatgacctcatcggccgggtgtggtttgacctgaatgagatcccgaaaagggtacctccggatagccctctggctcctcagtggtatagattggaggataggaagagcgacaaagcgaagggggagctgatgctggctgtttggatgggtacacaggctgatgaggcttttcccgaagcttggcactcggatgctgcgatggttagtgggagtgatgctcttgcgaacattagatcgaaagtttatctgtctcccaagctttggtatttgagggttaatgtgatagaggcacaggacctgatgccaactgataagggtagataccctgaggtatttgtgaaggctattctggggaatcaggccttgaggactagaatctctcaaagtaggagtattaatccaatgtggaatgaggatttgatgtttgtggtggcagaacagtttgaggagccgctgattttgagtgtggaggatagagttgcgcctaacaaggatgaagtgttggggaggtgtgccattcctttgcagtatgtggagaggagactagatgagaaacctgtgaacacaaggtggttcaatctggaaaggcatattgtgatagaaggggagaagaaggacaccaaatttgcaagcagaattcacatgaggatttgtctagaaggtggttatcatgttttagatgaatctactcactacagcagtgatcttcgcccaacagcgaaacagctgtggatgcctggtattggtgttcttgaactagggatattgaatgctcagggtttgatgccaatgaagacaaaagatgggagggggacaacggatgcttattgtgtagcaaaatatgggcagaagtgggtcaggacaaggacaatcattgatagctttgcaccgaggtggaatgagcaatatacttgggaggtttttgatccatgcactgtcattacaattggtgtatttgataactgtcatctgcatggtggtgacaaggctggaggggcaagagatgcaaagattggaaaggtacgggttcgtctttccacccttgagactgatcgggtctacacacattcctatccacttcttgttcttcacccgaatggggtgaagaagatgggtgagattcacttggctatgaggttcacttgttcatcttttgtcaatatgatgcacatgtattcacggcccttgttgccaagaatgcactatatacacccattgactgttagccagcttgacagtttgaggcatcaagctactcagattgtttcaatgagactgagtcgcgctgagccacctctgagaaaagaggtagtggaatatatgctggatgttggttctcacatgtggagtatgagaagaagcaaagctaacttcttcaggattatgggggttttgagcggcctaattgctgtaggaaaatggtttgatcagatttgcaattggagaagtccaatcactacaattctgatccatatcttgttcataatattggttatgtatccagagcttatcttaccaacaattttcctttacctcttcttgattggaatttggtactatagatggaggccaaggcaccctcctcacatggacacgcgtctctctcacgcggattcagcgcatcctgatgaacttgatgaagaatttgacacattcccgacctcccggccaaatgacctcgtgaggatgagatatgatagacttagaagcattgctggtaggattcaaactgtggttggggacttggccactcagggtgaaaggctgcaatctttgctgagttggcgtgatcctagagctacatcactatttgtgattttctgtctggttgctgctactgtactgtatgtcactccattccaagttgtggccctctttactggaatttatgttttgagacatccaaggtttcgttacatgcttccttcggtgccgctgaatttcttcaggaggctgcctgcaagaactgattgcatgctttga

SEQ ID NO: 9701 - DNA, 1470 bp, Glycine max
  Peptide Sequence Number=SeqID_101386
atgggcccttgcagcgatcaggacggtgtggacaacactgtctgtgagaaatacggcataagcaaggaaaaatggacccaattttgccagactcgcagagacccttcttgggaggatgtgcggaaaaaggcacaggacatccaaaaacataacactgccccccacgttttgtctcgtgggggttatgaatatttggagcagaagctcctggctgagaagaccaagaagaagctgaaggaagctgcacagtcaggaagcatggatggcgtcatcgaccttccatcccccgtcaaacgccacgtgaagtggaagatggcccgcaccaagaaaacaagggaaatgacgactgaggccgcaaaggaaatcgctgacaagatcggaaattcctttgaggagcaggcgtcacagggatccttcatcccccatggatgtcaggatgttctcaccgctgctattggatgtttagagcaccctggacgtgtctgtgctacaaatcagggaccagctagaggagtcgatcaaagaaaaagtgactcggcaactcatggcatcattcagccagatgcagtcccagttttagtcccagatgcaatctcaggcactgccttcgaagcctctggaaatgatcctgagacaagtgactcagataggtgcggcttgtacatcgaagcacatcctacccgcctggttgccctgggaagagtttatgagagattcattgttgttcataacactcttttgttgtctggccaagtaaaggtgggcaattcacaccttccttgcttgtccgacacatctggtcaagcctttatcacagcagcagttgtgtctccggcaaaaccacctcaaaagccggatccgaaggtcgatgatccgctttatctaatgacattgaccatcccaaagcttttcttgaggccttaccaggttacatgggatgccaccatgttcggggtctttaatccagacttcccactctacataaagcacaaagatctctccaaaatcgcacatggtggtcaatgtctcaacatatcagtgttacagttgtggattatgcacctgactgaaacaagtatgcgagcggggaattctgatctgtatggattcctcgagccacagttcattcagagcggacactgtcagatggtggtcatcctacctaaggaacgcctagttgtctggttctgttcattgcataacaggccagacaactaccttaaggggataattatcagtgctttaaaaggtcttgatgatgctccacagcctaaatcaaaggttgctactaggtggattgccgtcaagtgtaatagacaaaaaggaagcactgagggcggctattatgtgatgcactggatgtccaccataatattagaaagtttcaggaataactgggaagcgtattttaacgatcctagaccattggagccagagagattaaaggcgcttcagatccagtgggcataa

SEQ ID NO: 9702 - DNA, 420 bp, Glycine max
  Peptide Sequence Number=SeqID_101387
atgccaggtgccaacctgttggcaatgggttcttcatcagattcgacttcttccaagtcaatgaggttacctggagcagggagggcttcagcatttggagcggaggatgttggaacatctttattgacatcaggcacagaaacatctggggtggaagatgttggaacatctttctcagcatcaggcacagaagcatctttcagaatgctactcacaataccgcggattttcttgtccatctcctgtgtctacttccctaggacttgttgcaaggctagggttttcagcaatcttcactccctgttgtcttctgggaatcagtttctcagggacagaagcttgaccaggaattatttgtatgggttggatgttgaattctgggttgttcctgggtgcggagatgatgggtacagcgggtga

SEQ ID NO: 9703 - DNA, 186 bp, Glycine max
  Peptide Sequence Number=SeqID_101388
atggagggaggcataggtcccatagtagacctccctcccaaagaagagaaaaggatagaaggtcttgagagtgaagagagaaaagttccattggctacccttagcttccaagggtataccctctattggtggacttcccttgttagggaaagaaggattcatggggatcctctagtagagtattag

SEQ ID NO: 9704 - DNA, 414 bp, Glycine max
  Peptide Sequence Number=SeqID_101389
gccattgatgatcagtttattacatctgacaaggaccttgccagcacccttataatgcagttctcatccttaaagctccaagggataaggggtgtacatgatcacatcatgcgcatgagggatataatggctcaactaaaagccttggagggcgaaagggtgaacttaatcgttcatggaaaaaagaatggggatcaatacaaaaacaagagcaagattcctgctcaaccagtcataaagaaagattccaagtgtttcttttacaagaagaaagggcacatgaagaaagactgcttaaagtttaagagctggatggacaagaaagatactccattttcttttggtatggaaaacctaagcaggccagtaggaagtgagcaacacatctatttaggaggcaagatgagctcacat

SEQ ID NO: 9705 - DNA, 162 bp, Glycine max
  Peptide Sequence Number=SeqID_101390
atggacgagaactacctccacaactgctttgctcacaccggcgagctggaagttactatgaatgaaatgaattttctgtttcacatttcaatccttgggattgcgaatcgacggaggcagtacttttggcggcctaagtggtcctctaatctgagggtttag

SEQ ID NO: 9706 - DNA, 273 bp, Glycine max
  Peptide Sequence Number=SeqID_101391
atgtataaaaatttctttgcatatactcaaaaggctagttctcctttcttgacatgcttttactgtggtaggaaaggacatagtgcatcaacatgttattttaggaaaaatagtagtagcattggaaaaatggtgtgggttccaaaaggatctttagtcaaaaccaacattcaaggacccaagaaaatttggataaaaccccaaattatgctcaatgctctcaaagcaaagaggatggatcatggttgtggcataggagaattgctcatataa

SEQ ID NO: 9707 - DNA, 309 bp, Glycine max
  Peptide Sequence Number=SeqID_101392
atggagaagtattgcacgcctaggcaggcgcaaggtgatgtgccacaggccgtagacgcaccgccgccacctcatcaggctgatcccgctgggtcattaggcatggagtggtatctacagcacttggttcgccaacaggcggccaaccaccgggtgcagtttaggactgaggtcgcatggcacggaaattggcccgaggaccagacggaggaggcacctgcaggagctcccgacgatgcagaggacgcccgcatggatgaggagatgaaagacttgctcggcttcttgggaggaagcagagccacgtga

SEQ ID NO: 9708 - DNA, 243 bp, Glycine max
  Peptide Sequence Number=SeqID_101393
atggtagccataacccctgctaggtttcctcaacctccatttttccgaggatacaacttgaacgcaacatgtgcatatcatggaggagccctggggcattccattgagcactgtaagaccctgaagcataaggtgcaaagtctaattgatatgggctggctgaaacttgaggagaatcgcttgttgaatcctaacactgacaagcgacaccacacatggggaaattttgaaagctgttgttag

SEQ ID NO: 9709 - DNA, 465 bp, Glycine max
  Peptide Sequence Number=SeqID_101394
atgaagagaccgacaaaaggaaaaaaaagcatagcactcaaagcctcctcctcaatgcaagaagaagaagaagaagaagaagaagaagaagaagaagaagaagaatctgatgatgaagaagacttctcactctttgtgaagaagtttcagaaattcatcaaaaatagaataatcaagaagacttcaagattcaagaggaaagttgaagaacacttcaagactcaagaggaaaagttgaagaacacttcaagatttaagaggaaagttgaattcaagaatcaagattcatggatcaagcttcaagaatcaagatcaagattcaagactcaagattctagactcaagattcaagaatcaagagaagacttaatcaagataagtatgaaatggttttttttcaaaaatggagtagcacatgaatttttctcaaaacatgtttaccaaagagtttttactctctggtaa

SEQ ID NO: 9710 - DNA, 297 bp, Glycine max
  Peptide Sequence Number=SeqID_101395
atggcccttgcaaaagaacttatgggtttttcctcatttgattctgcttcctacaaagtgtttctgcacaacaagcatggcaccttctggttcaatactatcttgcttccttcggataacacaagagttgtgaggttgaggaagggagcaaagtttccgatggcagctattagtgaggatttgataaagaccacactgacagtgcatgcagagaaaccagtacaattcaaagtcagagcggtggtgatagataggaacaagaaacattgtgctggaacttatgagcaccgagattga

SEQ ID NO: 9711 - DNA, 210 bp, Glycine max
  Peptide Sequence Number=SeqID_101396
atggcctttgtggatgactgggtggtgggtaatgaggaggtaggggattttctatttaggaacgacagtcgcagcatgggtttctccttcattctcaccctcttcatttgccccagttttctcattcgtccaagcaagatgattaaatttgcctcttttcaaacccgcttcgatcctttacccggcgaagaccaaatccgcaaaacttga

SEQ ID NO: 9712 - DNA, 255 bp, Glycine max
  Peptide Sequence Number=SeqID_101397
atgggaggatattcagccgacaaggacggtgttaatgacactgtttgtgaaaagtacgacattagcaaggaaaagtggacccaattttgtcagagtagcaaagacccttcgtgggaggccattcggaaacaaaacactgcccctcatgtgttgtcttgtaagagttatgagtttcttgaaaagaagttgatggacgagaagaaaaagaaacaaggaggaagctgcttaatccagaagcacttacaccgtgattga

SEQ ID NO: 9713 - DNA, 483 bp, Glycine max
  Peptide Sequence Number=SeqID_101398
atgaccggacgccttcttgccggttcattggcttttgaaagccgcatccttcatgatctgattgtgcggatttttcttccacgatcttccaatcttgcccaggtttctgaggaagatcttgttatcatgtgggcctttcataccgggcatcaacttgactgggcacatttagtcagatatcgcatgcataaggcattgcgattaaatgctccattgccatatccacatcttattactctttttttttgccattttcaaattcctcttgattctgaaccttacgttccaatcaagagatcctttttaattggcgctgttgtgattgctcttgggtcaaaaagggcgctcaacccactgatgaagaaggcaacctaccagttgaagataattccactcttctttgaaggcttatggacaagtttgatgcttgtcttgatttcagggattgtcatcatcaaaaagggggagattgtagacaaatga

SEQ ID NO: 9714 - DNA, 563 bp, Glycine max
  Peptide Sequence Number=SeqID_101399
ctaagcgccagcttgctgcgcttagcgcttgtgttaatttcataaggcgcgctaagcatggcatctcagaaaagaaaatccattacttcttcatcttcttagatctgataggacagatacaaattttcttccctgaagcatgggatcgctacaccaacaacatctttggcaaaaagatcattcctgaaagaaatatgcagttgtcgtttaatgactttgaggaatttcaaggggaggtaaacaagaggaattggcataagaaaatcactactttagaagagggaagcatagatgtggcacttgtaagggagttctatgcaaatgtttatgatcctaaagacaagtcaccaaagcatgtcaaggcaaggggcaagagatctgaggcctcttccacagcaccatcagagacaggaggtccttcttcttctacacttcctccttcttcctccacagagatcccagtgattcctccagcaccttcacagattccactaccagctcctctctctataggtccagtagattttattttcactcctcagatgattcactccatgctctag

SEQ ID NO: 9715 - DNA, 283 bp, Glycine max
  Peptide Sequence Number=SeqID_101400
atgaagaggcataacttacacaaacacctcgccaatctccaagacggaagcatagatgtaactgtggtgaaggagttttatgctaacttatacagcccggaagaccagagccctaagcaagtgagggtaagagggcatttaatcaagattagtgctgacagcctgaacaccatcttagagaccccagtagttttggaggagggtgagacacttcctacctattccagatttacgaggatgaggattgatcctcaggagtttgctgcccgtctctacatccctg

SEQ ID NO: 9716 - DNA, 129 bp, Glycine max
  Peptide Sequence Number=SeqID_101401
atggataagagcttgaaggtaagagaagatgagtggagggagaaggagagaaggaacacgaaaacttatgcctcaaatgagcccactaatccaagatcaagtccaagattctccactaagtgtgcttag

SEQ ID NO: 9717 - DNA, 258 bp, Glycine max
  Peptide Sequence Number=SeqID_101402
atggaaaaatctgaaaagaagaatcatagtgaaaagaaactgaagaaagcatacatcacatgggatgaaaatgatatggaatcttctgaagattcagaaaatgaagagataaatctctgccttatggctaaaagttacgaaagtgatgaagaggtatctttgagaaagaagtggtacatagatagcggatgctcaaaacatatgactggagatgcatcaaattttacacacatctctccaaagaaaagcggcatgtaa

SEQ ID NO: 9718 - DNA, 567 bp, Glycine max
  misc_feature (48)..(48): n is a, c, g, or t
  Peptide Sequence Number=SeqID_101403
gagaactttgaagctccggaagaggatgaagaagtccgacctctaaanatagaactaggaaaagcaagacttgccaaagaaaaattcaagttagtcgctacagacgtccgtaaagagtgtgtcgagttacgaaaagaaaacgcagctaccgcaagagcccttgaacgagaaaccaagagggctcgcaaggaagagcatggccgagacaaatttcgtggagctttgtggggcagcaacagtgagctcaagcttcgaagggaagagaaagaccaatcacgagcacatagcatggtcttaaaagaggagttagctgcttgctcaaggtccaagagaagcttgtctcagtgtttatgcaagacagagaccaacatgttagccatcatcaataagtaccaagaagaattaaatctagccacggtccacgagcacaaagtggcggacgagtatgctcgggtgtatgcggaaaaggaggctagaggaagggtgatcgactcgttacatcaagaggcaacaatgtggatggaccgatttgctcttactttgaacgggagtcaaaaacttccctga

SEQ ID NO: 9719 - DNA, 1200 bp, Glycine max
  Peptide Sequence Number=SeqID_101404
atggcatctgttagaagaaccttgtctcccgtgcctagagctggaactgtagcaaatggagaagtgtgttcagtagcttctcccttgtcgaagtcctcatcgagtcctcagaacttctcaccatcggttggattggactaccgtgcacttgtgtttggtgttttctccccaaggtctttcagggctttggagagatcaaagccacgggggcagctttggaggaagatgctttttcattttttcatttgcttcatggttggtgtttctattggactcatcccacttgcatcgacacacatgtccgcaaatctcatgccaaaacaacaagccttctcctttgaggtgatatctgcagtggcaaatttccagccatttgaaaatgtaaatttaaatgtgaccccatcaatcaacgaggctgtgaattttaatgctactttgtattcaactgtgaaagaacaggaactaatagatggagtggcatataatgtctccaacagccaaatcagtgaaaatccatatttggagtctcagaagcttctcataattatgacttcccaatctgaagaaactgctgacatcttatggagtagtgggattatgtacaggcatctcatttgtaaaacaaatctaaccaacccaagccataggagcattcttcaaagaaatgttgcaatggcacacattgaaactcatcgtcttgaaggaattgtttactttgcagatgatgataacatctactcagtggaactctttcagcaaatgagagaaataaggcgatttggaacatggactgtagcaagattattaggggataaaagtagcattgtcttgcaagggcccatttgtaatggaagtcaagtaattggatggcatacagatgaatcaaatgggaaatctaaaagatttcatgctgaaatgccaggttttgccttcaatagtacaatactctgggatccgaagaggtggcaccgccccactcttgaacctatcagacaacttgattcggtcaaggaaagtttgtgggttagcacattgattgagcaggtggttgaagatgaaagtcaaatggagggcttaatggacaactgctcgagagttatggtctggcatattgatcttgaatcatcttattcgttctatcctcagaagtggattgtaaagaacaacctagatgccattgttcatcttccacttgtgtga

SEQ ID NO: 9720 - DNA, 2208 bp, Glycine max
  Peptide Sequence Number=SeqID_101405
atggccatgacgattagggttttcctcatccttctactctttctctcatctactcatctcagttactcgctttacgaagatcaagttggcctcatggattggcatcaacagtacattgggaaagtaaagcacgctttgttccatactcaaaagtctggacgcaagcgtgttttagtatccaccgaagagaatgttgtagcttcactcgaccttcgtcgtggagagattttttggaggcatgttcttgggaccaatgatgttgttgatggacttgacattgccctgggaaaatatgtcataactctttcctcggatggaagtatattgagagcatggaaccttcctgatggacagatggtttgggagtctttccttcagggatcagtggcatcaaagtcaatattatacattccaatttatctgaaatatgatatgtgtttttcttattgggtaaaaaacaattcttggccagactttacttacctcccggtcgaactccagattagtcagggtccttttcccttgatgaactggaggaaaaacctgaaagccgacaaggatgatttgatccttgtttttggtaaaggttgtctccatgctgtttccagcatagatggtgaagttctctggaagaaagattttgtgggtgaaagcattgaggttaaccatattattcagtctaccgacgagatatatgtagctggttttgttggttcttcaaagttttatgtgtatggattgaatgctaagaatggagaattgctaaagaatgatcataaagcacttccttgtgatacttttggggaattattatcagtctcaggtgataagtttgttgtgttggataaaacgaggtctaagatactaacaataaacatcaagaatggagagattagttacaaacagaagcctatttcagacctcatcgaggattcatctggacaggcagtaatattaccatcaaggcttccagagttgtttgcattacgtatcaattcccatgttcttttaattaaagtgacaaatgaaggtgagttggtgctggttgacaaaattaataatgcagcagctgttagcgatgctttgtcaattccagagggtcagcatgcttttgcatttgttcaacatgaagacagtaaaattcacctatttgtaaaggatgttaatgattggaatggtgatttgctcaaggaaagagtagtaatagaccatcaaagagggaacgttgataagatttttataaacaattatgtgaggacagatagatcttacggttttagagcattgatggtaatggaggatcattcactcttattagtacaacaaggagaaattgtctggagtagagaggatggtcttgcatcagttgtagatgtaaccgcatctgaactacctgtggaaaaggaaggtgtatctgtggcaaaagtggaacagaacctctttgaatggcttaagggacatgtgctgaagctcaaaggaactttaatgattgcaagtgctgaggatgtagtagctattcaagcgctgaggttaaggagttccgagaaaagcaaaatgactcgtgatcataatggttttcgtaagttgcttatagtacttacaagggcaggaaaggtttttgctttgcacactggagatgggcgtgtagtttggtctattctacttcatactctgcgtaaaacagaagtgtgtgaacatccgattgggcttaacatttatcagtggcaggttccacatcatcatgcattggatgagaatccttctatccttgtagttgggcgatgtggaccaagtttggctgcaccatctgttctttcttttattgatgcatacacagggaaggaactcaattctttgagtcttgctcatactgttgctcaagttattccactgccttatactgattcaactgaacagcgtctgcatctaattatagacataaaccgatatgcatacctatacccaagaacttctgaagctattggcattctgcaacgtgaattttcaaatgtgtactggtactcagttgatgctgataatggtgttatcagaggtcatgccttgaagagcaattgcattcacaaagtagtggatgaatactgctttgacttcaggaatttatggtctattgtattcccatctgaatcagaaaagattattgcaacagtaacaagaaaatcaaatgaggtatggtgcctttggcattga

SEQ ID NO: 9721 - DNA, 291 bp, Glycine max
  Peptide Sequence Number=SeqID_101406
atgttaggattcacaagcggttctcctcaaatttcagccagcccgcatcaattagactttgcaccttatgcttcaaggtcatatagtgctcaatggaatgtccaagaactcctccaggatatgcacatgttgcgttcgagtcgtatcctcggaaaaatggaggttgaggaaccctggcaggggttatggctactattgcattatcaagtagatatgggagcaagctttttgctgcaaaattcctttttggattgcactataggtggtgtttgggcattgggcgtgtggtaa

SEQ ID NO: 9722 - DNA, 552 bp, Glycine max
  Peptide Sequence Number=SeqID_101407
atgaccaccctgacccagatatggatgacgttgctcctcagcaacatcctgcccaccgatcataattctgacctccccatgccgaagtgccagctggtgtacgccatcctgacacggatgaggatccatgtggctcagttgatcgctgatgtcatctatatttttgcaggtatggcgcccactaggcaccctttggacccagataagtccaacagggccctgggattccccgcactgatcacaggactctgccagtcgctcggagtccccgttgcgcctaccaaggtgattcggccgcccatcacccaggcttttattgagaagcggccaaccaccgagcacatgtacagaccccatgattgtctgtaccagatgagccttagcatgcagagcccagggcttcgcttctttttcatgccctactctagaccagttcagggcagaggttgcatggcccagagattggcccgaggcccaagcaggagaggcaccccccccccccccccaccgatggagaagaggcccacgaggacgaggagatggccgatttag

SEQ ID NO: 9723 - DNA, 441 bp, Glycine max
  Peptide Sequence Number=SeqID_101408
atgggaaaagaaaccattcattctgaaatcgtaattatttctgttgacttggagaaggagacttgcagatcactgtttcttcccaacgatttttgctttgttgatacaaatattggagtttttagagactcgctgtgcgtttggcaagatagcaacacccatcttggcttgtggcagatgaggaagtttggagaagacaagtcttggattcaattaataaattttagttatttacatcataatattcgtccttatgaagaaaaatcaatgattttaccattgtgcatgtctaacaacggagacttcttcatgctgaaattcactagaaatgttgatgatgaataccaaacaattctgtataaccagagggatggtagtttcagaactttgttttggcgcaacctcaagatttttaccaaaagtttggtcataccttattga

SEQ ID NO: 9724 - DNA, 463 bp, Glycine max
  Peptide Sequence Number=SeqID_101409
atggcgcctcctctcacctcttctcctttgtcttccgctgcatctccatgggctacacgtcctcgccttcagaggactacacgtcctttcaactatcgaattcctgcagcccgggggatatgcgccactagttctagagcggccgccaccgcggtgggctccaattcgccctataggagtcgtattacaattcactggccgtcgttttacaacgtcgtgactgaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 9725 - DNA, 117 bp, Glycine max
  Peptide Sequence Number=SeqID_101410
ggttggacatgaatcatctctagaccctaggcggcaacaaggagagagaaagacacgtgacctacactccatgcctttctctttccttgtcgttacaccgtgcaaatggagatttgg

SEQ ID NO: 9726 - DNA, 468 bp, Glycine max
  Peptide Sequence Number=SeqID_101411
atgggatcaagtcaaacgccttcgcttaaaaagaggttctatcaagtcaaggtcaagagcctagggaccaccagtctaaaagagttagggcaattgatgggtcagctccagcgccaagcttttcgcaaagcttacggtaaaatctgggacctagccatggtagaagtctccacagaggccattgcctcccttgcccagtattatgatcagccattgaggaaaccatacctcttttcagggttctatccctcattagctagaatttccaagatagtccaaatctcggcgcaggaattggaccacaagaagcaagtcgaaaatggggtggttggaataccaagaaaatatttagaggcagaagcaagaatcttggcaggtaaagcgatcgacacttttctcacctatcataaccacaaggaaagcccgattgtcgctattctagctgacctatatgacaccttcgactga

SEQ ID NO: 9727 - DNA, 177 bp, Glycine max
  Peptide Sequence Number=SeqID_101412
atgaacaaagacttagaagtagcagcaactccagaagaagaacctcgatcttctgaggcgtcttctagctttcctattccagggcaatctcatacagatttaattgaagaagttattatggctgaagagccaagaaaagtgaccctggaagattactcaacttccactgtgccataa

SEQ ID NO: 9728 - DNA, 411 bp, Glycine max
  Peptide Sequence Number=SeqID_101413
atgactgaagttctttcagagttacggggtctccgcactatgttggtggacgattcgattccttggatggtcgctttgaaggcatggatactcgcatcacccagcttgaagaagacgtgggaattaaattgtcatcatcaaaaagggggagattgtagaagcaaagactttgcctttgatgttttgatgatgccatatgattgtgatgttttgatgccttatgaaaatgcgcttttcaagtttaattcaagacaaaaatccaagaatacaagatacaacatcaagaagatctctagtgttttaggaagggaattccaaattgaaactgtaaaaggtttggccaagaaatttaagcaaaaatgtctttttcaagagatttactctctggtaatcgattaccagaggatgtaa

SEQ ID NO: 9729 - DNA, 168 bp, Glycine max
  Peptide Sequence Number=SeqID_101414
atgtgccggagacttggagagttggagataatgcctactaggatgactttacagttagcagatcgctccatcaccagaccttatggagtgattgaggatgttttggttcgggtgaaggagtttgatgagaagattctgaaggagagaaccaagattgatccaggataa

SEQ ID NO: 9730 - DNA, 637 bp, Glycine max
  Peptide Sequence Number=SeqID_101415
tttgatgccacctctcttaatgccttcctggagacaccaccagttattcagccaggggagcagtacacttcttattccattttctgccgattgcgccaagatcctcaggagcttgcttccaagctctgcattccaggatgcggatttgttttgaatgctgaaggggcgccctggaagctgctgaggaaggacttgactactctagcgcagacctggagtgtcctgtcctattttaacctcacccccacctctcacacatccgatctgaatatggactgggcgagatggcctagtccaactcctctcgactcggcttcccagccctcatcaccgccttgtgcgtggccagaggagtcatatccgactctctcaccttcgaggagccgcaaggctcgggctcgaggatttgagggcccttcttcttttgctccccctgcttctactccagctccgtctacttcaactccaccatcagtagctccagctccagtttctacacctgctggcacctctgctcaaagctcagatctcacagtaccgatgttcccaggagcctcagccatagccggaggttactccagaggtcacactagaggtcactccacggacttcaccggtcactacaccacttgtggag

SEQ ID NO: 9731 - DNA, 315 bp, Glycine max
  Peptide Sequence Number=SeqID_101416
atggcaaatcatgtcatttaccagttgaaatggaacataaggtgtcgcaacctaccattcggtgggaggacgacgcgcggctcacaggtgcgtcttccaagaaaggaatacgcgcgaagtcgccaccaacgtttatttgaggaaaacgtcggaaaaaccacaaaagacatggtctacgaaactttaagtgaaagaggggtgtggatagataaggatctagcttctcaaagaagcctcttgagaagcttctcaagaaaccacgaggaagcttctggaggaagcctcttaatgaagcttctagagaaagctacatga

SEQ ID NO: 9732 - DNA, 427 bp, Glycine max
  Peptide Sequence Number=SeqID_101417
gaaagaatacgctttacggtgcccttatcgaacgcatgtcagagctaaagtaattagtgaaatagaggaagttcaggagcatatgaaggctgacatggagggcatgaaggacctaatggccgccatgatggagaccatgttgagcatgaagaaaataatggaaagcaatgcggtccattgggccatcacaaaggaagacccgactcacccatcgggcctcaataaagtaaatcctctagtctcggatatgataagtcaaggaggaaaagcattgggaagtacaggcggtccctatgttatgcaaagcaagaatcctttcccaccatacggcttgcctcccaactatgcaccacccaatattgtactggtgcccgatgagaacgtcgacaactccgcacccatacctattaagggccaacaaccctaa

SEQ ID NO: 9733 - DNA, 539 bp, Glycine max
  Peptide Sequence Number=SeqID_101418
ggccagtcaaggttggtgttgaggagattaaagatggagaggctctccttcctgtacccactgacgaggttaccttagtggggcaagcacttaacaccttccttgcttggccaacacatcttatgaagcgtttattagaacaggcagctgtgtctccagcaaaacctccagaaatcccagatgaagaggtcgatgatcccctgtacctgatgacattgaccatcccacaactgtttttgaagccgctccaggttatgtgggatgctaccatattcgaggtgtttaatcaaaacttcccgttgtatataaagcacgaagatctctttgaaattgcacacgatggtcaatgtctcagcatatctgttatacagttgtggattctgtcagacaactaccttaagggaataattaacagcaacatcaatagtttaatgttcctcatattcaacactagtgctttgaaaggacttgatgatactccacagccgaaatccaaggctgctgctaggtggattgttattaagttaacgtttaattaa

SEQ ID NO: 9734 - DNA, 364 bp, Glycine max
  Peptide Sequence Number=SeqID_101419
tcattttcaaattccgcttaatgatgagccatttgttcaagtcaagtgttcctttgctattggtgctggtgctgtgacttcctttggttaccgtaaggatcggaatggtcaatggctgaagaaagacgcactccctcctcaagatgagcgtactccttcacctcctcttcagcgtgaagattcagcactcctgaatgaagtccttaccgaattacgaggtcttcgttcttatgttggtgaacatttcgactcattggatacacgctttgccggcatggatattcgcctcacacaagttgaagaagatgtctccttcatccgtagttgctttgatccaccaccaccgcctccatcatcctcttag

SEQ ID NO: 9735 - DNA, 318 bp, Glycine max
  Peptide Sequence Number=SeqID_101420
atggatttcctggatttcaagcaggggaacatgactatggctaaatatgcagccaagtttgaggagttggtgaggagtgcaggcccaatgaagaacaaaaagaatggacctcaacaacggggaaaatcgtactcaacccctcctaagaaatatggtaatcgccccaacaatcagaggactgttgctatggggtttgctggtggtaatggtagcaaacccacttctttctcaactcagatcacttgttacaaatgtggtaagccagggcacatttcctcaaattatgctgataaaggcacgacttgtttcaactattga

SEQ ID NO: 9736 - DNA, 681 bp, Glycine max
  Peptide Sequence Number=SeqID_101421
atgatccttgatgcctcaactagaggcattatgatgtccaagagttcagaggaagccatagtaatcattgactccaaagtagccagtgattatcaaagtcatcatgatagagctccaactcaaagaaaaggtataacagaagtggacactcaaaatgcaattctagcacaaaacaaactcttgacgcaacaaattgaggccttaacaaagcagataggccaactccctcagcaatatcaccaaggtggaccacagaaaacacaacaagttcaccaagttcaacaaattttgagatgcaatttttgcggaggtccttctaacaactcttatggaggttcttcaaataagggtccacaacaacaacaacacttaaccaaacaaattgtccaagatagaagatactttaaaccagtttatgcagcaaccatagaggtcaacctaagagaacaatgtaaggcagttacaactaggaggggagtagtggttagtttaaaggacgaaagtgagtttggtgagaaaaagacaaatgaaggagttgtgaaaacaagtgaggaaaaagaaatcaacattccctttacaaaagcattagagcaaatgtcaacatatgccaaatacatgaaagaatttcttacaaagaaaaggagaatcatagatgatgaaacaatagagttggaagtatga

SEQ ID NO: 9737 - DNA, 299 bp, Glycine max
  Peptide Sequence Number=SeqID_101422
atggcgcaattagtggtatatgatggtggtaaggtcataggggcttggaacaaggaatttatcaagtttggtggatatggtgttttgagtggcggtaaggttgagctgattggaggtgagtttggcgatgatctcctcaatacggtacatattggacttggagctaggggtgttcacaagtacgggtcaccggcgaaccagaattgccttaaaccaatgcgatcagtttgggttgggtcatttatgtatttgggtcaaaaccaaaccgaaccgaatcaatcaaaaccgttcatgtacag

SEQ ID NO: 9738 - DNA, 654 bp, Glycine max
  Peptide Sequence Number=SeqID_101423
atgtacctaagcaggcgagctcctggcagtcaacagataaaaggaactaagaccacaaagcaaggaggcttgtgtaatcgattaccaggcaggcagcatgttgtggatgcctctggtaatcgattaccaggctgtgtaatcgattacacagaggaacatgccactggtaatcgaataccagttatgtgtaatcgattacacagtgcatttttgcagatcgtgatggcggcgcagctaatccatgatcgagtggagatggagtgcctagagggagcttgggagaccctcgaaggcaacacgaggtgccgatttcggggcacgattcgatttacagctacttcattggtgcatccagatgaacccgcgcgcacgcttcagcgtactgtggagtggatactacccacgcctacaccataccgtctagtggagccagtccaagtgatcgaggtgacgtcatccgaggaagaccctgaggaagatctcgaggagttacctcctgagcctgccgtggatgctcttgactttctagagggtgatgaggacccactccctgatgtggattctcccgaggacgtcatgtcggcatctgaggcagactctacggaggatagtggcctggagagatggcgattagtggaggctctttcatcatag

SEQ ID NO: 9739 - DNA, 285 bp, Glycine max
  Peptide Sequence Number=SeqID_101424
atggctcttggttcactttgcattagccaagcaaaactgcccatcatatctcccaaagccccatacccacgaaaatcaagtgagaaagaagtctactcaaacctgaaatttcgaggtcccacacgcagagatgcgcttcacgactccgaaaatgccttcctttcgcgatttggggcagaaatggtgtgcaaaggttggagctttaatggagtttcaatggaggatgaagaagaaagaaaaagcaacgtgagggagagggagaatgcttctgaaatgtggggctga

SEQ ID NO: 9740 - DNA, 840 bp, Glycine max
  Peptide Sequence Number=SeqID_101425
atgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatatttgagttccttggcgcacgaagcgccggggtttgtgtttgtcgcgaggacgaggaggccgggcgcacggggcgccgtggtcatcccctccgcgtcccgacggtagcatatcaacagcccgggcttgggccaccatcgcaatccgcgtcggtcaatgtcccgagtcgatcgctaggaccggacttctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggccgaccgattttcatggtgggcttttcccggttcgctcgccgttactaa

SEQ ID NO: 9741 - DNA, 213 bp, Glycine max
  Peptide Sequence Number=SeqID_101426
atgtcagtgaaaaacctcattgagcgcctaggagtacatgacaagacaaatcacacactgggagaccagtcagggttatgttgttttatgagaatgctccaaccatgtggaatcggcacaagcttaaaggagcactcaaactgggtgtatttaaccccaaggcctagactccgaagagtctgtcagggcctctccctcctgattcaggtctag

SEQ ID NO: 9742 - DNA, 568 bp, Glycine max
  Peptide Sequence Number=SeqID_101427
gtacaatcctgggtggaggaatcatcccaaccttagatggtcgagtccttcacaacagcagcaacaacaacagccttattttcagaatgctgctagcccaagcagaccatgcgttcctccaccattccagcaacaacaacaacaacaacaacaacagccccagaaacaacaaacagttgagactcctccgcaaccttcctttgaagaacttgtgaggcaaatgactatgcaaaacatgaagtttcaacaagagaccagagcctccattcagagcttaactaataagatgggacaattgactacacagttaaatcaacaacagtcccagaattcagacaaattaccttctcaatctgtccagaatccaaaaaatgtgagtgccattacattgaggtcgggaaagcaatatcaaggacctcaaccagtagcatcttcctcatccgcaaatgaacttgcccaacttcactctactccagaaaaagatgatgacaaaaatttaaagagtaagttgcctaacaatttctatgcaggtgaatcttctactggtaattctgacttacagcagtag

SEQ ID NO: 9743 - DNA, 165 bp, Glycine max
  Peptide Sequence Number=SeqID_101428
atggcgtgcccattagcgtgcgtaccaaaagagcccccatggacctctctcaacatgttttcagcttccatagcgttcacgcagcgtagcagaaccatgtcatggtccccgtgcggtgttagctggaacatggaagctaaagtggcaagcgtagctgccatttga

SEQ ID NO: 9744 - DNA, 306 bp, Glycine max
  Peptide Sequence Number=SeqID_101429
atgccggaatcatctcccaacatgcatgtgaagcaagaagtatcaacaagagtcaagccaagtctattgatgatcttcttcatcaatgaattccttttcttcttggaagatgaatggcaatggaatggagaaggaagagagagagagaggagacaccacttcaaggagaagatgagtctagaagaagctcaccaccataggaggccatggataagagcttcgaggaagaaggagatgaatgaagggagaggaagagaagagcacgaaattttgtgctctaaaagagctctgaaatctgaagtttaa

SEQ ID NO: 9745 - DNA, 315 bp, Glycine max
  Peptide Sequence Number=SeqID_101430
ggggagacaaactgctgctgctgatgatgactggtgtaagctactagctgatagaagatgctgcagtaagagcatggagacagggggagcagaatgtgagagagcattgagacagggggagcagaaagctgatgtcacgattcacgatgtcggatacaatgtccaggacatcctgcccgaaaatactggagttgctaaaagcattgaagctgcaggatccacgatgtcggatacaatgtccaggacatcctgcccgaaaatactggagttgctaaaaagcattgaagctgcaggatccacgatgtcggatacgat

SEQ ID NO: 9746 - DNA, 342 bp, Glycine max
  Peptide Sequence Number=SeqID_101431
atggaagagaacctctcgcctttccttgtgagagatttcggcgcgcaaagtttcaagattgtacaaagagtccacaaggcgagggaaagcccgttaaggaaagataaagaacttaggggcatccgaaatggcattattagtggttatcatgaatggctaagagttcatacacgagggttggattggctctccaagttgaaaattatcaacgaggagaacttcgaagctctggaagaggatgaagaagtccaagctctaaaaacggagctaggaaaggcaagactcgccaaagaaaaattcaagttagacgctacagacatccggaaagagtgtgccgagtaa

SEQ ID NO: 9747 - DNA, 201 bp, Glycine max
  Peptide Sequence Number=SeqID_101432
atgtcatcgatgggagaactaaaagtacttccctggggattacaaatcaagcaaactcaagaagatttgggatggaaagtgccaaaacacatggctacaccaatgagtactagctgttacttagataaagatgaatctggtcaatctatagacatgaaacagtatcgaggtttcaatccaaccccaaacaatcacatttga

SEQ ID NO: 9748 - DNA, 288 bp, Glycine max
  Peptide Sequence Number=SeqID_101433
atgatccttgatgcctcaactggaggcacaatgatgtccaagagtttagaggaagctatagtaatcattgactccataacaaccaatgattatcaaagtcatcatgatagagctctcactcaaagaaaagcacctggtgatagacaacaagaagaggaggcccattatgtacagaaccaagccagacctcaacaaaactttcaaggaagctatcaaggctataaaggtggtccaagttcaaatcagccttattatggttggagaccacaaaattctaagccccactaa

SEQ ID NO: 9749 - DNA, 399 bp, Glycine max
  Peptide Sequence Number=SeqID_101434
atggctagaacaaattcagaggggctctgtggggcagtaaaaagaagcttgtctcagcggttatgcgagaccgagaccaacatgttagcaatcatcagcaagtaccaagaagaattaaatctagccacggcccacgagcacaaagtggcggacgaatatgcccgagtgtacgcggaaaaggaggctagaggaagggtgattgactcgttacatcaagaggcaacgatgtggatagaccgatttgctcttactttgaacgggagtcaagaacttccccgattgctggccaaggccaaagcaatggcggatgcctactccgcccccgaggagatccacagactcctcagctattgtcagcatatgatagacttaatggcccatataattaggaaccgctaa

SEQ ID NO: 9750 - DNA, 585 bp, Glycine max
  Peptide Sequence Number=SeqID_101435
atggagttggacactcatagtgcaattctagctcaaaacaaagtcttgacgcaacaagttgaggcctcaacaaagcagataggccaacttcctcagcaatatcaccaaggtggaccacagaaaatgaatcaagctcaccaagttcaacgaatttttagatgtgatttctatggtggaagctacaaaggctatagaggtggctcaagttcgaatcagccttatggctggagaccacaaaattttggtcccactaacacttctttggtaggtccttctaacaactctaatggagattcttcaaataagggtccacaacaacaacaagctcaactagacagattgtccaagatggaagatactttaaaccagtttatgcaggataatgatgagaaaaagaataaaaaaggagttgaaaaagaaaacgagaaaaaggatgaagtggtgactagtgaagaagtggaagaaaaaatgattaacattcctttttctgaagtattagagcagataccaacatatgctaaattcatgaaggatttgcttatgaaaaagaaaagaattatggatggtgaaataataaagccttag

SEQ ID NO: 9751 - DNA, 540 bp, Glycine max
  Peptide Sequence Number=SeqID_101436
gatttagaagcagcagcaattccagaggaagaacctcaatcttctgaggcatcttctagttttcctattgcagggcattctcatttagatcctatcgaagaccacatcatggctgaagagccaagaagagtcaccctggaagattattcaagttctaatgtgccacaatttttcaccagcattgctcaccccgaagaggattttctggattccaacatggccagcaatacaatcaacaacagggacaatggaggaaccaccctggaaatcaattcaatagagatcaaggtttctatgtccaaccagaagagcacagagtcagccataaagaatctagagattcaagtgggacaacttggaaagcaattggcggatagatcatcaagcagttttacagctaatacaaagaaaaatcccaaggaggagtgtaaagttgtgatgactagaagtagaatggcaatccatgtggatgtgagtgaagctgagaagaagatgggggaacgtaaacaacagctgacacctaagccagcacttgaaccc

SEQ ID NO: 9752 - DNA, 456 bp, Glycine max
  Peptide Sequence Number=SeqID_101437
atgttcattgaaatatgtaacactattaagatcaccggtgtaccagatgaagctattaggatcagccttttctcattctcattggcaggagaagccaagaggtggcttcactcattcaagggcaacagtctgaaaacctgggaagaagttgtcgaaaagttcttaaagaaatacctcccagagtccaagactgcggaagggaaagttataggttgtaccatctgtggtgaggctcatgaaataggccaatgtattcccactaaagaaaacactcaagaaattcactacatgggaaatcaacagcgacaagggtatactcaagggggattttcaggctttcagcagggtccctataatcaacaaggacaatggaggacacaccctggcaatcagttgaacaaagaccagagtgggccttcaaataggccaatccaacaaggacctaacatattctag

SEQ ID NO: 9753 - DNA, 363 bp, Glycine max
  Peptide Sequence Number=SeqID_101438
atgttggataaacagggagctgtgggaccagcaaaacctgcagatagaccagatcataaggtcgatgatcccctatatctgatgacattgaccatcccacagctttttttgaagccgttgcaggttatgtgggatgctaccgtgttcggggtgtttaatgaagacttccccttgtacataaagcatgaagatctgtctaaaatagcacatggtggtcaatgtctcagcatctctgtcatacagttgtggatactattcttacataatttacttcgtgttaacaacaatagacatctgactgagacaagtatacgagcggggaattcagatgtgtatggatttctcgagccacagtccatatag

SEQ ID NO: 9754 - DNA, 300 bp, Glycine max
  Peptide Sequence Number=SeqID_101439
atggagggaaagaggaacaaggaaaggaaagggcttatctgtagtcagcatgatttggagggtattgagaattgtaaacaaagttgccatcttcaactattgacaatggggttccttatcacaaactgttcaacaaacttcctcattattcatttcttagggtgtttggttggtcatgcttcccctttcttagaccatacaacaagcacaagttccaattcaaatctcaggaatgtgtcttcttgggttattcctgatggaagcttgcttgtggagcttctatggaggctggatctttga

SEQ ID NO: 9755 - DNA, 609 bp, Glycine max
  Peptide Sequence Number=SeqID_101440
atgcagtcccagggactcgtactgcctcctgagcctgaggttggtccttctgttgcctatgtaagcacaaagggaagttgtgtcaaacccttagggcgggacccagacatgggtgaatcaaacaaatttgggttgtatgttgatgacaatcctccccacttggttgtccttggaagagttaatgaggggtcaaaaactatccacaatgtccctttgggaaatgatcaagtgaaggtcagtgttgagaaagttagagatgctaatgctcatgtccctgtacccactcacgagggagctagggaaccatcaaaacctatagataggctggaacctgatgacgataccctataccagatgacattgacaatcttgcagcttttcctcaagcatatgttggtgtcgtgggattcaactatgttttgggtgtataatgatggcgtccccttgtacataaagaatgaagagctttctaaaatagcacacggctcaaaagacctgtctgtcctcctcactcaagctgccattgaggttttagacatagtcttggctcctagttggtgggttcatgagttggtgggttcacgagctggtgagttcgttgtttcttag

SEQ ID NO: 9756 - DNA, 381 bp, Glycine max
  Peptide Sequence Number=SeqID_101441
atgatgagaggccctctcaaagagtcaacctcttgctttctcataagattgagccctttgtgcaaagcaaggaaccattcagtgttccgatcaggaagacaaaagataccaagaaaggagggcaaaagggtctttttcttgtttttcctaggccctaggtcgcccaggccagcatttggctcacctgggccaccaaataacttcaaggctaagggactagctcgtctgggcaagctgcaaccaccccagggtggccttttgcctataaataggcatcctgggggtgttttaaagggttccaaggttcagaagtggagggaattgagagaactaagaaagaagaagaataaagaagaggaaacaaagccgaggtgctactga

SEQ ID NO: 9757 - DNA, 114 bp, Glycine max
  Peptide Sequence Number=SeqID_101442
atgggtttaggaggagtgttgatgcagaatggtcagagagaggttggtgagtttgtgtatgcgtgtttagtctgccagaaggctaagatagaacatcagagaccttcagattga

SEQ ID NO: 9758 - DNA, 978 bp, Glycine max
  Peptide Sequence Number=SeqID_101443
atggccaattccgatccagaaatagtcctcgaattttatgccaatgcttggccaatagaggagggcgtgcgtgacatgaggtccttggatgctatcggccagctcctgggatatccgttagtgtcggaagagggccagaagtgcgagtatggccagaggtggaaccggtctaatgggttcgatgaggaggccatcgcccagttgctatgtataccggggcaagattttgcccgaactgctgtcgggagacgggtgcggatcatgcgcaccaacatgaccaccctgactcagatatggatgactttgctgctcagcaacatcctgcccaccgatcataattccgacctccccctgccgaagtgtcagctggtgtacgtcatcctgacgcggatgagcatccatgtggctcagttaatcgctgatgccatctatatttttgcaggtatggcgcctaccagacaccctttggatccagataagtccaacagggccctgggatttccggcgctgatcacagggctctgccagtcgtttggagtccccgttgcacctaccaaggtgattcggccacccatcacacgggattttattgagaagtactgcacccagagacaggctcagggggatgctccgcaggtcgcagacgtgccgccacctcatcaggctggccagactggatcgtttgatatggagtggtatttgcggcatttggttcgccagcaggcagccaaccaccaggcacatgtacagacccatgattgtctttaccagctgagcctcagcatgcagagtcagggcttcgcttctttttcatgccctactccagaccagttcagggcagaggtcgcatggcccggggagtggcctgaggcccaagcaggagaggcgccagaggctcccgacgatggagaggaggcccacgaggatgaagagatggccgatttgcttgacttcttgggagggagtggagctacatga

SEQ ID NO: 9759 - DNA, 156 bp, Glycine max
  Peptide Sequence Number=SeqID_101444
atggaccctaagagaataaaggtcattcctgagtggcccactccaccatgtgttgaggaaagaatccatgagtttcaagatcctatggatttgaggtcaaatccttttcaaggaggagtgaatgatgcaatcctaccccccaagggtattggatag

SEQ ID NO: 9760 - DNA, 246 bp, Glycine max
  Peptide Sequence Number=SeqID_101445
atggaagtgcttcgtagtccaatatgtggaagcaatgccttccaaggttattttgatgatgccaaagaatcaagaattaagcaaagtttcaagcaaagattcaagaatcaagtttcaattttcaagattcaagattcaagaatcaattttcaagaatcaagaatcaagaagaatcaagatcaagattcaagaatcacgagaagactcaatcaagataagtattacaaagtttttcaaaaccattga

SEQ ID NO: 9761 - DNA, 183 bp, Glycine max
  Peptide Sequence Number=SeqID_101446
atggctgcggagtgtagagggaagaaagatgattggagacaccacttcaaggagaagaggagtcaagaacaagctcacccccataagaagccatggataagagctttaagcctactaatccaagatcaagtccaagattctccactaagtgtgcttaggtgtcatgaggcatgtaaagcatga

SEQ ID NO: 9762 - DNA, 228 bp, Glycine max
  Peptide Sequence Number=SeqID_101447
atggatgctttgttagggtcattcaatagtggaagctggtctgattctaaagtccttgatagtacgtggctaagttgttgtactgtcatgaggaatcaggtcatggctgagtttagtcttagaagaggaatctgcagacgaggcttgatcaggattaggctaggctatcatgaggaatcggggtctagcagtccaggagacaacataggaatacatgagcattgttag

SEQ ID NO: 9763 - DNA, 1336 bp, Glycine max
  Peptide Sequence Number=SeqID_101448
atgacgcacaacatcgactatgccgacctatatttccaatacagccgtagcgagtcgtgggggctggaagaaggacaggtcaaatctggcagtttcaatattgaccaaggcgttggtgtgcgtgcagtgagcggtgagaaaacagcgttcgcctattctgacgatatccacctggatgccttacagcaagccgcgcaagcgacgcgcgccattgccaacctgggccaggaaaaaaccggccacagcattattacgcgtagccatacccccctctacctgccacaagacccgattgcgagcctgagtgcagatgccaaggtcaaactgctggaaaaactcgaaaaatatgccaaagcgcaagacccacgtatcatgcaagtcatggcctccattgctgccgaatacgaagtggtgctggttgcacgcagtgatggtgtcatggctggcgatgtacgccctttggtgcgcttatccctgcaagtgatcgctgaacataatggccgccgtgagcaaggctccagcggcggcggtggccgctttgattacagctactttaccgacgaagtgctacaagattatgcgcaaaaagccgcacaccaagcgctggttaatctggatgcacgccctgctccggctggcagcatgaccgtggtccttggcaacggctggccaggcatcttgctacatgaagcgattggccatggcctggaaggtgactttaaccgcaaaggcagtagcgccttcagcaatatgataggcaagcaagtcgcatccaaaggcatcaccattgttgacgacggcaccatcgctgaccgccgtggctctttaaccatggacgatgaaggcaatgcgccacaaaatactgttttaattgaagacggcatcctgcgtggttacatccaggacactttgaatgcccgcctgatgggcatgggtctcaccggcaacgcacgccgtgaaagctacgcgcatatccccatgccacgtatgaccaatacctatatgctcaacggcgacaaagacccgcaagagatcatcaagtcggtgaaaaaaggcctctatgcagccaactttggtggtggccaggttgacattaccagcggtaagttcgtctttagcgcggccgaagcttatatgattgaagacggcaaaattacctatccggtaaaaggtgctacactgattggcaacggccccgacgtactgaccaaagtcagcatgattggtaatgatatggcgctggatagtggcgttggtacttgtggtaaagaaggccaaagtgtgcctgtgggtgtgggtcagcctactttgaagattgatgggttgactgttggtg

SEQ ID NO: 9764 - DNA, 78 bp, Glycine max
  Peptide Sequence Number=SeqID_101449
gagacgccacttcaaggagatgcgagtcaagaacaagctcaccaccataagaggccacgaataagagctagaaggtag

SEQ ID NO: 9765 - DNA, 376 bp, Glycine max
  Peptide Sequence Number=SeqID_101450
tggtagaagcgggttgaaagagttttttgtcgaaggggttgaagagtttgtaagaaaagttagtcagcaagatttctatgagaatgatggggggatcagatgtcgttatgttaaatgcgattgcactaggattttggaggatagggttgtgaagggcaacaattacatggatgtttctagtagtgcaaaatatgtgactcaacataaacaagttatgttaatgcaagacatggctaagaggattgactgttatgtggatggctgcatgttgtattatgacaatgatgtagcattaaccgaatgtaaattttgtaacaagcccaggtatcgtgccaagaatgttggaacaagcaacaaaaaaccagttccagtaaag

SEQ ID NO: 9766 - DNA, 600 bp, Glycine max
  Peptide Sequence Number=SeqID_101451
atggctctcactttagtcaaaagaaaagacccaagggtcaaggaatctttaggggtgagaccttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtgaaagtgaagaagcaaaaggggaagaatctagtgaagaaatctacccccaagaagaaggacaacctataatggttaaggaggagtgtaaggaggtaagtgtctcctccaagaggttagttaagaagaaaagtcattttgaaataaagacaattattaaagaaacttcccctcttagacaacctccacatcttctcctttgtaaaaagacacttgttagcactgccacacctcttgggcttgaggttattcctcaagtaaaggagttgttggatgagtatttggttcgtaagagcttaaatcaaaaaagaaaatgttggtgcccaaaatag

SEQ ID NO: 9767 - DNA, 456 bp, Glycine max
  Peptide Sequence Number=SeqID_101452
caacattctgcccagcaaccgcaataccgatctccccctgcggaagtatcagttggtctgtgtcgtttcgacatagggatcgtgcccacaaggcacccagtggactcggaggagcccaacgggaccctggggtttccagctctggttacgggcctcgatcagtcctaccggatgcctgtccccccagcgaggtcatgccattgtgacatagggatcgcgcccgcaagacacccagtggactcggagaagtccaacagggtcttagggtttccagctctgattacgggcctgtgtcagttctacggagtgcccgtcgccccagcaaggtcattaggccccctactaatcaagctttcatcaagaggtactgcgcccccaggcaggcgcagggcgaaacaccacaatagcctggggatggccggcagcgggcaacaggcgcaccgccaccacctctag

SEQ ID NO: 9768 - DNA, 435 bp, Glycine max
  Peptide Sequence Number=SeqID_101453
atggaagaaccatcaaagaagcgcaaaggttattcgagtagaagccaacggcactctgaggctcaggatactccaattccttcctccatttccccctcctcattgttctcattggaagaacaccatacacggataaagatggtcattgaccaatccctcttctatgatttgacccaattgtctagtgacggtgtaccatttgaagatgcactagatgatgagtggaagtttgatttttctgtgcataatgcccaccggttggtttgcaccaaccaagcggatatgaccagaaggttgcttgccggttcattggctcttgaaagccgcatcctccattatctaattgtctgtatcttacttcctagatcttcaaaccttgcacaggtttctgaagaagatctaatagtcatgtgggcctttcctaccggccaataa

SEQ ID NO: 9769 - DNA, 192 bp, Glycine max
  Peptide Sequence Number=SeqID_101454
atgagggacgacaagaggtcttcatacaccattgggagtggggtgaattctggaattggcctcgggggaaagatcctcattgcattggaattgccggctgggcgagttgtgaggagttcccgacgtgagctgagaagctcagatgatgttgcgcgtactgatgtgtaccatgagatgtctgtgggggtttga

SEQ ID NO: 9770 - DNA, 243 bp, Glycine max
  Peptide Sequence Number=SeqID_101455
gacagagagcttaggggaagtagtaatgggatcatcggtggctatcataagtggctgagagtccgggcacaaggattggattggctcccaaatctaaaaactgcgagagaagatgaggttaaagcttcggaagaaagtgatgaggtacaagccctaaaggcagagcttcaaaagcccggggtgaaaggaatcatcatgggtcaaaggcatgatcttgaaggacgagctaaaggcttgccttag

SEQ ID NO: 9771 - DNA, 477 bp, Glycine max
  Peptide Sequence Number=SeqID_101456
gcttggaggggttgatggggacccggtgctgagaggaatgaggagaagggctacgtgggcaactggggatggtgtgcttatgcctgggcttgtggaaatgggatattttttttgcgccatcgcccgatcaccacctagtaccacatatgacggagtggtacttgaggatatgtccgcgggggtcaggagaccttggggatgtcagaacgcgatggcagcgcagttgatccatgatcgtgtcgtgatggagtgcctagagggtgtttgggagacccttgaaggcaatgagaggtgccgattccgtggcacagttcgactcactgctacttcgctagtacatccagagcaacccgcacgcccacttcagcagcctgtggagtggataatacctatgcctactccatatccactagttgagcttgttcaattgatagaggtgtcatcctctgaagaggaccttgaagaggacccaaagga

SEQ ID NO: 9772 - DNA, 510 bp, Glycine max
  Peptide Sequence Number=SeqID_101457
tttctgtgggagccttacacagcaactgttatgtcgatgttacctcccatttgtttggttggcagtatggcgtgtggcccccacccggatagagtgttgcgacaatttggaatgcaacaacctattccggagtctcctgcgcaaccatggaatgtccacgggctaacactgaaaggcaaacaagatgaaaattggttccagctgttggccccatttatcagtcagtggaataatcgagctgagtttagggtcgacgtttatcctcgacaagagggcctattgagttttaactcggatccatggtgtgagcaagggaggatcactgagcctgtgacacatggtccagcatcagagcgtcgatttcccccacaacagtttgacatgcttcagtcaagtgttgaaactcgaggttttgacagacgaagggagattgttcaagcggaagatttttcccaacaaatggagcagcgtggccatggaatgtattacacgccaccaacattttcttag

SEQ ID NO: 9773 - DNA, 339 bp, Glycine max
  Peptide Sequence Number=SeqID_101458
atgaggatatgggctacgtgggagtacgtgagctcagctgcagagtggtacctggagatatgtcacgggggtcaggagaccttggggacgtcaggtggggtgctattgcccaaaaccaagcttgaccaatcccgacccaaccccgggcatagccagtcagtgagaacctgtgatgtacctaagcaagcgagctcctggcagtcaacagataaaaggaacaaagaccacaaagcaaggaggcttgtgtggtggctggccagctgtgaatcttgtgtgatatatgggttatggcctctagtaatcgattaccaagggtgggtaatcaattacaaggcttaa

SEQ ID NO: 9774 - DNA, 213 bp, Glycine max
  Peptide Sequence Number=SeqID_101459
atgacattgctacttagcacccttcttcccagcgaccaccactctgatctcccctgccaaagtgccagctgggatcgcgctcgcaagacacccagtggacccgaagaagtccaacagggccctgaggctctaggtctgattacgggcctctgtcggttctacggagtgaccaccactccgatctgttggatcaagtggcctcggaataattaa

SEQ ID NO: 9775 - DNA, 464 bp, Glycine max
  Peptide Sequence Number=SeqID_101460
gactctgccagtcgttcggagtccccatcgcacctagcaaggtgatttggccgcccatcacccgagcttttattgagaagtattgcacgcagagacaggcccagggggatgctcttcaggtcgcagaagcgccgccacctcatcaggctggcccagctggatcatttgatgcggagcagtatttacggcatttggttcgccagcaggcggccaaccaccgggcgcatgtacagacccatgattgtctttaccagttaagcctcagcctgcagagccagggttttacttcttttccatgccctactccggatcagttcagggcagaggtcgcatggcccggagattggcctgaggcccgggcaggagaggcaccagcagaggctcccgacgaggcagatgaggcctgcgaggacgaggagatgaccgatttgcttaatttcttgggagggagcggagccacatga

SEQ ID NO: 9776 - DNA, 511 bp, Glycine max
  Peptide Sequence Number=SeqID_101461
gggtgccattaattggtccaacaaatcttgattgggctgatttatgtgatgaattgttaggagtcagaccacaggaaggaggtgtcctcttcgttaacaaaagcagtgccagagtttccctaagacagatgtgcagtgccactgattacaaaattaaatcaatcggaggtatgtgcatcttaatccaaatgtgggcatgggaacgatgcacgactttggctccaaagaggatgtctcccgtaatagaaaataaaccactcagacacaggtggctgcgacgtggaaatcaacatattggcaatgaagatctaagagtttttcgtcgcaaattggatattatgaaacaacatgagccttacacagcaactgtgatgtcagcgttgcctccaatttgtatggttggaagtgtagcgtggttcacggtggtgccattgatttgtttccatgttgttgagtggcaccaacccgatagagttttgcgacaatttggaatgcaacaacctattcccgg

SEQ ID NO: 9777 - DNA, 84 bp, Glycine max
  Peptide Sequence Number=SeqID_101462
atgaagattactcccgccgtctcaaaacaagctaagcaggatattaggaagggaggcagattcatgaaggtgtaccatgggtga

SEQ ID NO: 9778 - DNA, 176 bp, Glycine max
  Peptide Sequence Number=SeqID_101463
gcctagggatcttcttcatcaatggattcctttgcttcttggaagatgaatggcagcagaatggagaaggaagagagagaggaagacccccttcaaggagaaagatgaggtctagaagaagctcaccccccataaggaggtcatggataagagcttggagggaagaagggagatga

SEQ ID NO: 9779 - DNA, 213 bp, Glycine max
  Peptide Sequence Number=SeqID_101464
atgaggaggaatacttgtactggggggcatatcactcggttgggaactcccttgagactcaagctaatcaccgggggggggggagttgccttttcacgacagggtgacctcgacacttattggctagttttcctaaatgcccacttggccgacacatcttgtcaagcgtttctcaaaacagggagttgtgagattggggaaacctacaaatag

SEQ ID NO: 9780 - DNA, 243 bp, Glycine max
  Peptide Sequence Number=SeqID_101465
atggtgtcgcaacctacccttcggcgggagggcgatgcgaggctcacgggggcgtctttcaagggaggaaaacacgtggagtcgccaccaacgtttattcgggaaaaacgttggaaaaaccgaaacgtgtggtctatgaactttaagtatgaaaggtttgggagttgtttttatgcatggggaagggtgtttccctcgctactacgtatcctagggtgtgatgaggaaatcagacctacgtag

SEQ ID NO: 9781 - DNA, 144 bp, Glycine max
  Peptide Sequence Number=SeqID_101466
atggttgtcatcatcaaaaagggggagaatgtgaatgaatatcattcaggttttgatgatgccaaaaatgttacttggcaaaaagatccttactgtgacatcccctatcccagcatgcatatagtgaaagaaaacgtagaataa

SEQ ID NO: 9782 - DNA, 165 bp, Glycine max
  Peptide Sequence Number=SeqID_101467
atggataagagcttgaaggtaggagaagatgaggggagggagagggagagaaggagcacgaaattttgtgccttaaaagagctatggttcaacccactaatccaagatcaagtccaagattatccactaagtgtgcttaggagtgatgaggcatgtaaagcatga

SEQ ID NO: 9783 - DNA, 222 bp, Glycine max
  Peptide Sequence Number=SeqID_101468
atggagaaggagcttcaccaccaagatgagccttggataagaagcttggaaggatgcttcaatggaggaaaagaaagagggagagaaagagagaggggggagcacgaaattgaaggaataaaagagggagagaagtggaactttgaagtagcttccttgagaagctttcttgagaaaacttccttgagaagcttttttgagaaaacttccttgagaagctag

SEQ ID NO: 9784 - DNA, 550 bp, Glycine max
  Peptide Sequence Number=SeqID_101469
gttgcccacaaactacagagagattgaggctgctctttgcataccagggagggggttcatcttgaacgctgagggccatcctgggaggattctcaagaaagatttgactacattagcccaggtgtggagtgttctcttatactccaacctggcccccacatctcacacctctgacctgatagtggatagagctaggctgatctttggcttaatctctcacatggagatgaacataggagcgctcatttctggccagatgacttctatagcccagtctaactcttctagacttgggtttcctactctgatcaccgccctatgtcgagccagaggggttgtctttgacagcctcacttttgagcgcctgagcccggtcattaatttggcctacatcaggaagaactgttggaatcctgatgatctgacagtttctattcgaggggctaggagggcgagggtgaggccagctaatcctccttccacatctgtagctcctactccagcatccacttcaacaaatccttcaatcctagctcaaattgattcttag

SEQ ID NO: 9785 - DNA, 300 bp, Glycine max
  Peptide Sequence Number=SeqID_101470
atgggtgaagtaaaggaggcgcatgagcagatgaaggccgacatggaggccatgaaagagcaaatagccacaatggtggaggccatgatgagcatgaagaagataatggaagccaatacggttgcagttgccgctaccagcgctgttgctaaggtgaacccgatgcccccatctgatctcaaaccaaatgaatcatccaacctcagatatggtgggcaaagatttgggaagtacggacggccccatgatgtgcaaattcaaaataagtacaccttcccgccatatagcttgcctccctag

SEQ ID NO: 9786 - DNA, 252 bp, Glycine max
  Peptide Sequence Number=SeqID_101471
atgtcctttcaagccttggaagtagtgagcaacgcttatgtggagtctcccccggtacaaccacgctcatctggggccacattgatggtggcttcggtgatgttgggacatggatacgagcccagaatgggtttaggccggaacgacaatggcatggcgagtttggtagagttcacagggaaccgcggaaggttcggactgggatatgagcctacgcacatcgacgtgagaaggattgccctagaaaggagg

SEQ ID NO: 9787 - DNA, 169 bp, Glycine max
  Peptide Sequence Number=SeqID_101472
atggctagtgtggactacattaacacctggtggattgattctagatctactatccatattacaaattctttacaaggtatgcaaaacctaaggaagccagggaagttcaagcatttattagacaataagttcatcactgatatttattgtacaaatatggaggcacatg

SEQ ID NO: 9788 - DNA, 593 bp, Glycine max
  Peptide Sequence Number=SeqID_101473
atgaaagataagagggatgaggaagaaaaattagaaaaagaaaaattagaaaaagaaaagaaaaagaaggatagtaaggccttgtcttcaaaggccagggagaaggaaaaagaggaaaaggattcctccaagaagattgttaagaaggaaaatcattttgcaacaaaaggtgatattaaaagagcactccttcttaaacaatctttctaccttctcctatcaagggaaacatctcttagcaccgccatacctcttgagcttgaggttattcctcaagtaaaggagttattggatgagggtttggttcgcaagagcttaaatccctatgctttgttggtgcctaaaataggtattattaggcaccaaatccctatgataggtggtatgatgaatgtgttgagtggtgcaacactcttttgtaaaatcactcatgcacccaacatcttcatgatttgtgtacatagggactcattaggtagtgatcaagggcttcccatggaccctaagagaataaaggtcattcttgagtggcctactccaccaagtataagggaaatttggggtttcaatatcttaacaaacttttacaaaag

SEQ ID NO: 9789 - DNA, 119 bp, Glycine max
  Peptide Sequence Number=SeqID_101474
aagcaaagcttcatgatgacgaaaaaggttatgacaaaaagctcaaagatcaatcaagaacaattcaagagttcaagataagaatcaagaagaattcaagactcaagaagaaagtctag

SEQ ID NO: 9790 - DNA, 234 bp, Glycine max
  Peptide Sequence Number=SeqID_101475
atggagaattggcgaatagcgttacgcaataacttcgcggggttccagactcattggtggaggatgcatgaaacagcgctaggcaataacactcgtgggactccgaaaaaaagtggagaatggagaattggggaacagcactacgcaataaattcgcaggcctccagactccgtttacgcataactttcgcggggttccagactcattggtggaggatgcctgaacagcgctag

SEQ ID NO: 9791 - DNA, 132 bp, Glycine max
  Peptide Sequence Number=SeqID_101476
atggctacaccaacgagtattgcttgctatttggataaagatgaaaccggtcagtcaatagacattaagcaatatcgaggtttcaatcaaatcccaaacaatctcatcttagtgccgttaagagaattataa

SEQ ID NO: 9792 - DNA, 309 bp, Glycine max
  Peptide Sequence Number=SeqID_101477
atggccgctttggagagagaaggtagcaacggacttggttccacagaggcgcagctcaccacctcaaaggattggaaagccgtttccaatgattcttccgccgcttctacggaccactcccagggcatgaatccacggtcttcccaagaggcagctataggcgggatttatatccattacttgaaacaccacgttgcaagtgtgggggccctatctgaatgggaatgtcgatttcccccatcacttctcgccgagtaccatcaaaggctcgcaccaccatcgagcttggttttaaacgtgacacactaa

SEQ ID NO: 9793 - DNA, 937 bp, Glycine max
  Peptide Sequence Number=SeqID_101478
atgggggatcccatcagcagactctcctcccctgaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtcattcagtgaccccaagtgtgattgacgagcagagaccaatatggtcatctgcgccctttccggagatgtcagcattttccgatggagacttttcaagtctcacaagttatccagaactacgtcatgtgacgtgcacccttgtatcatccagaggcggcgggcccgatgatacgcggagataccttacggttatccgcacccttttgtcatccagaggcggcgggcccgatgacaagcagagaccaaaggcggcgggcccgatgatacgcggagataccttacggttattcgcacccttttgtcatccagaggcggtgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattcgtcatgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 9794 - DNA, 147 bp, Glycine max
  Peptide Sequence Number=SeqID_101479
atgaggatcaaaaggtcttttaaggttgtaatggggccaaggacaaggtatggagaaatatggaataagtggctaaatcccaaaggaatagaggagcaaaggggacctttgagaaacaacatttcattcagcctgtccaacatttaa

SEQ ID NO: 9795 - DNA, 425 bp, Glycine max
  Peptide Sequence Number=SeqID_101480
gaaagaatgcgcattacggtgcccttacccaacgtgtgccaaagctagagtgatgagtgaaatagaggaggtgcaagagcagatgaaggccgacatggaggccatgaaagaccaaatggctgccatgatggaggccatgttgagcatgaagaaaataatggaggacaacgtggttgcggttgccactatgagtgctgccactgaggtagatccaactcacccacctggcctcaatcaagtaaatcctccaatatcggatatgactcatcttctccttgaagtggcgtctcctctctctctccctttctccattccgctgccattcatcttccaagaagcaaaggaatccattgatgaagaagatcctaggcctacaagctccaatggagcttgcatcatgtggtatcaagagcatcttcatctag

SEQ ID NO: 9796 - DNA, 552 bp, Glycine max
  Peptide Sequence Number=SeqID_101481
atgcagttggcagatgaggaaggacctaaaaagcctaaacccttggtaatgcacttcaccaggaacacggctccccaaagatctcaacaccccttggcagtgtcaggcggtagatctattccgtttccttacgagaacagccgcgcagttccgtggaggtatgcccctccgagcggtaggaaggaagaagctactgatatcagctcactatcagccaaagtgaccaatatcaccgggctgagcggcataacccgcagtggtcgcgtattcgcaccacctagcctgctgatacaacccgcaaacactaaagggaaagctaggatggcggaaggacaaaatgtcaaagtgatccccgcaccggacgaggatgttccgaggaaggatcttcccgaggaaagagagggctgtggcaagaaagaggtcttgaatgaagctcacgtagcccaagacatctccgtagaaggctttgggggaatcgtcaataacatcaaagccaacaactacctcaccttcgctgaagaggaaatcccccgccgaggggagaggacataa

SEQ ID NO: 9797 - DNA, 444 bp, Glycine max
  Peptide Sequence Number=SeqID_101482
atggctaagtttgaccctgaggtagtcctggagttttacgctaatgcttggcccacagaggagggagtgcgagacatgcagtcatgggtgaggggtcaatggattccttttgacgttgatgccctcagccagttcctgggtgacccgctagtgttggaggaaggccaggagtgtgagttcagtcagaggaggaatcgggccgacaggttcgacgaggaggccattgcccaactgttatgcacaccggggcaggatttcgcccggatcgctgcagggaggcgggtgcggatcatgcacactagcatgaccaccttgacccagatgtggatgacattgctactcagcaatgtcttgcctagtgatcataactccgatctccctctgctgaagtgtcagctggtgtatgccatcctgacacagatagcgtccacgtggctcagttga

SEQ ID NO: 9798 - DNA, 255 bp, Glycine max
  Peptide Sequence Number=SeqID_101483
atggggcttaagaatcaaggaagtcacttagtacattatgtaagccaccaagggaatcaaggagctgaaaagaaatttatgaagaagcatgataaaggcaaagggccattaaagataaatgaagactctttgcaaatccagcaaaaggtatcaaaggacaataattgccaattttgtgggaaatatggacatttccaaaaggattgccaaaagcgtaagtctttgtttgaaaagaaaggtgagcttaatgctcat

SEQ ID NO: 9799 - DNA, 333 bp, Glycine max
  Peptide Sequence Number=SeqID_101484
atgctcatgtgggatctgcatctgtgttggttggtgatattgatgatgcattggactctgaaaaaggtaacgttcttcacattattaactgattggagtattatttgtcattttggccttgttcttatcgtaatattactgcattgtatctacaagttgcatagcaactgttggagaactactctcacattttatctgaccaagtaccccggctctgcgagtcctaaatgtacaaaactcagttgcagggtccacattagaggttaccttgcaaatgtggatagtaccttccttcccttagcacgtgctggagtgagtttatcacgtagctag

SEQ ID NO: 9800 - DNA, 867 bp, Glycine max
  Peptide Sequence Number=SeqID_101485
atgttgcactggcgttgcttttatcaaccccaatgccttcacttgccatcctacgttaattacccgaactccatttcgtactccaagggagtgttgggaattgtaattcctggttgtgacgagacttatgaagagccacaaccggagagtgagcatgagcaggaacaggaacatgatcgccaccagaaggttcgttacctgaggcagggtgacatattcgctgttccacctggaattccttactggacctacaactacgcaaatgtttcccttgttagttatcttcctgggaacccaaaagaagagcaccctggtagtggtgggtgcaagcaagaagaaggtaacaatagaaacatgttcggtggcttcgatccacgtttcttggcagaagcatccaacgtgaagaagaaaaacccaagacccgagaagaaagaagaggtggtagaagaaaaagaaatcagaaagcgcaagcacctcaaaggagaacacgagggatgtggagaatgcgaagagaaaactagaacacattactaccttcgccgcgagtggcatgaacataaaggacaacaagatggaaaagaagaatcacgagagagatataaggaacgtggtgaaggtagtaatgtgttggaagaaagcttgtgcactttgaagctacacgagaatatcgctgacccttcacacgcagacatattcaacccaagagccggtcgactgcgcgccatcaacagcttaaccctcccagttctcaaattgctccgtctcagcgcccaattggttaaactttacaagagtgacatttacgtgccacactggagcatgaacgcaaacagtgtggcctctgtcacacacatgacaaataggtga

SEQ ID NO: 9801 - DNA, 294 bp, Glycine max
  Peptide Sequence Number=SeqID_101486
atgaactacaagaaacggcataaaagcgaagagggttgtcctgaaaccctggtgttagacatgtctaagcttgtttggtcagtattgactgttgtgaagcaaaaagatccactttctagtgagaggtctcaactaagagccgtggttgaaatagcagtggccacccctggaagattgaagaattatcaaaggtcagcattagctttactacatgaaggcaaagttgtattgggtgtcttggcttgtccaaacctcatccattggctccaatcagcagcattattcttcaaataa

SEQ ID NO: 9802 - DNA, 1521 bp, Glycine max
  Peptide Sequence Number=SeqID_101487
atgcgtagtgctcccaccatttcatcacaaaaccctttagaaacccttcgtgcctttttctcttgtgccaagattctctcttcagcgcagcaacttcacgctcaggtcatcatcaacgggcttcacaagaaggttttctatggttccaacatcaccaatgtttatatccaatcgggttctcttcctctggccaaaaaggcttttgatcaaatttccgttaagaaccttcattcttggaacaccattatttcgggttactcaaaacgcagtctctacggtgatgttttgcagctttttcgacgattgcgaagtgaaggcaatgcagtggatggcttcaacttggtgttttccgttaaagcgagtcaaaggttgctgcttttgcataatgggaggttgcttcattgcttggccatcaaatctgggttggagggagacctgttcttcgcgcctgcgattttggatatgtatgctgagttgggttctctggacgatgcccgcaagctgtttgaacgatattcttacagaagctcggttatgtggggctttatgataaaggggtatttgaatttttctttagaatccaaagtttttgagctattctcgtgcatgactaattattttggtttcaaatgggatgctttcacaatggaaggtctagttcgagcctgtgcaaaccttttggctgggagagaggggaaagcatctcatggggtgtgtataaagaacaatcttctggtgaatgtctgtttgctgacatctgttatagatatgtatatgaaatgtggagttactcattatgcatttaggttgtttgaaaaagcgaatgatcttaaggatgtggttctatggagtgctgtgattaatgggtgtgccaagaaagggaaattttgtgaagctttgtccgtgttcagaaggatgctggaaaactctattaccccaaatccggtgacattggctggcgtaattctagcttgctctggggtggggtctttgaaacaaggaaaaagtgtgcacggctttgtggttagaaacatggttcaattggatgtggtaaattatacttctcttgtggacatgtattctaaatgcggtcactctggaatggttcaggaggggttgaggatctttaattctatgaaagattatggcatttctccaactgaggaacactgtgcctacatgataggtgttttagctagagttggtcaatttgatgcagcattatcctttctctcaaacatgcctataaaacctggtcctaatgttttgggagttctattaagtgcatgtagattccataaacgagttgaacttgctgaagaaatagcgaaaacactttcatctttagagcataatgatttatcctggcatgcttcattgtcgaacatatattctgatggtaggatgtggggagtagtagagatggcaatggctgaagaaggtcctgtgtttctcattgtggaagagtggaaattttcggattctcaaaggtttgtcgtggctcaccagtcaccatactga

SEQ ID NO: 9803 - DNA, 405 bp, Glycine max
  Peptide Sequence Number=SeqID_101488
atgattttggtgaactgctttcttggtccttatatgccagtggacaatcgtaacaatagagtttccctttttgatggtattgaggagggtggcatcagagcatcatctgtttactcctcttctcatgaaattgatgaacatgataatgagcaggcattggatggattgcaagatagagtcaatctgctgaaaagattatcaggtgatataaatgaggaggtggatagccataaccgcatgctggatcgaatggggaatgatatggattcatcaagaggggtcctttcgggcactatggacaaatttaaaatggtattcgagaccaaatccaaccagagaatgttcacgcttgtagcatcctttgttgtgctctttcttataatatactacctcactaggtattga

SEQ ID NO: 9804 - DNA, 894 bp, Glycine max
  Peptide Sequence Number=SeqID_101489
atggatttgttacagggttaccaccaaatcattagtcaacacagaacctccgaagaagaaaggaacataaaggtgccttctgaaccatggactccatatgcgcctcaatttcctgcttttagtaatggggatagtgccatcatgaaagaacttcatggacaaggagttgtaatcggtgaggactggcccaagagatttcagccactgcatcccgaggacaacattggcccctactatcggcaacacatacaggtcaacgacgcaattacactccagttgttgggtcaccaattgctgttgaatgaagttgtgtgtgcttcatccgtccaccagaagcatcacctgatgatccctgacaagacccagaaaatggaagaggggttctcgtcctctgtgatgaggagaaaaaccctagaggcgcaacgatggcccctatggtatttctcgtcgcagttgaaacagagcccatgctctcttcccgagactatctcttccggtgacaactgcttcagcgcggccatgcggcgcctagcgagtattgaggagcttctcttcttggagacgggcaaggccaactacttggacaagggtcaatggctggccaatgattctattggcgagatctttgaattcggacagggtgcaaagcagggccttgccatccatataaaacgaagcaatggtaaggcgttcttgttccggggtaacgtgatactcaaaaaactggttgatcttaaagatccaaccaagggggttatggtggcggggtgggcgaggaaggcgttagggttgaaagcagaggatagcatcctcgagtttgtctggaggacttgtggttttagtggaatcgatcatgtcaacgagaaacgagaaatgagagtaccaaaatggtag

SEQ ID NO: 9805 - DNA, 396 bp, Glycine max
  Peptide Sequence Number=SeqID_101490
atgttagatagattattggcattggccaatctgatgcaaaaattccactggaagttggatgacagaaattcttcctcaaattgtgaatcacgcagacatccaaaccatccaagcatcacctcccctaaacaccaattcgcaagattcattgacttggaagttcagcagcactggagtatacacactaagaaaattcgtggcatgtgttttttggttgtcaacaagttcaacgattctggcttgcctcagatctcgcaagacatcaacaacgctacaaccttgactgatacagtgttcaaattgctgcaaaatctctccaccgaattggcatcaagtttgctatgctactttggtgtatctggcgacgtagaaacgacaagatctggaatcatatag

SEQ ID NO: 9806 - DNA, 984 bp, Glycine max
  Peptide Sequence Number=SeqID_101491
atggtttctgcaaaagaagaaccagatcgtcccataccacctgctattgatggtttgttaagggttcataagcaagttatcaatgttgaccgtgaccttgtggatagtgctttggcagctgggcgatcagttgttaccaggcttctagtagcagatactcaagcaggaagcttgatcggaaagcagggatcaaccataaaatccattcaagatggctctggttgtactatacgtgttcttggatcagaaaacctgccagtatttgctttgcgagatgatagtattgttgaaatacaaggggaatctgctggtgttcacaaggcagttgaacttattgcagttcatttacgcaagttcttgatgcaaaggccagatgttagagttaaccagaatgtgccaccacatcaaaattggggtcctcctcctcaagggtttcctgctcctgctggtggtggtggtggaggacctgcttttgcaccaaatcatcaatatatgccaccttcacatcactatgatagctattatccacctactgagttgcctcccatggacaaacaccttcatcaaggtccaccacctgcctatgcaaaggatgcttcaatgggaattcattcatcaagtgcaccaccacaacaatctgttgtaactaaggtcacacaacacatgcaaattcctcttacatatgcagatgctgttataggagcatcaggcacaaatatcagctatatacgtcgtgctagtggagcaagtattacaattcaggaaacaaggggtgtgccaggtgagatgactgttgagataagcgggacttcttctcaaatacaggcagcccagcagctggttcagattttaatcctgtcaaacatactacaccctaaagccgttagccccacatctctggttccaatgatttttatgattgacagttcatccactccactagctgctacaatccatggtcctgctgttgaaactcttttttag

SEQ ID NO: 9807 - DNA, 412 bp, Glycine max
  Peptide Sequence Number=SeqID_101492
gggccgctttgccgctgagatccgtgacccctggaaaaagacccgaaagtggctcggcacctttgacactgccgaggaagccgccagggcttatgacgccgccgccagaacactccgtgggcccaaggccaagaccaacttctcctacatccttgctcccgctttccacctccctcccccggtgctcactactcccgaagcccatgccctggcccaagcccaagcccaggaacaactcgccagacaggtcgagttctgtggcccaccgtttttctttgcaactgatgtagcttccaccgcgccggtgaggtcggagtacaagggttacaagttagagaatatcgcgggttttgtggttttgagcagcaagcattttggttattacggtggcataggtttaaagttcatttaa

SEQ ID NO: 9808 - DNA, 1809 bp, Glycine max
  Peptide Sequence Number=SeqID_101493
atgaagcagtcacgtcgccggcagaggactctgctcctcgctctgctctttctctccgtcgtttctccgctcgttttcgtctctcaccacctcaacaccatcactcccgacggtgctgaagaattagaagagccaaaagaaattgtttataaagaagaggattttgtttcaacaaatagttacattttgcaaaagactaatgatactgagggatctaaaagtgaggggtacagaaataacactttggaaagaaatgaattcgaccagcacaaaagacaaaaccaggaagctcaacaaaaaggattactctccacggatggggatgtgaatatattcaatacaacagtcacacataatcagaatatacacactcattttcaaagagtgacagatgagaatgttgaagtgacaggaaaccaatctgttccaaaagcaacccaacatcgtcagagttcatgccctcagtctcagagagtgacaaatcagaaggttttggagattaaggatcaaattattagagccagagcatacttggggtttgctacaccaagcagcaactcacacttggtgaaggagttgaagctgagaattaaagagatggaacgtgctgttggagaagctactaaggattcagagctgtcaaggagtgaacttcacagtgctttgcagaaaacaagacacatggaagcttcactgtctaaagccaactgtgttttcccagactgcactgctatggcagctaagctccgtgcaatgaatcataatgctgaagagcaagttcattctcatcaacgtgaagcaacacatcttgttcatcttgctgcaaggaccaccccaaaaggtcttcactgtctttctatgcagctaactgctgattactttgccctgaaacctgaggaccggaagcttccaaatgaaaataagattcatgatccaaaactttatcattatgctgtcttctctgacaatcttctagcatgtgctgtggttgttaactccactgtctctaatgccaagaaacaggagaaacttgttttccatgtagtaaccaattcactcaactttcctgcaatctggatgtggttcttattaaaccctcctggcaaagccacagtccacatacaaagcattgagaactttgaatggttgcccaagtacaatacattcaacaaacataattccagtgatccaagatatacttctgagttgaactacctgcgtttctacttgccagatatcttccctactctaaataagattctgttctttgatcatgatgtggtggtgcaacaagatctcagtggactatggaatgccaatatgaaaggaaaagtaattgcagcagtgggcacttgtcaggaaggtggaacctcatttcataggatggatatgttcataaacttctcagatccattcattgcaaagaggtttgatgtcaatgcttgtacatgggcatttgggatgaacttgtttgatttacaacagtggaggagacataatttaactgctctctaccacagatatttgcaaatgggttccaagagaccattgtggaacattggaagtctgcctttaggctggctcactttctataacaagactaaggttttggacagacggtggcacattcttggccttggttatgactcagttgtcgataaaaacgagattgagcgagctgccattatacactacgatggaattaggaaaccgtggttggacattgcaatgggaagataccgaagttactggaccaaatatttgaactttgacctccctattttgcaacgttgcaatctccaggcgtag

SEQ ID NO: 9809 - DNA, 513 bp, Glycine max
  Peptide Sequence Number=SeqID_101494
atggaagcaaccttctcttcaacgacggcaagaggatattggaatctagcacttgcttcgccagctgccatcgttgaaacttatggagctgttgattcctcggggaaaaaaagaattagccgtgttgatgagttatatgatacattggttacacgtcttctgccttcagtgtcagtgtcatcaaatcctaatcacaagcttttagttgggctggctggtcctcctggtgctggaaaaagcactctagcacatgaagtagccagacgtataaacaaactttggccagagaaagcttcttcctttgactctctggttgaacctccagatgttgctattgtggttcccatggatggttttcatctttatcgttttgaactagacgcaatggagaatctcgaggaagcacatgccagaaggggaggtaagggatcagtttatgtaccatcatttgaccatggtgttggggacccagttaagatgtggtccactcatcagcattttataaatttctga

SEQ ID NO: 9810 - DNA, 1509 bp, Glycine max
  Peptide Sequence Number=SeqID_101495
atggatttccacggcggaggaccactccgttcccgcagttcccagtccccttctccctctcactccgcctccgcctccgccacctcctccatccacaagcgcaagctcgtgtccgaggaccacgcgcctcccttccccccctcctccttctccgccgacacccgcgacggtgccctcacctccaacgacgacctcgagagcatctccgcccgcggcgccgactccgactccgactccgaatccgaggacgccgtcgtcgacgacgacgaggacgactacgacaacgacaacgacaacgactcctccatgcgcaccttcaccgcctccaggctcagcaaccctccctccgctccccgcaacaccaagctcaagaccgaaaactccaccgtcaaaattgagaattctgacggcgccaaagacgccggagccgtcggatctggcgccgccgccgccgcgggaccggtccccgggattgtggttaaggaggacccgactaagatttttactgataatttgcaaaccagtggggcttacactgccagggaggagagtctcaagaaagaggaggaagcaggaaagctcaaatttgtatgcctttcaaacgatggtgttgatgaacatatggtttggttgattggattgaagaatatatttgctaggcaacttcccaatatgcccaaggagtacattgtccgacttgttatggataggagccataagtctgtaatggttataaggcgcaatcacgttgttggaggcattacatatcgcccatatgctagccagaggttcggtgagatagccttttgtgcaattacagctgatgagcaagtaaagggttatggtacccgattgatgaatcacttaaaacagtttgcacgtgatatggatgggctgacacatttcctcacatatgctgacaataatgctgttggctattttatcaaacagaaaaacagggtgacatggctaaaggggctgacagtactttggaatctttatcttgtcctcagatacagtaggagtgatgcaggaatctgtatatttcttttggttttatcttttgattctcttgaagggatttacaaaagagattcacttggagaaagatcgatggcaagggattacgatggaggaattctcatggaatgcaagattgatccaaagctcccttacactgatttgtcaactatgatccgtcgtcaaaggcaggcaattgatgaaaaaatcagagagctgtcaaactgtcacatcgtttatgctggaattgattttcagaagaaagaagctggtattcctaaaaaaattattgatgacatccctggtttgagtttgctaacttttgctgagatgtcaacctcctgtccaagttcctgtgcacaggggctaacctttttgctgcttaatgcttatgaccttggtgtcaatctttccctatgttacctcgctataactttttcattgcctcatacatttgttgtagttttagtgttgattttgcatatctag

SEQ ID NO: 9811 - DNA, 188 bp, Glycine max
  Peptide Sequence Number=SeqID_101496
atggagtttctgtcacgctcatggagtgcctctgcccttgaggtctccaaagctcttgcacctcatcactctaattccaacaacaacacttcttccattccagaagaaacttctgtttctgctcccaaccacaacagcaacaactctttttctgaggacttctccacaaccatttcttctaagaatca

SEQ ID NO: 9812 - DNA, 570 bp, Glycine max
  Peptide Sequence Number=SeqID_101497
atgtcgtcgttgataacagatttgctccgtgaaaccggcggctccgccgtcatcgacggcggtctcgcgacggagctggagcgccatggcgacgacctcaacgatcccctatggagcgccaaatgcctgttttcctcccctcacctgattcgccaggtgcaccttgattacctggaaaatggtgcagacattataatcacagcatcttaccaagccaccattcaaggctttaaagccaaaggttattctgatgaagagagtgaagccttgctcaagaggagtgccgaaattgcattcgaggcacgtgaagtttacgataaaaattgtgctggatgctgttcgggtgatggggaggatgatggtagaatcctcaagcaacggcctatcctggttgcagcattggtggggagctatggagcttatttggccgatggatcagggtacagtggggattatggtgatgctatcacggtggaaattcggagaagagttcaaattttagcagattcaagtgctgacctgcttgcatttgaaacagtgtccaataagcttgaagctgaggtatcctaa

SEQ ID NO: 9813 - DNA, 222 bp, Glycine max
  Peptide Sequence Number=SeqID_101498
atggtgaaagttggaacctcttacgtgccgatcaacgtctcattttcgccaaaagttggcccagggcttcccggtatcaacagggacaccaggaattatttattttgcgaagtgatcttccgtcacagctgtccctcctgttcagctactgacggggtgggaggtaaaactgtaccgaggctgttttgttcgaaagatgtggtcatgatcatgatcttctag

SEQ ID NO: 9814 - DNA, 141 bp, Glycine max
  Peptide Sequence Number=SeqID_101499
atggaggagtcatcgtgggtgaaccagatgatgtcgcgggaaggtgagagttgtcacaggaatagggttacgttgtcgaggagagaaagggaggtgcaagaattcactacagggagtgtaggattcaaaacccctaactaa

SEQ ID NO: 9815 - DNA, 1881 bp, Glycine max
  Peptide Sequence Number=SeqID_101500
atgggtgagaattcgcagtctcagacaacgctcgagaaacatgacgatggtgatgaaagaggggttaaggagagtgggaacggagaatgctcaaggagtcttgaggtgtattttggcgattacgcaatgataaacatgggagaattttcagggtttcctctgtcatttgatgttggaaattcaaaccctcctaatgatggcgacaaagacaagattctggggcaggaagttattacaagacttcaaaataatggtcacaaagataagacatttctaaggttggaacttattgaaagacttcagcaccgcaccagaggtttaagacgtttaactaggatacatggtgtggacttgacgaacgaaactgaggatacatgccccaggagatccataaagaaagaaatattagaagaggtgctgggaatttctcatcccatggtgagtcaatctgagaaggttgtggcacatgatgaggaaaatgatgtaaatgtgcttgaaaaagagccacgttctggtgcaagaaagactaggtctgctagtaggaagctgaacacaggaaaaaaaactgtgctttcatggatgattgaaactggaacaatacggcaacgtgagaaggttcattatatggatcacaaaaatgaacgtgcactactgagtggtgaaatctttggagacggaattctgtgtgattgttgttttcaagttgtgtccatttcacagtttgaagcccattcaaggaggcaaataatctctgatgatacagtactggagaatatgtctgaggaatctgatccactgaagaatatgttcgaagagaggagaggacgttctctcttgcaatgcatggaagaagcatggaatagacaagataaatcttctgttggtaaattctataacgaagttcgtgttagggggagtgactataacgatgttacttgtagtctctgtgggaaacgtggagaccttatttgttgcgacacttgcccatcaactttccatcaaagctgcttggatatacaaacacttccatcaggtgactggaactgtatctattgctgttgcaaattttgtgggttgtataagcaaatggacagctttcagttatcctcatgccgtctatgcgagcaaagatatcaccaatcctgtcttgaggccactggagccaatacttctcattctaaacactcatccttatgtggaaacgggtgtaaagagttatatgagagacttgaaaagcttcttcgggttaaacataatatagaagatggattttcttggtcttttatttgccggtcagatgttgattctaacgccacgcagatagaaccccgtgtggttgaatgtaatgccaaaatcgctgttgcgttatctgtaatgtatgagggcttcaggccatgcattgatgatggaagtgagattaatctgatccacagtgttatgtataattgtggatcaaacttccctcgcctggattgtaagagatttattactgcaattctagagagaggtgatgagattaccagcgttgcatcaatcaggattcatgggaaccaactagcagagatgccatttgttacaacccgctctgtttataggcatgaaggaatgttcagccggcttctaaacgccattgaatcggcactcagctttctaaatgttgagttattagtcataccatctgtcaaagaattaagagaaatttggattcgttcctttgggtttgagccacttgatttgagaagcaagaaaatgatgaagggcatgaatctgttggtattccgtggcaccgaaatgttacagaaaaagataccaaagcgtaattttcctgatgagaatttgaagtcatatagccgtcaaacaagggattggctatttatttaa

SEQ ID NO: 9816 - DNA, 627 bp, Glycine max
  Peptide Sequence Number=SeqID_101501
atgagggcagtactggtgtcggtgttgccgcttccaccttcccatcgactttccactcaaaaccacaatcccaattcgcacctccgttttccttcttcttcttctgtcacttcctccacatcctccaacagaaccatagtgtttggcgtcaatcccagcgactccaaaaaagacccttccttcttcgacgaaaatggcgccgtcaacgacatggaaggttacctcaaccacctctccctcgaatacgactctgtctgggacactaaaccctcttggtgtcaaccctggacaatagctctgacgggggtatcaattattgccattagctggttgattttgcattcggtgataatcacttcacttatatcatcactaatatgtgcatggtggtacatcttcctctattcttatcccaaggtcttgcctttcttgaaagaaaattatgttgatgtcattcctgtgtttatcgaaattagggagaacgatatcagagatattaccgacaattcgcccatgttctacttatacatggtattagcgtttgcatttgagaaagttatgtggactgtggagtctaggagtaggttctgctgtgcttacattctgttaaaacacagcaaaaaatag

SEQ ID NO: 9817 - DNA, 1100 bp, Glycine max
  Peptide Sequence Number=SeqID_101502
atgggttccccaaatatgggtggttctagaaccgctaagcctacgttacaggcaatggttcttccggatgacattcgacaggcgttattgttgatggttgaatgctgtatgaggcgagattatctggctgcaatggaccattatatcaagctggctatcgggaatgcaccctggcctattggtgtcactatggttggtattcacgaaagatctgcccgtgaaaagatctacaccaacagtgttgctcacatcatgaatgatgagaccactcgcaaatacttgcaatctgtgaagagattaatgacattttgccaacgccgttatccgacattgccttctaaagccgttgagttcaatagtttggcaaatggcagtgatttgcattcacttctagcagaagagagatttagtgggggcaatcaggcggcatctgaagagaggcttaggataatgcctgctccaagagacagctatctggatcaagttagcaaaattttttggctgttgctaggcgcacctggtacaattgctagtacacccagtgagccatgtgatgatccacgtggcgctaaggcgacaagcaccggcactgaaacgcataggatctatctgcggtacatagccataggtagagactgtgaacgtccgtgtccgtcgcaaaaccctagagcggagaacaacctgggcgaggtggagcgccgacttgaggcgttcctctcactctcccacgtggcttctctctccctcgatctctccttcgagaggctcctccaatcgctcccctccgactccgactccgatctcatcgatcgcgccctcaaaatggcctctctcctcctagacgccgccaaacactcatcccgcaaacgcgcttccaaccacaattccctctcctggcccctcccccccgacctcaccatcaaggtgttctcgatgcttgatacccagagcctgtgctatgcttcggctacttgtttactgtttagcaaatgtgctaaggatcctatgtgctatgcaaatcttgatttgacgacactggttccgaaggttaacaatgcagtagttgccacgatgattcagcgagctggaaagggactaag

SEQ ID NO: 9818 - DNA, 375 bp, Glycine max
  Peptide Sequence Number=SeqID_101503
atggcgtcatatttggtgaatggcaatgcaacaaatgaattcagtatggagtataggtcaaagcttaacgcatatgtacaatttatggatgatactcttataactggtgatataatgcaccaaaatgtgtgtacaattaaggtgattctacaattatttaaagtggtgttaggcttgaaggtggttttgattccttttgtgttctttgccctacctatagaagcttaccacatgaagttgtctattttgtatgcgctttcgatttacttcctttctcttttcaaggcgcctaaaggtagaggtgaaggcaataataaaactcattgggttgccttgcagaatgtgtttattgagaaggatggagttggagaataa

SEQ ID NO: 9819 - DNA, 969 bp, Glycine max
  Peptide Sequence Number=SeqID_101504
atgtctctggataatattgggaaggatgataatatagacgaagaagctcttaaccagtcccgagacggatcattcttgttctctccatcctctacagcttatgccctcatgcaaactaaggatgaaaatgctcacaaataccctgaaaagacggtccagacgttcaatgggggagccagagatcaaagattgtgcgagttatgtttcaaggtatgtgaggtgttatcgagtgctggtatagtgggtatttgctgggcaaggaattcagaggttcaagatatagatgacacagcaatgggatttagactactaaggttgcatgggaatcaagtttcacccgctgtgacaggaatgtttaatctatatcgagcatttcaagtgctacttcaaggagagaagattcttgagtatgccaagaacttctatgccaaatttttaactgagaaatgtgaagcaaatgagctcctaaacaaatggatcatgaccaaagatttacctggagagttcgcgtttttacttttgctcattaacatttgtaaaactactctccagatgggttatgcattggaggccacccgtgcatttgctcggatacccggttgtgacacgatgccctacgtgaacaatgatgtttatctccagcttgcaaaattggattacagcaactgtcaagcagtgcattgtgtggaatgggaaaaaaatccaaagctagccagcatatttgagcctaagaagtttctagagcgatttgcatgggctaaaactgctgcattgcttcaaacactcaggttccacataaaggatgaagaaactaagagtgcacttgaacaagaaaagagagaggaggaactcctggagattttgctgacaaatcttgactaccttgggttccaaatgtttcggagtcatggtcaggaattttcccattatttgaatcaagctgtgagtagaaacccttctaagctctaa

SEQ ID NO: 9820 - DNA, 132 bp, Glycine max
  Peptide Sequence Number=SeqID_101505
atgtcattcacgatgctcgcctacgagctatgcttatccagtgagagtaatcgtgcaaacaaggtcacatcacagcccaagagagaaggagaagtgtcaagtcatcataagaactcgtccagaaatgcttga

SEQ ID NO: 9821 - DNA, 333 bp, Glycine max
  Peptide Sequence Number=SeqID_101506
atgtccacctcggacaacttgacaaaagtaacccaaacaacacttgtccaagcttgggggcttaacaaaccacatcgacctgcaattctctcacctatcgaggttaccacacccgacatcgaacaaacacttgtccatgcttgggggcttgacaaagtcgtcaccctcctacttgttaaggctactatcccggacattagacaatcttcaacactggacaacctctttcgctcgcaagctgacttagagcttgggggacttatgtactatccaaggtccataaaatacacgtggcattccgagacacgtgtcaaccctccatgtcagccttga

SEQ ID NO: 9822 - DNA, 81 bp, Glycine max
  Peptide Sequence Number=SeqID_101507
gagaagatacttgtgggtggacagagtcttaatctttatagaggaagtggttgttcttaggaatggtgattaccaacccaa

SEQ ID NO: 9823 - DNA, 417 bp, Glycine max
  Peptide Sequence Number=SeqID_101508
atggcgctggcaacccaaagattgcaacttgcccaggaagatgttggaaatgctacgggacaagcgactagtttatgttggcgattcgattggtcggaaccatgggaatcactcatttgtatgctcttttcggcaattgcaaataaggctagggtctacgaggttaatggaagtcaacttacaaggcacatgggcttcttggcattcaattttgaagatttcaactgtaccattgaatactacaaatcacgatttcttgtagtacagggacggcctccttttggtgcacctgatggggtaagaatgactttgagagtggatcatatggtctggatttctcatagttggagagatgcagatgtgctgattctcaatgctggaccttggtggaactttcagaaaactgtcagaatgtaa

SEQ ID NO: 9824 - DNA, 327 bp, Glycine max
  Peptide Sequence Number=SeqID_101509
atggcaatggggcgggtcggatacgggtattgtttctcggattttttactccgattcttcaacatatccccatacccatacccgatacccgacgggtttgagtttattatcccatcctcgtacccgtcggattttaagtggcagggcgggttcgggttcgaggtcggaacgggtctagtaatcccatacacgtatccatacctgacttttggttattgggaaaaatccgaacccgaacccatacccgatcaactcaggtattacccgtcaaagtcaggacggattcggacaaatacacacatgtacggattttcttgccatgtctaa

SEQ ID NO: 9825 - DNA, 1218 bp, Glycine max
  Peptide Sequence Number=SeqID_101510
atgtcagttgcaccagttgacggtattccctcattaaacagtgatctcttctatgatatatttcgtcgacttgatggtgcaacattggctagtgcagcatgtacttgtgcagcgctgtgttccatctcaaaagaagagagtttatgggagaacgtatgttcctctatgtggccttcaaccaatagagaggatgtcaaaagtttaatatcttctgttggtggattcagaaaattctatgcagattgtttcccacttattgtaaacaaggaggttgtagggtatcaaccaaacaactatctcgagtacccggacaattggactgaagctgaatattatggggacatgaatgaatctgaaagcatctctccatcagattttgtttctatagtagatattaggttcaaggggaaaccaatctgttccaaagttctgtggggaattccaaatgcaaatggctatgatggttggttctataactgccctttccggattgatattctcacttatgcagatagagatgataacaatgatggagcggttcacctttctgtatctgatggtctgccaccaattacatccttggagagggaaaggaaagatgggaagctgtggcgggaactccgtgaagggctccagcttagttggattatagtaaacaggaaaataaagcaagctgcaaatcttgctagctggagccctcttggtggtcaaagacactggccaaccgataaggattttgttatccgctttggatcagttctacccgccaaggacattcttccttgtcaggtagcagagtgtatccttattatgaagtttagagtgattcacactgaagaagatgggtttcaaacaactcttaaattaacagagctgagcatgcagttggaagacatggaaggtgctcatgttaatggaagaaacagtttgcttatacttaaggaagcacttagcagccgaaggagcaaaaattatggtgaagtactcgagtcttgtcatatgtattcaaaagtacagaatgagttgaaagaggagaagatgagaaacgaaagtcggttggacagactttgtattttaagtggcattgcagcatttatgacgttctgtctgcaacttgaaaaactttgcagggctgcttttccgagcatggcaaacaaactcacgccatgggcactcgcccaaacctgtttagactttgaggagaaaaaccggttttga

SEQ ID NO: 9826 - DNA, 366 bp, Glycine max
  Peptide Sequence Number=SeqID_101511
atgggccgtggcgcaggagaagatgaagtcggagatgaggacgagagaggaggaagcgtcgtaggtgggaagagcgagggaatcgatgagggcggtgtccaggagggtgtttcttgtgacggggttttcggggaagagggcgcagagggaggagttgttggagcatgcgttggaggggaaggagttgcagagaggggaggaggaggtgtaggtggagtcgcagaggacccagctgagggaggagccaaggtggagggggatttggaaagtgggtgtgaggaagaggaagagtatcgccaagttgaagttgcagagagatggaagaggaggaggcattttggtttgcttgctggagcaaggagataa

SEQ ID NO: 9827 - DNA, 1209 bp, Glycine max
  Peptide Sequence Number=SeqID_101512
atgcctcctcctcttccatctctctgcaacttcaacttggcgatactcttcctcttcctcacacccactttccaaatccccctcatagccccaatctcaaaagacgacaccacccaactctacactctctccgtgttcctgaaaaccccactccaacccacaaaactccacctccaccttggctcctccctcagctgggtcctctgcgactccacctacacctcctcctcctcccaccacatccctgcaacacccctctctgcaactccttcccctccaacgcatgctccaacaactcctccctctgcgccctcttccccgaaaaccccgtcacaagaaacaccctcctggacaccgccctcatcgattccctcgctcttcccacctacgacgcttcctcctctctcgtcctcatctccgacttcatcttctcctgcgccacggcccatcttctccagggcctcgccgccaatgcattgggcctcgcctcattgggccgcttcatcagccaacacaggggcagctatattcgcctccactgcctcctcatttcttttctcttccaaaattgaccttacttacacacaactcatcgtaaaccccgttgccgacaccgtcgtcaccgacaatccacaaccgtctgatgagtatttcataaacttaacctcaatcaaaatcaacggtaagcctctttatatcaactcctccatcctcaccgttgatcagaccggcttcggtgggaccaagataagcactgcggaaccctacactgttttagaaacttctatttacagactatttgttcagcgttttgtgaacgagtcctctgcttttaacttgacggtgacggaagcagttgagccgtttggcgtgtgctaccctgcgggggatctcacggagacacgagttggacccgcggtgcccaccgttgatctggtgatgcacagcgaggacgtgttctggagaatctttggcgggaattcgatggtgagggttgcgaagggaggagtggatgtgtggtgtttgggttttgtggacggtgggacccgcgggagaactcccattgtaatcggagggcatcagttggaggataatttaatgcagtttgatcttgactcaaatagattcggtttcacttcgactctcttgcttcaggatgccaaatgttctaatctcaaggtcaataattttgcaaatggaattaaataa

SEQ ID NO: 9828 - DNA, 918 bp, Glycine max
  Peptide Sequence Number=SeqID_101513
atgtcaagagtgatgtgtaggccaacacaaccactgaaaaacgttccttctaattcttccattagtggccaaaaccagataataaggccaaaagagaaggtagtgttggtgatgggagcaaccggaagcggcaaaacaaggttgtcgatcgacctagccacatgttttccatcagaaataataaactccgacaaaatacaagtctactcaggcttggacgttgtcacaaacaaagcaacaaaagaagaacaacgtggggtcccacaccacttgctggggacacagaacccaaacacagagttcacagcctccgacttctgccacatggcatcacacgccattgaatccatcactcaccgcgagaaggttccaataatcgtgggaggctccaactcatacattgaagccttggtcgacaagttcgggccacgttacgattggtgttgtctctgggttgatgtttccacgtccgtgcttcactcctacgttgcgcagcgcgtggatcacatgcttggtggcggaatggtgaacgagttgagaccctttttcagtcccaacggggattactcgaaggggataagaaaggcaattggggtgccggaatttgatgcctattttcgaagggaagcgttttcgagcaacgagacgagggtgagtttgttgcaggatgcggtgagggatgtgaagaggaacacgtgccacctagcatgcaagcagattgggaggattcacaggttgaggagtgttaaggggtggaagattcaccgtgtttgtgccactcccgtgtttcagaaacgtggccaggaagcgaatgatgcgtggaagaacattgtggcgcagccttgtgcctccatagtttcccattttctctatagtactgcaaatcatgattatcaacctctggagttaattcgttaa

SEQ ID NO: 9829 - DNA, 214 bp, Glycine max
  Peptide Sequence Number=SeqID_101514
atggatatggtgggtgatggggcatggggaagggagggaggtggggacgaacaggttatcagggtcaggggtggtcggagtaggttcagtgacgatggcaagctagaacagggccgaaacactctcggtgtgaaacaggcggagaagcgtaaaggtcaacctcaaccggtggccttgcatgtggagagggacctggagatagtacttgtcgcag

SEQ ID NO: 9830 - DNA, 339 bp, Glycine max
  Peptide Sequence Number=SeqID_101515
atgttctgtgtttctgttcagatctatgtagcagcagtctcagaaggtccagttatttctaacctaagtattgcagaatgtggattacttgatgtaaaaaaccttctcactgtaagagctgaaacagagactccagttagtgttgtttccatccggagaattcctagggttccagcagatatgcctctatatgatatcctcaacgagtttcaaaaaggaagcagtcatatggcagctgtaattaaggttataagagagagaagcaaccctcagaatgttgaagatggggaggaaatcaatgtggaagattggcatcatcaccctggaggacgtgtttga

SEQ ID NO: 9831 - DNA, 2478 bp, Glycine max
  Peptide Sequence Number=SeqID_101516
atggtaagctacataattggatatggagtgtttggtgcaacttctttttccttttcttacagagttatagcaatgggtagatcaagtttagagttttgctcaacagatggaagattggagagtggaagagctttctgcaatcatgccgatgttgaagcatttactgaagagaagaaacaatctcttgccaaacgttcaggaaggggtggtgaatttgcttgtgcagtaaaggagattattgaatgttatgaaaagttgaggacggagaatcaggatggtgacactagctctggtggtgaagttgctattgcaaatgtgtcgtattcacttgatccatctgccaacacagggttaaaggatcagacggatgctcctttcacaattaattcacaaatgaaatcttcaaattgtgtgattgacagacctgaggatgctgttgcattgaaggatgaatcttataatatagaggcatcactggaggaagctactgataatgctattatgactgcaactgtaaaatcacctttttcaataacccagagaaatgcaccagttcgaaggtctagaactagaagcacattacaggtccaaaactttgttgtaccttgtggtgatggtggaaataatgttggcaatagtgatgacaacatatcagctgatgcaattcaggatacatctataaggagtaaacgtatcaggaaatcacctgaccttttacgttgtgatgatactgattcacctgcatttgccccaaatgttagcatggaggacaatggttctgaaattattacaatcaattctgatgcctttactttaaatgagggaagtacgatagattctaatttaaaatttgaacagtctgagcctattgtttgccctgaaggtgaaggtcttgatctagaaataaaggctgtaatcaacaagaataaaagaaaaccaaaccagaagaaggaaactaatgattctggtgctcagaatgccagccaaagtttgcagaatatgggtggaaattcgaaagaaagatgccctgaccaagatggagatgaacacttgcccctggtgaaacgagccagagttagaatgggtaaatcatccacagaggcagaactcaatagcatttctcaagttcaggttaaaagtggcgaggaagatattactgactcaccacatcagataatcacatgctcaaattgtgaaaatggccttgctgaaggaggcccatcagtgttgaacagtactttggttaatgtttctccttctaacttaatagcctcgtattctgaaaatgggtctcaaatttgtaaaattaaaaaagaccaaatgtttggctgctctgtggatgatgaagctgctttacctccatctaaacgcatccatcgtgctttagaagcaatgtctgccaatgctgccgaagaaggtcaagcttgcatggaatcctcctcctctataatgacatttagtggtagatgctgtatatctgccattaagagatgtccttgtatgactgttaataatcaaggagttaatgagttagaactgcaaagtttctcaactcgttcaaatacaattatttccacagagaatgagttatctacagaagtggataagcatttggtcaagttccaacatgagtctgggaaggatgtcatcccaggtgctagtcagcaaggtggtgaagatattagtgattctgttgtctgtcatcctgccaaaatagattcactaatacagtcacatggaaaaatttctcctaatcttgatgtgaaatgttgccaagttggaaacaataaggattcaccaggtccatcattgttactaaatgatgatgacaatgccagaacttcaaaccattcagatgcatctgatacagtagagcatgttggaataagtctcgatcctgtggcaggcaacagtgaaagtgataaattggtacctaaaaatagtattaatgtgacacagaatgtggtggttgcttgtgaggatatgatgaagcatgcagttggtgacagcagcaaacctaatgacacgcatgaggtcatcaaagaggtaaaatttaaaggacaagaggaggatatgaattctgtttcaatatcaaatgattattccgatgaaaagggtaatttgggcattctgtcaagcccatccttgactgatgtgagagtttgcctcccactaggttcacctccaattacatcagtttgcaatatttctacatctgacagtagtaatatccttcaaaatggaagttgtagccctgatgtacaccaaaagaacactttatctggtcctactgatggatggaaagatgggattgtggaaaatgaacaatcaagatctgagggcaagtcaactgaagcaggagatgctgcattgttgtactttgaagcaacgcttcgaacattgaaaaggacaaaggaaagtattggtcgagcaacacgcatagctattgactgtgcaaagtttggcattgcaactaag

SEQ ID NO: 9832 - DNA, 357 bp, Glycine max
  Peptide Sequence Number=SeqID_101517
atgccgaagggtcttactgatggctcattgtcgatatgcaccgggtcaatcgccttgaagtcatctaacttaaaggttatggggggcatgttaggcactcggtgccgggagaccttattattagaccagacttgtttcgctctctttcgaagtttgtcgaggtctgatgctggttttttgcataggttgttcacaaaagctcctagccttaatgttgttatcaaatggtgcatagccactattgggtcaaagtttcagatattcaatgcaacttttctgaagcgttccatgaaggttcgcaatggttccctcttctcctgtcggatgttgacgagggaaacaaatgttaagtggtga

SEQ ID NO: 9833 - DNA, 135 bp, Glycine max
  Peptide Sequence Number=SeqID_101518
atggcaaaacaactagaggagctgatatcccatgtcattgctgctttgtcatgtgctggagtcgcaactaagacattaaccaatgcaggagttagctgtgatccctccatcaacgatgaccagccagacacatga

SEQ ID NO: 9834 - DNA, 111 bp, Glycine max
  Peptide Sequence Number=SeqID_101519
atgaaaagccctaaaactaaggaatggaatgcagagagaaagagagagactacgagcgagggttttaggttcgggaagaccaaagttgaaatacaggttgacttgttttag

SEQ ID NO: 9835 - DNA, 309 bp, Glycine max
  Peptide Sequence Number=SeqID_101520
atgaaggggaaccaaagcaaattaagtatagaggagtacgtaggaggccatggtgctcgtgtgtggcttggaacctttaacacagctgaggaggctgcaagagcttatgatcgtgctgcctttgagatgagaggtactatggccattctcaatttcccaaatgaacaccccccttgcaatgtggcttctcttagcaagaagtcctcatcatctaacactgagcttggtaaacaagttgtggtatttcagtgtttggatcacaaattgttagaggaaatccttgactgtgatggggaaaaccatcaatga

SEQ ID NO: 9836 - DNA, 327 bp, Glycine max
  Peptide Sequence Number=SeqID_101521
atggctggtggagttagctgggtttggaagataacttatgatcccagagtgttctttgagcgggctgctatgtgtgctgctatccggggattggcaataagtaatctgaaagcgaatgcatctagattaactcagcataacaatgtaaagcctattgtcgattccaatttttctaaggctaaaccagaacattctttggactcacaattcaaaccgccagaagcttcacgactagtttctaaacttcaatcatcattggtgctttcaccaggatttttttatggcaacgattcaggaaaaccaagatctggtaagaatttggtttag

SEQ ID NO: 9837 - DNA, 969 bp, Glycine max
  Peptide Sequence Number=SeqID_101522
atggcgatcaaagacgatgtggaggaaggaatgcagaaaggagtcagagagccactggtggcctatgcaagcaaagggcatccatggatggtttactttactacattcgttgcagtgtgtggttcttatgaatttggagcttgttctggatattcatctccgactcaagatgctatcaggaaggatttcagtctgtctttggcagagttcatgatcactgctgctgtgtcagtgtcattcacaattggaaatgcaaagagaggacgtcaaaaagattttgtggcagcgctgcagatacttcgtggcaaagatgccgatatatctgaggaggcagaggaaattcagattggaataggccttatggtctgccagcagtttgggggaatcaatggaatttgcttttataccagcagtatttttgaactagcaggattttctcctaccatcgggactataacatatgcttgccttcagattgtgactacaggtcttggagcagccttaatagataaagctggcaggaagcccctacttctaatatccggatcaggattggtagtaggatgtatgtttgcagcagttgcattctatctcaaggttcacgaggtgggtgttgcggcagttccagcacttgccgtaatgggcatactgatatttcctgttaatattaaagggctggcaggaagtgtggccacattagtgaactggtttggtgcatgtttatgttcctatactttcaacttcttcatgagctggagctcctatgggaataatagtagaagattgaagttcggtaatgtgcaaccagtaaattcatttgtgtatggtttgcagaaaccaaggggaaaagcttggaacaattacaagcagacattaactcataggaagcaggagttttgtaatctgcagaacagtgtaaggtggaaaaagaaaaagaaaaaaccgacagcactcacagcagtttcgtga

SEQ ID NO: 9838 - DNA, 1770 bp, Glycine max
  Peptide Sequence Number=SeqID_101523
atgaacacgttaatctcaccgccttctacaaaccgttacctttgtggggtcccttactctttcctctctccgcttcgacacaacaacaacaccaaccttaaccttccgaggttccattccacagttgctaccaacttcttgtcacactctccggttcgggccacgctctccgcacgtgccacttccgatgaagtagacacgcaaacggtggttgaggaactttcagaggagaataaagtggaagagaacaccaacgaggacaacacaaacacgtccactttttctgctccaattgacaaagaacttaaaaaggttgctcagaagactgctgctacctttgcaccaagggcttccacggctacaaaaaaccctgcagtgcctggaactgttttgtacagtgtttttgaggttcaagggtatgtttcaatgttgttgggaggagctttgtcttttaatctcatattcccttctgatgaacctgacatttggagattaatgggaatgtggtccatttggatgttcacaattccttcattacgagctcgagattgctcaaagaatgagaaagaagctctcaactatctttttctcctcgtcccattgatcaatgttataatcccattcttttggaagtcctttgctgttgtttggtccgcagatgtagtagccttcttgggaatgtacgcatggaaggaattcggcaccggtttgaagaaggagattgaggtcgctcacggttccctcgagacggtgggccacgtcatcgaccagttcggaaacacagtcgtcaaaggcacctctcacatcaaatcatatctcgattccgataataataacagaaacaacaaccccggcggcaacgaagaaaaaaagagtttcaattcgaagcgctattataataggtttgacgcacaggttcgtgcaattcagggtgacgttagcacctacaccgaagtgcctgaggattcggatgagtatactgattggaaatcagggttttcgttggaagggaagagtgatgaaattgaggattttttaaaagagagtgaggcgatggagagtgttttcaagagggttgttcccagtgttgttgaccgtgacacgttttggtgtaggtattattatagagtttataggctcaagaaagctgaggatgtgagggcgagactcgtgaggagaatgtcgagggaagaggaggagttgagttgggatgttgaagatgatgatgatgatggtgatggggatgagaataaggggaaagagggagattctgagttgcatggtgatggaacaaagaaattgaatgtggaagagatgcataagtctggtgaggaggggtctaaggaagaaaagagaggtgatttattgcaaagcaagggagatgagtgtgtcgaagaatcaaaggttgacaagaacaaagaggttgttgagaagatgggtgatggaagtagtaagaaaactatcaatgaagatgatgagaggaaagattctggtgtggattctggtaagaaagtgataatggaaagtaaagttgatgatggaaaagattcgttggttgcaaataagcactcggggaacaagaaagaggaggaggatcttgagtgggatgaaattgagaatcttagtagaattgatgaagagaaggaagttcggacgggtagccctaccaaagttgatttgcggaagcgcctcagtgctgctcaagagcaagacgaagaagacgacttgagttgggacattgaagatgatgatgaacatgctaaggcatga

SEQ ID NO: 9839 - DNA, 3000 bp, Glycine max
  Peptide Sequence Number=SeqID_101524
atgaaaaaaggaaaggggaagaacaacggcttattgcccaattcgttgaggattatctctctgtgcctcaaaactgtgtccaccaatgccaccaccgttgcttccaccgtgcgctccgccggtgcctccgtcgccgcttctatttcgtcttcttctgaggatcacaaagatcaggtaacctgggctggttttgatacactggagcttgatccagctaacttaaaacgtgttcttctacttggttatctgaatggatttcaagttcttgatgttgaggatgcctctggcttccgtgaactggtctcaaagcgcgatggtccagtttcttttttacagatgcagcctttcccagtaggttgtgatggccaggagggattcaggaagtcgcaccctttactgttggtggtttccggggatgacactagcaatgcaaaccagaacagtaccagtttgagtggtttaggaagggatggtaactttgagactcaaccggggaacaatgtcaactcttcaacagttgttcggttttactccttgaagtctcactgttatgttcatgttctgaggttccgttcaactgtatgtatgatcagatgcagctcaaggatagtagcggttggtcttgccacacaaatatactgctttgatgctgtgactcttgagaataagttcagtgttctcacttatcctgtttctcaattcgctggacaaggaacaactggtgttaatgttggttatggtccaatggctgtgggtccaaggtggttggcatatgcttctaacaaccccctgccctctaatttaggttgcttaagcccacaaaacttcagtgattctccaggaattagtccatcaacttctccaagcagtggtagtttagtggctcgttatgcagtggagtccagcagacatttagctgccggaataatcaaatactgtcaagagctgcttcctgatggttcctcttctcccatacaatcaaattcaggtgtgaaagtcaatagggttacaggaattgatgcagataatgcaggaatggtagtcattaaggattttgtttccagaagtatcatatcacaattcaaagctcacactagtcctatatctgcactatgttttgaccctagtgggacccttcttgtcactgcatcagtctatgggaataacattaatatatttcggataatgccgtcattcacatgcaagagttcaggcattccaagctccaattggaactcttctcatgtgcatctttataaacttcatcgtggaataacaccagctatgattcaggacatttgtttcagtaattttagtcagtggattgcaattgtctcatccaagggtacttgtcatctttttgttttgtcaccctttgggggtgatactggttttcgaattattagttctcagggtgaagaaccgttcctactccctgttttttctctgccttggtggtatactccagcttccatttcttatcagcaatctctgcctcccccagcacctgttgtcctttctgtggctagccggataaaatatagtagttttggatggcttaatactgttcacaattcttctgcaaatgtgacaggaaaagtttttgtgccatctggtgccattgctgccatctttcataattccttatctcactcgcaacagcttgttaactcaaaggcaaaacccttagaacatatattggtttatacaccttcaggtcatgtagttcaacatgaacttctggcatctgttggtttaggaacaactgataatggtttgagaaaccagtcaacttcactcttgcatatgcaagaggatgagttcagagtcaaagtcgaacctattcaatggtgggatgtatgtagaaggtcagaatggccagaaagaggggatacttgctgcaatacctttgatagacaaggaggtattgagagagttcaagagaaaataagttatagtgatgtccatggattgaattttttgggcacaagagatagggcaggggaaaagatggtaagatcttctaatgagaatatgcacgacaggtttcattggtatctgtctaatgcggaggtgcaaaggaattttggaaggttacccatatggcaaaagtctaagatttgttgctattcaatgagttgtgcgggagctagtttcagtgctactggggagtttgaaattgaaaaggtccctgttaatgaagttgaaataaagcggaaggagctgcttcctgtttttgaccattttcatagcatcagatcaagcgggaatgagagaggcctttctggggaaagatatttaagccctatatctcctgttcacaatcaagctgatgacaaggaaactgttgatgtaacagttatttgtcattcaaagccagcatcactgagttccactgaaagctccgaaggaggttcatcaagaagaattgaaaatctgcttgacttggatcaagttgcttctagttatcaaatacttggtgagatatgcctggaaagaacggggacaatcaacgttgagcctgctctacaaaaccagattgtgatgagtccatcatgtctgtctggaaacttgaaacaggttgattttaacgctgaccatattgccaatcctatattacaagggagaaatataacttctgaaggaagagattctataggtgttgggatcagtgagaactcggcattggtcccagaacatgattcacacgagactgaatttgtggaagtagccttaacaaagcaaaatgaagatgttgggatatctttcaaggatggccactgcaaaacacaggagcctgatgaaagtgacgtgttaactgaagttgtaactgatgatgttgacagcagcagtagccaccatgaaagagagcaactggaggaagatgaggagaatgatgaaatgcttggtggcatatttgccttttccgaagaagatggaaattcacgtattcatgggcttgcaaactttgagccctatagtgtggaaagttgttggtaa

SEQ ID NO: 9840 - DNA, 1302 bp, Glycine max
  Peptide Sequence Number=SeqID_101525
gatctcatcaacaaggtcacgattctcaaaaacgagctcattagagattcctgcgactctgctagggttcagaccattttggacgatagtttcgacactttgtttcggcgtcaccccaatggatctgcgttactcaagcttatgaatcaattgaattcaaatccttcccttgccctccaggtgtttagttggagaagaaagagatcgaatgctgaaaaccctatggatgcgtatgagtactcaaagggtataaaagctgcaggtagatctgggaatgttgatttagctgttaagctctttaaggaggctgctgtcaaaggtatcaagacgaccggcacttacaatgcgcttatgggtgcttttatgttcaatggtcttcctgataactgtcagtctttgttttgtgatttgaagagggatctgacttgcgatccttctattgccacgtacaatattcttctatctgtttatggtaggctgatgctcgttgatcacatggaagcaacattcagtgagatacaaaggttaaacctcgccatgaacatctgcacttacaatcacttgattgctggatatatcacggcttggatgtgggatgatatggaaaaggtgtttcaaatgctgaagttgagctctgttgagcctaacatgaaaacccaccttctaatgcttcgtgggtatgcaaattcgggtaatcttgaaaagatggaagagatgtattcctttataagggatcatgttaatataaaggaaatttcattaatcagatgtatgatatgtgcctattgtagaagttctcatgcagatagacttaagaagatagagttattgttgaagtttattccacaaaaagagtacaggccatggttaaatgttttgttgattaaactctatgccaaggaagactggttagcgaaaatggagaatgctataaatgaggcatttgagcatgggacttctataacaaccaagggtattttgagacgcataattgcaacttattatcgatgtaatgcagtagaaaagctagaaaattttgtgagacgtgcggaaatctctgggtggagtatctgccgatccttatatcattgtaagctagtcatgtatgggtcacagatgaccttactcgaaatgcataatgtccttgaagagatggaaaatgtcaagcttaaatgctcaaagaaaacattatggataatgtacaaagcttacatgagccgtggccagatttccatggttttaaaaacattgggacaaatgttcaagcatggatatgaagttcctttgagtgcatttccataa

SEQ ID NO: 9841 - DNA, 84 bp, Glycine max
  Peptide Sequence Number=SeqID_101526
atggcaatggattgtcacactttggctgatcccgaggcaaaggccaccattggattcaaaggaatcctaaggagttttgcatga

SEQ ID NO: 9842 - DNA, 417 bp, Glycine max
  Peptide Sequence Number=SeqID_101527
atgcacattttatgtctacatcccgtcatcacgcatgtgttgtatttttggtctcgtcattttgtcataggaagccggaaggtccgtatcactttcttaagtgcatacatggggcactgtgctgccaaatgctgcaagtacgaagagataaattttctgcgctctcatgtccgtaaaatacatttttgtcatgcatcgcataagcatctcttcatgcatccatccgatgatagatgtcgaagtattgattcaaactggacttttcattctagtagacatgggatcaaatcaaacacctattctcaagaaaaggttctatcaagccaaaatcaagagcttagaggtcaccagtttacgagagttgcggcaattgatgggtcaacttcaacggcaagccttccgcaaagcctatggtaa

SEQ ID NO: 9843 - DNA, 363 bp, Glycine max
  Peptide Sequence Number=SeqID_101528
atgccattgaggcatttcactgagcacttggtgggtgcacctttaagcatgaaacaaatggggaataagggcaatgtgacatgcccaattatctcagaacacaacctaggcctaaggccaaattgctccacggatttgagcaaattcacacaatttagagcacaaaagggcatcaatggaaggctagaaaaacaaagaatgatgtactcacttgttgggagtgaacaacaatgccaaacggaaccaaaattgcaagaaaaggcgactttggactggaaaattcatgatttctgcaagggtgctcgcctagaccctaggattgcgaacaaactaggaataatcaactatgacttaagaaaatag

SEQ ID NO: 9844 - DNA, 174 bp, Glycine max
  Peptide Sequence Number=SeqID_101529
gtgaaaaagaggctaagtcatgaagtgctaaaagtgacagttgagcttaccaggcttagcgcacgactggtgctaagctcaaatccacttactcgcgctaagcgcgagggtggcgctaagcgcaacgtcgcggatttagagcctgttttgtgcagaattagggaaggtagatga

SEQ ID NO: 9845 - DNA, 813 bp, Glycine max
  Peptide Sequence Number=SeqID_101530
atgcctagaagtttccagtttgtgagaattagaacagcggatggatcaactccaacgtcaagctttccacaagacatatggaaagagctgggatctggctatgataaagtctctgttgaagccattgcatccctcactcagtattacgatcagtcgctaagaaatggggtggtcgaaataccaaggaagcatttggaggagaaagcgaaggctttagcggttcaaggtgaatgggcttcattcattgatatcttggtgctattggtgtttggagttgtcctctttccaaatacggatgggctagtggatctagtggcgatcgacgccttccttgcttatcactatagcaaggaaagtccggtcgttgctgttttggccgatgcttatgacatatttgaccggagatgcgagaagagaggcgcaaggatcgtctgttgcacaaccgttccttatatatggttggtctctcacctctttcatcatgaaagtagacctgtctgtcccctacaaggtcaccgcatgtgcgtcgagaaaggggaggcaaattgggagcagctcttggctggaatggtagaggcatccattaattggttcccccgatggaaggaaggaaaagctatagttttgtcctcatgtgagaggttctcaaacgtccccttaatgggaacaaggggttgtatcaattataatctcgtacttgccataagacaacttgactatcccatgagaggagcatcgtcggaagaaagcatcatgcctttcatcgcacggggtttcagtggccccaatgtcaggatgtttcacagagtctga

SEQ ID NO: 9846 - DNA, 431 bp, Glycine max
  Peptide Sequence Number=SeqID_101531
actctcgagacaaggcaagctattattggagtataggtccaatgaagaacaaaaagaatggacctcaacatcggggaaaaccgtactcgacccctcgaacaatcagaggactgttgctatggggtttgcgggtggtagtggtagcaaacccaatactttccccactcagatcacttgttacaaatgtgattgtccatatcccaagaaggagcaaaatggtaggggcctgaatgatcaaactggacattcgaaggccataagaagagtctttacctttaacggtgccgaagcttcaaaatccaaagatctaatccaagggaaacttaagctttctgtgtcttctttaaataaagatctggtagtagagactccaactagtggttctgtgttaacttctaatgtgtgtttgaattgtcctgtggaaatttctg

SEQ ID NO: 9847 - DNA, 439 bp, Glycine max
  Peptide Sequence Number=SeqID_101532
tgttgctcgcgttaagcgccggccccgtgagttaagcgttcttcattgcggcatgcataaggctaaactagcactgctcgctaagccattgtttgaaataaaagtgctcggtgctaagcgaatggcatccaggcgattccattctttggacgcttggaatagatacaccaataacattctcggccggaatatccttccggagagaaatgtgcagatttatcatactgagtatgacgagtttaaagtggaattggagaggcgtaatctacacaaatgcctcgctaatctccaagatggaagcatagatgtagctatggtgaaggagttttatgctaatttatacaccatagaggagcaagcacctaagcaagccagagtacgaggacacttgatcaaaatagatgcagacggcctgaatgagttccttcaaatgccaatg

SEQ ID NO: 9848 - DNA, 243 bp, Glycine max
  Peptide Sequence Number=SeqID_101533
atggctaatgacaacagaaggtatgtggttggtagcacaaagaaacatgttaaacgaacgacggaatggagaagtaagagagagaggagacaccacttcaaggagaagatgagtctagaagaagctcaccaccataggaggccatggataagagcttggaggaagaaggagatgaatgaagggaggggaagagaagagcatgaaattttgtgctctaaaagagctctgaaatctgaagtttaa

SEQ ID NO: 9849 - DNA, 270 bp, Glycine max
  Peptide Sequence Number=SeqID_101534
atggcacaacctccaccccgtgagagaactctaagggaaatggttgcacttgatttcacctacgaaagcttgtgcatccaataccctgatgaggatgtccaatatgttcttaaaaccggactgatccatttgcttccaaagtttcatggccttgcaggactcagtaacatggagagaagtatgatagatgccgccagtggtggagcccttggagacatgacccctgctgaagccaaaaatttaattgagaagatggcttcaaactcctag

SEQ ID NO: 9850 - DNA, 232 bp, Glycine max
  Peptide Sequence Number=SeqID_101535
gactacatctggagacgttgtccctatcaacttagaaattgaagctacttgtcggggtaacaacgctgcaagaagaagaagggaacaagacacagaaggaagcagttacacctcacctcctctttctccacatcacactgaaatggacggggaaccggcacgaagagtcaccctagaggacttctccaatatcgctactcctcagttcttcacgagcattgccagaccggag

SEQ ID NO: 9851 - DNA, 261 bp, Glycine max
  Peptide Sequence Number=SeqID_101536
atgagggatggtagaagatcttcgtacgtcattgggagcggggtgaattccggcaatggcctcggagggaagttccttgtcgtgttggaattaccggccggtcgagtcgtgttcggagttggaacttggggagcttccctctggagcacaaaatttcgtgctcttttctccctctcccctcattcatctccttcttcctccaagctcttatccatggcctcctatggtggtgagcttcttctagactcgtcttctccttga

SEQ ID NO: 9852 - DNA, 189 bp, Glycine max
  Peptide Sequence Number=SeqID_101537
atgatgacaaaggtgatgacaaaaagctcaaagatcaatcaaagagcaactcaaaacaattcaagagttcaagataagaatcaagaagaattcaagactcaagaagaaagtttagagtcaagaatcaagattcaaggttcaagatctcaagaatcaagatcaagattcaagaatcaagagaaggcttaa

SEQ ID NO: 9853 - DNA, 591 bp, Glycine max
  Peptide Sequence Number=SeqID_101538
atgcagatgctattggccagctcctgggatatccatttagtgctggaagagggtcaggagtgcgagtatggccagaggaggaaccggtccgatgggttcgatgaggaggtcatcgcccatttgctatgtataccggggcaggattttgcccggactgctgccgggagacgggtgcggatcatgcgcaccaacatgaccaccctgactcagatctggatgactttgctgctcagcaacatccagcccagcgaccataattccgacctccccctgccgaagtgtcagctggtgtacgccatcctgacgcggatgagcattcacgtggctcagttaatcgttgatgccatctatatatttgcagtccaacagggccctgggatttcccgccttgatccccaggactctgccagtgattgtccttcccagatgagccctcagcccgcagagccaggggttatacttcttttccatgccctacctcccggaccaggttcagggcagaggtcgcatggcttggagattggccctgaggcccgggcaggagaggcgccagcagaggcacccagcagaggctcccgacgaggcagatga

SEQ ID NO: 9854 - DNA, 383 bp, Glycine max
  Peptide Sequence Number=SeqID_101539
aatcaagagatctcactaacatgtctcttgcaactctttttggaaagcttcaggaacatgaaatggaacttataagactaaatcaacatgaagaaaatgacaagaaaaagaaaggaattgcacttaaagcctcattttgtattcaagaagaaagtggcagagaaaacttgaatgaaatagaagaagatgatgattttagtttcttcataaagagattcaacaagtttctaaggaacaaaggaaatcaaagaagaacaaatttcaatccaaagagaaaaggagaagactctccttttgttccaaagtgctatgaatgtaatcaacctagacatctacgagttgattgtcccagtttcaagaaaagaatggagaagtctgattag

SEQ ID NO: 9855 - DNA, 228 bp, Glycine max
  Peptide Sequence Number=SeqID_101540
atggtatggcgtctccaatcatctttcttccttctccattccgctgctattggtcttcaagaagcaaaggactccattgatgaagaagatctaagctccacatggagctacattagaagatacattgagaacaatgaagaaacaaaaatggaggagaatgtaaagctaaaaattaatggaggtttaaggagcacttacttgaagctcttatgctctaataccatttga

SEQ ID NO: 9856 - DNA, 288 bp, Glycine max
  Peptide Sequence Number=SeqID_101541
atggcacccagcgtgtttgcttcgtgcctctattttagggacttatatgggagggagctaaaagggctcttagtgataattcccaaggtggtcatatctctcttgatggtctctagagccctgatggtggcgcgggtaatgctcaagcacggttatgagcccggaatgggtctgggcaaggacagccacaggaatgccgatgtggttgacgttgggggtaacccgcagagtttcgtgcgaccgtgccatcccaaattccaagtggggaactggcacgtgatgagctag

SEQ ID NO: 9857 - DNA, 204 bp, Glycine max
  Peptide Sequence Number=SeqID_101542
atgtccgccagggtccagcctatagccttcttatgcttcttgagaacagacaacaacttctcctcttgctcatcaacaagggaggcagatataatcactggaaaacttttgctatcatccaagaagatggtttctcagcctgtacctcataaagaaaagtcagaggtatgtgtacttcctgaaacatgggttagtcctatctga

SEQ ID NO: 9858 - DNA, 411 bp, Glycine max
  Peptide Sequence Number=SeqID_101543
atggcatccaggaagaggaagaacactgcttctagatctcaagctcagtatgataccaaacaatttcattctttggatgcttggaatagatacaccgataacattctcggccgaaatatccttccggagagaaatgtgcagatttatcatactgagtttgacgagtttaaagtggaattggagaggcataatctacacaaatgcctcgcgaatctccaagatggaagcatagatgtagctgtggtgaaggagttttatgctaatttatacaccacaaaggatcaatcacccaagcaagccagagagattgaagccaggctctgtattccccgcaaggggtttgttttgaatgctgagggccagccatggaagcttctcaaaaaacatctgatgacattgacccaaacatga

SEQ ID NO: 9859 - DNA, 288 bp, Glycine max
  Peptide Sequence Number=SeqID_101544
atggagaagggagacacaaaacaattcaggcggttagtccttcgttcttttggaaaagggagaagagagacacaaaaagaattcaggcggttagtccttggcgaactctttttggcaaagggagaagagaatgaaaagatgaatagcacaagttttcaaggtttggaaaaccataaaacttcaaaaagcttttggtacaaagaagaagaagttcaaagagattcaaggcttgtaaaggattgtaagagattgattggaaaattattcaagattgaaggaatttattaa

SEQ ID NO: 9860 - DNA, 48 bp, Glycine max
  Peptide Sequence Number=SeqID_101545
gagacaggggcatatggtgttgccttggaggactttatcaagaattaa

SEQ ID NO: 9861 - DNA, 109 bp, Glycine max
  Peptide Sequence Number=SeqID_101546
atggatataggtccagtaccgggcatcaggtctatggagaactcgacctctctctcaggtggtaatccagacacctcctcaaacacctttggaaactccctcaccaagg

SEQ ID NO: 9862 - DNA, 527 bp, Glycine max
  Peptide Sequence Number=SeqID_101547
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgcccccctgacgagcatcacaaaatcgacgctcaagtcagaggtggcgaaacccgacagactataaagataccagcgtttccccctggagctccctc

SEQ ID NO: 9863 - DNA, 405 bp, Glycine max
  Peptide Sequence Number=SeqID_101548
atgagattggctaagagactttatcgaggccacaaggtccaacagcatgaagtctccagcaccccggaatatccctgcttggccactgtcgactatgttggagggaaagataaaggtagattggaactcagtgtggaggataaaaaaatctcttttgacctctttgaagccatgaaacactcatatataggtgatgcctgtttcgaggaagaagaggtagagcaggaaataacattatcaacttcaaccatggtactaccgtctcctttggaaaaagaaccaggttatgggatagatggcttagtttgtgatgaagagcttgatgatccaaaagacagttgtgttgatcatgtggttttcgaagaattggaaaaaatgagactaacagaaaagcccaaagcataa

SEQ ID NO: 9864 - DNA, 123 bp, Glycine max
  Peptide Sequence Number=SeqID_101549
atgtgccgtgccagcgttgttggtgcccaaaaaggatggctaaaggcccaagtggagaagggcgaaggtccaatggagaaggacaaagcccccgagtggagaaggatgaaggcccagaggtag

SEQ ID NO: 9865 - DNA, 8277 bp, Glycine max
  Peptide Sequence Number=SeqID_101550
atgctgagggatttcaagctcccgcgccgaaaccctagcaagcacgaagaacctgagaatgtagatccttatgattcatccaccacagttcagaggcacgcggaaagttctagacctccgttgaacacaattcaagggcccgatgcgcattgtgaaagcaagattgagaagactccttcgaagagaggaagaggaggagctgagcttcgcacgccggataagcacggcggagggagcatgattgtgaagcaccggtttggttggaatcacaagcacgacggaggagtttcgtcgttcggtgatgataggagagcatctggtgttgggaatgtgactcctcgcgtgcctcgcactgtggggagagcttcttcgagtgttactgcctattctgagagcaactccacgcagagcactccgactaagagtgtgacaaagccacctcctggctcgagcgttcggagcaaggcggatggaggaggcttcagtgctcgcttggggaactatgctgcattatataaaggggttcccagttcggcttgctccacccccacggttgttaacacggtcgaagtgcctcactttgatctcaaggaagattcttcgttttggattaaccacaatgtacaggttattattcgtgttcgtcctctcaatagcatggagcggtgtacacaagggtataacagatgcctgaagcaagaaggctctcagagcattacttggattgggcaaccggagaaccggttcaactttgaccatgttgcatgtgaaaccatagaccaggaaatgattttcagattggctggtcttccaatggtagagaactgcctttcagggtataatagctgcatgtttgcatacggacagactggaagcgggaaaacatatacaatgcttggtgacattgaagatttagatgtgatgcctagtcctcatcgtggaatgacaccgcgtatatttgagtttttgtttgcccggatccaagctgaagaggaaagccgaagagatgagagcttaaaatacaactgcaagtgttccttcttggagatttacaatgaacaaattacagatctacttgatccctcctctactaatttgctactgcgtgaggatgtcaagaagggtgtttacgttgaaaatttatctgagttcgaggttcaaagtgtgagtgacattataaggcttctaattcagggttctgctaatagaaaagttgcagcaacaaatatgaatagagagagcagtaggtcccatagtgtttttacatgtgtaattgagagcacatgggaaaaggattctacaactaattatcgttttgcaaggttaaacctggttgatctggctggctcagaaagtcatgttattatgatactagtggatgtggcaaatgggaagcagaggcatatcccttacagagactctagactaacttttcttcttcaggactctcttggcggaaactcgaaaacaatgatcattgccaatgtcagcccttctatctgctgcgctgctgaaacattgaatacacttaaatttgctcagagagcaaaacttattcaaaataatgctgtggtgaacgaagattctactggggatgtaattgctttacaacatcaaattcgacttttgaaggtggaagagctttctatcctcaaacgacgtcagaatgtctctaggtctttgtcattttctttgtcatcgatcagagatataaaacaatcactagaactagaagactgttgcctagaaaatgcaactgacatggttgaccaacatgaagataacatgccggattatgaatccaagggcatcagaatgtcccacaaacagttgcattcattggagacaactcttgcgggtgctttgagaagggaacaaatggcagaaatttctattaagcaactagaagctgaaattgaacaattaaatcgtttggttcgtcaaagagaggaggacactaggagttgcaaaatgatgcttaggtttcgcgaagacaaaattcatagattggagtcccaacttgctggttcgattcctacggacacatttttgcaggaagagaataaagcactttctgatgagattcaaatacttcagagcagacttgaccgaaatcctgaagtcactcggtttgctgtagagaatatcaggcttctagaccaacttagaagatatcaagagttttatgaagaaggggagagagagattttattgactgaagtgtcttctttgagggatcagttgcttcaatatcatggaagaaactccatgcagggtaattcaaatcatgatattcaacctcagaaagctcagtgctgcaataaagaaaataaccttgttgatctagagctaagaaacaccctcgatgagttacaggaatgcaggcgcaatttaaattattgcttagaggagaatgcaaaactcaatagggaagtagactctcttcactcaatgttaagcagcacaaatagtacaaaggtttctaccaaaggaccatttattgaagctcaggcagttccaaggatgggggtcaagcatgaaactcatctgtcacaacacacagatgatattttaaatctgcagttggaattagatataataaatgtcattctgaaggaagagaggtctttccgtggcatattggaagagcaaaaaatatgcttaaataaggattttatgatggcaaaagacaagcttgagcaaacaagcaaacaattagaagatgcaaaggacgagcttggagaggcaaaatctgtcattgaagccttagaattgcagcaaatattatctatcaaagagatagaagagatgaggaacaagaacagccattttatggagcttatggggaaacaagagcatgaaatcatgaccttgaagaaccaacttgcatctaaagagttcagagataatttgctttcaaataatccagagtttgaaaacaagtcccccttacaggtaaaactcagaaggatgcatgattctcttgaaaaagcgaagcaactgaacatgtcgtaccaaagtgatcatgcattccagatatccaatgaggaagagagggatgaaatccgtcggcaggccgaggctgaaactgttgaggtaattgtctgtatgcaagaagaacttgcccagctccagcatcaagtaaatgatagtcatttgaaggaaacagaaatggaagagagtatgctgcatctggaaactgaattgaaggagttgcagaaaaaaatgcttactactattgatgataatagaagtttaaaggaggagcttggccaaaaagatatagaactcacatcactggcagaagaatgggaactgttaacctctgagattgaagaggttcttcttgatggatgtgaggcaatagttgatgcctctgaagaacttgggaatataaggaattcatttccacagaaaaggatctggatttctgaacaagttggcatgatagttagaaaaatttctgagaatgaattattaattgatgaacttagaagatgtttggaagatgcaagcaataaaagaagtgatatggagtgtatgctgaagtccttaagaagtgcagcgttagtcattactgaatcccaccagaaggagtgtgctgaaaatgaaaaagaaattctcctattgacctcacaattgagtgaaaaaacatctactgtggcacaactgaaggagcatttggtaatggcagaagatcatatcagaaaagcatcaaattgttcaacagtggcttttgtagttgtgaatagattgtcagaagtgaatcttggttacctggatgatctaaagcataaggatattctgcttagtgaattagcagaaactaataataggaaggatgtccttctcagtgaccaatccacttcatttgttcaagcagagagacagataacagagttgcaggaaagatgtaatgatttatggcagaagctgtctgaggagcaagagcattctcgtgctttggaacaaaagcttgaagatattgaaaagaatgccatttcaaagacaagggagcagctagtgacattacaagatggtgtctcttcaatcagatcatgcatggcctcttttgcagaccatccaggaagtcttgataatagaaattcattggatgcatgcacatcagactatgatgatattggtgaacaaaggcatacaagttcggaaacacatcaaaacagtgattcagatccgctttctgttgaagaacatatagttgacctgactgacttacagttggtcaaaagtggatatgatacgaaagacctgaaatcaagaaaagttggcaagaatgtgcttgaaagagatgctactattaggcttttgagaaaagaaatcgaatgtgctcttgaaagcttaaaagaagtgcaatatgagatggccagattacatgaagaaaaaaaagagatgtccgtgtctgaaaagaagagtcggcaaagcatagagtgcctcacaaatcagatacttttcctgcaagaagctatgtatcactttgaggagaaatctaaagtcaagattgatgtactcagtcacaaacttagaggcctggagaaacctctgaaagaagccagctcccattggtaccaaaggaaagagacacttgaacttgaagttggagaggcaaagatcattcaagctcagaaagcccaagaggcatcttgtattcttgctaaatttgaagaagcacaagatacaatgagagaagcagatattatgatcaatggattggtgatagctaatgagtcaatgaagatagatatagaaagactgaaagacagagaaatgactttactcaatgagaagggtacattagtcagcaatattgaaagcttacaaactgttgttgatttgaagcatcaggagatagagaaccttgttgaatcaagtctagtagaaacaagggatctaattgttacgttggatgatgtcattaaagacgtccaattgacgatggcagaaaatttcaagtctttagcttgtgatttagagtgcttgaagtctcaatgtttatattccactaaattgatacagccatggcttgagaagatatggtctgagatagtttttaaagattgtgctatgtctgtgctacatctctgtcacatgggtattttactggaaacagtaacagggatgcatgcagaaaatggtttgctttcacacggcttgtgtgaatcgaactctgtcataagtgatttgaaggaacataattataggacaaagcaagagcttgatatgtgcagaatcttgaaagggaaactgctggctgacatcaagaacagttttgatcgtattaataagaaagaagttgaagctggagaaatcaccatcaagctaaataattttgctaaaagcatatcagacctacaacttcaggaggagatgatgctgcaaaggtcgaatgaaatgggatcccaacttgctaaactgatgagggaattggatgtgagtaatacagatattgtgacatcccttttagatcaagagaaactactgaaacagaaagtagtggccattgaatgtgaggccgaattttttatggcagattggtatgccaaagactttgaatcacttatccatgcatctgaattgaaaaatatgtcatgtaatatagctaatatggaggagcattttgtcaagtactccatattaattgagcaactgaagaaagaaacaatcttttcccaagtagaaactgagtttgcaaaacaaattttgatggataaggaagttgaagtttccctattagaaagagaagttcagcagggaaaagtggaaaggaaggacctagtaacagaattaaaccggaatgtcttaaggattacagagatgggtgaagtaaacaaggtccttgaacaaaatattgagtttctaaaggatgttacttgttctaatcatgcattgaagggtgaacttgttgaagctaacaaggcaaagaaaagactgctggataggattcttgatctagaagctgattatgataaagtaattggtgatgtcattgggaaggatgtggcttctgaattttctttccaacaggtttattttcttgaacatcaaaacacagagttaaagaaagtaaactatatgttggaaaattcatcttgcagactaaagaatgagctgaacctaaaggattcggacttaaccagaatgcagaacttactggaggttgagttatccagaaaggatgatgtagtaaaaggactgttgtatgatctgagcttactacaggaatctgcctcaaacaataaagaccaaaaagatgaagttgaaaaaattgtggctacaatggaggcattagaagtggagctagctgttaaatcaggtgaacttgctgatgttgttgcaaactgtcaattgcttgaagctcagttgcaggacaaatcagacataattagagctcttgagttggatctctcaaaagaacgtgaggctctagtgttgcaagtcagtgaaaatcaagaacttagaactcatattgaaggcgccttgacagcgagaaaactggctgacaatgagctaacagaaagaatgaagataacagagagcttagaagatgaaatcctggaaatgaacagtgtttttagccaaatgaatgattcatttaaaaatctgagtagtgatctggatgatgtcactaatgagagggatcagcttcagggtcaagtaatttgcctcaaaaacaggcttgaaaaagctgaagcacaagctgaagctaatgaagcaattgttcaagaagctcagaaggtggcagaatcgagaaaaatttatgctgaagacagggaagaagaggtgaaacttctagcgagatcagttgaagagctggaaagtactgtaaatgtactagaaaaccaagttgacatccttaaaggagaagcagaacgacagaggctacaacgagaagatctagagttggagctacatgcattaaaagatcagatgcaaaatgtcagaaatgtcgatggtgacatgagaagatttttggatgaaaaagagaaaagcctcaatgaagccctaaatcacatacaggttcttaagagggagttagcaggaaaggatgcagagattcgacaaataaaagctcatatttcagagctaaatttgcatgctgaagcacaggccatggagtacaagcagaaattcaaagcattggaagccatggctgagcaagtcaaaccggagggcctttctagtcattccaccagtgctaattcccacaatgcattgtcaaacaagtctgagaagaatgccaccaagtctcgaggttctagttctcctttcaaatgcattgggttgggcttggcacaacaggtaaaatatgagaaggttgaagagctgtctgctgcaagactgcgcattgaagaactagaagcccaggcagcatgtcgacagagagagatatttgcactgaatgccaaattagcatctgctgagagcatgacacatgatgtaattcgagacttacttggagtgaagttggatatgacctcttatgcgtcactaattgatgatgaacaagcggagaagattacagagaaagttaaatttcttactctggagtctcaagacaaggaggttattaagctaaagaagcagctgaatgaattcattgaagagagacaaggatggctacaagaaatggataggaaacaatcagagttggtagctgtccaaattgcattggaaaaccttcggcagcgagatcagttactaaaaacagaaaatgaaatgctgaagattgaaaatgcaagtaagaagaataaagtagtggaactggaggaagaaattaaaaagttgtctggtcagcaaaaccttcagcagcgtattcatcaccatgctaaaattaaggaggaaaataacaagttaaagatacagaacgaagaactcagtgcaaagctccggaagtcagacatcttccattcgcgtgtcaaagaagaccttgcacgtcttcgtgcttctactggcgcaaaaaaaagcattaatttggatgaggaacaacgtctgatgataaagctgaaggagatcgaggaagagaaagtacaactagcccagcaattactgagattgtccactaatgttctaaaggtggctggaatagcaagaccaacatcagatgtaaatccttctatggctgaggaagccctacaggacctcaagaataggataactaccctggaaatggaacaagaagatttgaagtttaagagagttaagcccaaggtgtggaaagtttatgagaggaaaaatagaaggcagaaagggagtgagtga

SEQ ID NO: 9866 - DNA, 493 bp, Glycine max
  Peptide Sequence Number=SeqID_101551
gattccacagctcttcctccctgcctctcgaagaattgcagcagtcgacccagcaaatcagggaccagctagaggagtccatcacagaaaaagtgatgcggcagctcatggcatcattcagccaaatgcagtcccaaattcagtcccagatgcaatctcagggacttgcattgcctctcgaccctctggttggcccctctggtccctgagaaacgatcctgagacgggtgactctgataggtgctgcttgtacatagaaacagatcctgcccacctggttgccatggggagagtttatgagggatccaatgttgttgataacattcctttgttgcctggccaagtaaaggtgagtgtggaggaggttacagatgtagatgctccaaatcctgtacccactgatgaggtttccttagtggggcaggcacttcacaccttccttgcttggccgacacatctggtcaagtctttatcacagcaggtagctgtgtga

SEQ ID NO: 9867 - DNA, 387 bp, Glycine max
  Peptide Sequence Number=SeqID_101552
atgacccaaaatccggtagcatgcggagacaccttacggttatccatacctcgtcatacggagaccccaagtccgattgacaagcagagaccaatgtggtcatctgcaccctttctggagatgacaacatcttctggagcaaaagcctcgcttttgtcgaccaccccaccttttgctatcatgacccaaaatccggtagcatgcggagacaccttacggttatccgcacctcgtcagtcggagaccccaagtccgattgacaagcagagaccaatgtggtcatctgcacccttttcggagatgtcagcatcttctggtagagactattttagtcacacaccgctttctcaagaactacgtagatttgagttcctcatcacaaattga

SEQ ID NO: 9868 - DNA, 445 bp, Glycine max
  Peptide Sequence Number=SeqID_101553
agttttacatgccctcgccttcagaggacgagggctacacgtcctcgcctttagaggactacacatcctcccctttaggggactacaggtcctcccctttagaaggctacacgccctcgccttcagaggactacgcgtcctcacctttatagggctacgcgtcctcgccttcagaggactgcgcgtccttgcctttagagggctacacgtccacccctttagaggactacacgtcctccccttgagagggctacacgccctcactttcagagggctacacgccctcgccttcagaggactacgcgtcctagccttcaggggactacatgtcctcgcattcaaagtgctacacgtcctcaccttcaggggactacacgtcctcgccttcagaggagatcttcttgatgttgtatcttgtattcttggttcatttgtcttgaattaa

SEQ ID NO: 9869 - DNA, 405 bp, Glycine max
  Peptide Sequence Number=SeqID_101554
cttgagaggattgatggggacccggtgttgagagaaacgaggatatgggctacgtgggagtacgtgagctcagttggaggtgggcaacaggggatgagtggtacctggagatatgtcgcgggggtcaggagaccttggggacgtcaggcgagctcctggcagtcaacagataaaaggaaaacaagaccacaaagcaaggaggcttgtggtggctggccagctgtgaatttttgtgtaatatgtggattgtggcctctggtaatcgattaccaagggcttgaaaacgaggtcaggaagctagggaagcctctgatcgtgatggcggcgcagctaatccgtgatcgagtagagatggagtgcctagagggagcttgggagaccctcgaaggcaacgcgaggtgctga

SEQ ID NO: 9870 - DNA, 213 bp, Glycine max
  Peptide Sequence Number=SeqID_101555
atgaccaagagcaaggacaaggatccacttgaaggacttggaggacctatgacaagggttagagaaaggaaagcaaaggaagctcttcaacaagtgttgtccatactatttgaatgcaagcccaagtttcaaggagaaaagtccaaggttcttagacatcagccatggggtgacttttggttgccacaatttcagttacactcagccatttaa

SEQ ID NO: 9871 - DNA, 213 bp, Glycine max
  Peptide Sequence Number=SeqID_101556
atggagagttttcagaaaatctgccaacaatcacatcttttcaatggatttgtgaatggccatcaaaggcctataaatagcctatccctcttacgattattgaggccacaagctaggctcagtgcaagactagcgctaagcccaaaaccatttactcatgctaagtgtgagggaggcgctaagcgcaaagtcgcgatttcagagcctatttaa

SEQ ID NO: 9872 - DNA, 291 bp, Glycine max
  Peptide Sequence Number=SeqID_101557
atgggtgaccaagaggaggtacaggaacagatgagagtcgacatgtcggctttgaaagagctaatggcttccatgatggatgccatgctaggaatgaggcaactaatggagaaaaacgcggccaccgctgccgcagttagttcggctgctgaagcagacccaactctcccaactattgcgcaccaccctatcccatacgtggtaggacaagaaagaagcacactagggcacatcaggaacccccatctgggatacaacggagtggcttacccttatgggattgccacctaa

SEQ ID NO: 9873 - DNA, 423 bp, Glycine max
  Peptide Sequence Number=SeqID_101558
atgattcctccacccgggattgtacctgttgctggagagatgtttgcagcatatgcttcaagctgttcagttgctccagattgctgcatagaagggcaaaggtctgtatggtggtcggcagaggagcataaaccacagagtcttgcgacaggtgcagattttttattcatggccagttgggttaccaagttaaccaaggcatctagtttaccttcaagcttcctagtttcagatgatgcagatgagtttgtggctacctcatgcactcatctaatgactatagcatcatttttggcactaaactgtgagttggaagccatcttctcaattaaattcctggcttcagcaggggtcatgtctccaagggatccaccactgacagcatctatcatacttctctccatgttactgagtccttcataa

SEQ ID NO: 9874 - DNA, 381 bp, Glycine max
  Peptide Sequence Number=SeqID_101559
atggatttaatcacattggatttagaaattgaaggaacctttagaagaaacaatgtagagagaaaaagaaagcttttgcacgacaaaacagtagcatcaatccttgaagaggctcaattttctgagtcatcatcttctaattcacctacatccagggaatctcaaacagaaaaatttgaagctgaagtcatggctgaagagcaacctcgacgagtgaccctggaagattactcaagtacatctatgccacagttctttactagcattgcgcggccggatgttcaagcacagaatataacctatccacattcattaattcagttgattcagaacaatttgtttcatggtctgccaaatgaagacccgtatgcacatatttag

SEQ ID NO: 9875 - DNA, 483 bp, Glycine max
  Peptide Sequence Number=SeqID_101560
atgcaacaacaacagcagcagtcacaacaaagacaacaagcaactgaggctcctcctcaaccatccttacaagagttacaagagacaagagcctccattcagagtctgacaaatcagatgaggcagatggctactcagttgaaccaagctcagtcccaaaattctgacaaattgccttcacaaactgtgcagaatccgaaaaatgcgagttccatcaccttgaggtctggcaaacaatttgaagtgcctccaccagtagcagcacatgcacctgaacctgtcaagcttcattctacacctgaaaaagaggatgagatagttgcacaaaagagaaagcttcctaacaaaaattttcatgcaagtggacattcttctagtaattctgacttaccgcagcctcatatccctcttccattcccacctagagcaattccaaacaaaaaagctggaagaagcggaaaaggagatcttggagacctttag

SEQ ID NO: 9876 - DNA, 446 bp, Glycine max
  Peptide Sequence Number=SeqID_101561
ggacgggggaagcccgtctgatagcgctctgtgcgcgtactccgaaagggaatcggcctgcccaccctggaaacggctcagccggaggaccgagtgcctcccacgcccggtcgtacttcataaccgcatcagggtctcccaaggtgaacagcctcttggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 9877 - DNA, 998 bp, Glycine max
  Peptide Sequence Number=SeqID_101562
atggctacctcaccaaaagaaactgcagctcctagttcacccgctgtaccatcatctccgcaccaggaacaaccagaattcaacatccaacccatacagataattcctggtcaagcttcagtccctgagaaactggttcccagaagacaacagggagtgaagattgctgaaaaccctagctctgcaacaagtcctagggaagtagacccggagatggacaagaaaatccgcagtattgtgagtagcattctgaaagatgcttctgtgcctgatgctgagaaagatgttccaacatcttccaccccaagtgtttccgtgcctgatgctgagaaagatgttccaacatcctccgctccaaatgctgaagccctcccttcacccagtgaagaggaatcaacagaagaagaggatcaagcctcagaggagacctcctgcaccaaaggcaccagaacctgctccagccgaaagggaaaaacccccatcaagaggtctggacgaatcaaaactatggcccagaagaagagcactccaatcactcctaccacatccagaaggagcaaggttgcaatcccctccaagaagaggaaagaaatttcctcatctgattctgatgatgatgtcgaactagatgtctcgacatcaaagagggccaagaaatctgggagaaaggtgcctggaaatgttcctgatgcaccactggacaacatctctttccactcaattggcaatgttgaaaagtggaaatatgtgtatcaacgcagacttgcggttgaaagagaactgggaagagatgccttggattgcaaggagaccatggaactcatcaaggctgctggactactgaaaacagtcaccaagttgggagattgttatgaaagcctagtcagggaatttattgtcaacattccctctgacataacaaacagaaagagtgatgagtatcaaaaagtatttgtcagaggaaagtgtattagattctcacctgctgtgatcaacaa

SEQ ID NO: 9878 - DNA, 996 bp, Glycine max
  Peptide Sequence Number=SeqID_101563
atgtcgaatttcctgagcaacactaatccgaaccctaacaagtcctttgaggtgaatcagcctcccactgattccgtgtccagtctcagcttcagtcccaaagccaacttcctcgtcgccacttcttgggacaatcaggttcgttgttgggaggtagcacagaatggagttaatgttgccactgttcccaaggcttctataacgcacgatcatccgatgtggttcttgctaaccactgcagctctaagggttttgtgctctacatggaaggatgatggcacaactgtcttctctggtggatgtgacaagcaagtgaagatgtggcctctgttatctggaggccaaccaatgactgttgccatgcatgacgcacccatcaaagaagttgcttggattcctgaaatgaaccttttagtcacagggagctgggacaagactttgaaatactgggacacaaggcagtcaaatccagtgcacacacagcaactcccagagcgctgctatgctatgacagtgagacatcctctgatggttgttggcactgctgatagaaatcttattgtttacaacttgcaaaatcctcaggtcggatcaatagaaggaagggttggggtgcatcatttggatgatagtcagcagggtaaaaacttcacttttaaatgccatagagagggcaatgaaatatactcagtcaactctttaaacttccatcctgtacaccacacatttgcaacttctggttctgatggtgctttcaatttttgggataaggatagtaaacagcggctcaaggccatgttgagatgcagcctacctattccttgcagtaccttcaacaatgatggttcaatatttgcttactcagtctgctatgactggagtaaaggggcagaaaattctaatcctgcaacagcaaagacctacattttcctgcacttgcctcaggaatctgaggtcaggggcaaaccacgcattggtgctactgggagaaagtag

SEQ ID NO: 9879 - DNA, 300 bp, Glycine max
  Peptide Sequence Number=SeqID_101564
atggctcagcatggagtagttcatctcacaggccgtgaacttctggctcactctcttttcccgaactcgtcatgttgccccaacatgcaccccattgactcgtccaaaatcgtcatgtacaagatgagaggtctcccgggaaccgatggcataagcaggggagggttcatgaggcactgtttgatctttccaaatgcctctcaacagtgctcgttccagtggatggattggttcttgcgtaagagcttgaacagcggctcacagatagcggtgagctgtgatatgaatctggcaatgtag

SEQ ID NO: 9880 - DNA, 204 bp, Glycine max
  Peptide Sequence Number=SeqID_101565
atggaagagaagttaaacggaagacaaaggagaagaggtgagaaaaggcaccatccactagggaataagccatggaagaaggagcttcaccaccaagatgagccttggataagaagcttggagaggatgcttcaatggaggaaagaaagagggagagaaagagagaggggggagcacgaaattgaaggaataaaagaggtatag

SEQ ID NO: 9881 - DNA, 576 bp, Glycine max
  Peptide Sequence Number=SeqID_101566
gcgaatgggccccgttcatagacattcttgcactattgatcttcggaggagtcctctttccaaatgtggatgggttggtggacctagtagcaatcgacacttttctcgcctatcatgaccacaaggaaagcccggttgtcgctatgctagccgacctatatgacaccttcgaccgaaaatgtgagaagagcagtacggggattgtttgttgtaccccagctctttatgtatggttggtttcgcacctttttcgccaagaggagcgtctgtcaactggttccctcgatggaaagaaggaagaaccagagcaacttggctaccctatgagaggggcatcactagaggaagagctcgcgcctgtcatttcgcgaggtttcaataagaccaacctggaggcacttcagaaggtccgcaaggcatgggaggtggtgcaaaagaaggacaaagaactcaaaggcagtaacaatgggacactcggtggctaccgtaaaactgctaaaagggaggaagttgaggcaacggaggaagacgaagaggtgcaggcccttagggcagaactcgagcaagcccagaaca

SEQ ID NO: 9882 - DNA, 555 bp, Glycine max
  Peptide Sequence Number=SeqID_101567
atggctacctcaccaaaagaaacttcagctcctggttcaccctctgtaccatcatctccgcaccaggaacaaccagaattcaacatccaacccatgcaaataattcctggtcaagcttctgtccctgagaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgatgctgagaaagatgttccaacatcctccaccccggatgttgctattcctgatgctgagaaagatgttccaacatcttccactccaaatgctgaagtcctcccttcacccagtgaagaggaatcatcagaggaagaggatcaagccacagaggagacccctgcaccacgggcaccagaacctgctccaggtgacctcattgacctggaagaagtagaatctgatgaagaacccattgccaacaaattggcacctggcattgcggaaagactacaaagcagaaaa

SEQ ID NO: 9883 - DNA, 450 bp, Glycine max
  Peptide Sequence Number=SeqID_101568
atggaaggctgtagatttttagtgtcaggaaaatatactgccttgcaaatttgtgatgacgaagacgttgagacgatgctggaaagttttaaacaacaacaagaaatgtcagttctagaattgtacatagaaaaggatgtggctggtggttcaatgtttcattctgcaaattcccttacatcatgtggaaattatgtatctaacgatgacacacaaccgccaacaaatatgagcaatttaaatcttgacgaagatgatgatcatgatgatgatgattatcttgtgcacaacgaattgaaaatccattttggaatgatgctttacattataacaatatcaactagagttatcctgatgaggaggacatttgcggtttggagatgccgtcgacctttaatgttgaccaagaattatatgttggcatggaatttgatagtaaagatgcggtaa

SEQ ID NO: 9884 - DNA, 230 bp, Glycine max
  Peptide Sequence Number=SeqID_101569
atgaaggttcatatctcctcaccttcaaaggactacatgtcttcaccttcaaaggactacatgtcctcgccttcaaaggactacatgtcctcgccttcagagggctgcgtaccctcacctttagaggactacacatcgtcacctttagaggactacacgtcctcgccttcagaggactacatgtcctcgcctttagaggactacacgtcctcgccttcagaggactacac

SEQ ID NO: 9885 - DNA, 204 bp, Glycine max
  Peptide Sequence Number=SeqID_101570
atgtcagtgaaaaacctcgtcgggcgcctaggagtacttgacaagacaaatcacacaatatgttttgcgagaatgctccaaccatatgggatcaacataggcttaaaggagcactcaaaccgtgtgacccccaaggcctacactccgaagagtccgtcagagcctctccctcctgattcaggtccaacccagaaaatattttag

SEQ ID NO: 9886 - DNA, 213 bp, Glycine max
  Peptide Sequence Number=SeqID_101571
atgaacattcaggggaaatgtcgggtcaaactgaaactgggaataaaatcactcatagtgtataaaaactcacacaggataccgccagtcgagagcgaccttgaatggaaatcccaaaggaataactacttcaaaatgggttttcctttgccggcagttatttgcccagccaaaaatttatctggtcagaagatcttctgttctctttcctag

SEQ ID NO: 9887 - DNA, 807 bp, Glycine max
  Peptide Sequence Number=SeqID_101572
atggcaatcaccttatcacgcggacgttcctttgccgtcgcgctggctctgctggccaccggcggtctggcgcaggcggccgactcggtgcgcgtcggctccaagatcgacaccgaaggttcgctgctcggcaacatcatcgtgcaggtgctggaagccaacggcatccagaccaccaacaagctgcagctcggcaccaccaaggtgctgcgcggcgccatcacgtccggcgagatcgacatctacccggaatacaccggcaacggcgcgtttttcttctccgatgagaaagatccggcgtggaagaacgcccaggccggtttcgagaaggtgaaacagctcgactacgacaaaaacaaaatcgtctggttggacgcggcgccggccaacaacacctggaccatcgccattcgccaggacgtggcggaggccaatcacctgaagacgctgtcggatctcggcaagtggatcaacggcggcggcaagttcaagctggcggcctcggcggaatttatcgagcggccggatgcgctgccggcgttccagaatgcctacggcttcaagctgaatcaggatcagctgctgtccctggccggcggcgatacggcggtgaccatcaaggcggcggcggagcagacctccggcgtcaacgcggcgatggcctacggcaccgatggcccggtggcggcgctggggctgcagacgctggcggatccgaaaggcgtacagccgatctacgcgccggcgccgatcgtgcgcgaagcggcgctgaaggcgcacgccaatctgcctgagctgctgaagccg

SEQ ID NO: 9888 - DNA, 525 bp, Glycine max
  Peptide Sequence Number=SeqID_101573
atggcaccagtgactatgggattatgtactgtcattgttcagattcaatgctggttgggtattgtgatgctgactgggctggaagtgcagatgacagaaaaagcacttctgatgctcaaggagtacaatgtcgaacaagatgtcatgacattgtacttagagcttgttgatgataaagttatcacactggagcatgttgacaccgaggaacaaatagcggatattttcacaaaggcattggatgcaacatttcccaacagctctcagagatttacgaaatcattcctaaggctctgcatttccatggctacctcaccaaaagaaacttcagctcctggttcaccctctgtaccatcatctccatcatccaccaaagcaccatcaaaccaggaacgacctgaattcaatatccagcccatacaaatgattcctggttcagtctctgttcctgaaaaattggttcccaaacgacaacagggtgtgaagatttctgaaaaccctagccttgcaacaagtcctagggaa

SEQ ID NO: 9889 - DNA, 981 bp, Glycine max
  Peptide Sequence Number=SeqID_101574
atggccccgaggaagcttgcctcaaagaggtccaggaaggataaggcggccgaagggactagttccgctcctgagtatgacagtcaccgctttaggagcgttgtacaccagcagcgcttcgaggccatcaaggaatgggacgacgagtatactgatttccaggaggaaatagggcaccggcggtggacatcactggttactcccattgccaagttcgatccagaaatagtccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaggaatgcgagtatggccagaggaggaaccggtctgatgggttcgatgaggaggccatcgcccaattactatgtataccggggcaggattttgcccgaactgctgcagggaggcgaatgcgaatcatgcgcaccaacatgaccaccctgactcagatatggatgactctactgctcagcaacatcctgcccaccgatcataacttcgacctccccatgccgaagtgtcagctggtgtacgccatcctgacacggatgagcatccatgtggctcagttgatcgctgatgccatctatatttttgcaggtatggcgcctactaggcaccctttggacccagataagtccaacagggccctgggatttcccgcactgatcacaggactctgccagtcgttcggagtccccgttgcacctaccaaggtaattcggccgcccatcacccgggcttttattgagaagtactgtacccagagacaggctcagggtgatgctccacaggccgcaggcgcgccaccaccacctcatcaggctggccaggctggggcatttgacatggagcagtatttacggcatttggttcgccagcaggcggcccaccaccgagcacat

SEQ ID NO: 9890 - DNA, 420 bp, Glycine max
  Peptide Sequence Number=SeqID_101575
atgattacatttgctgcgccgaacaagaattggaagtttgatatccacttctcaccgccactcgatgcacagacatgtggcaggcctccccattctgtcagaaattatgtttttactgtggatgtcgacaatctcatgattgctcgactttatccattggtactgccacccgatgttgtgagttatgttaatgcagcacacgagtatattactgtccttggtgttcgtgggcgtcgtcacttttggaagttgagtatccataatgggctccaatgtcttggtcagccatggttccaattcttaacacaaaatgatttgatggctggtgacgaagttgtcttctattacaagcccaatcaacgtgtttgggaggtcatttccagaaagcaaacaacgagggacgaggacgactccccttga

SEQ ID NO: 9891 - DNA, 408 bp, Glycine max
  Peptide Sequence Number=SeqID_101576
atggcagtaatggtggcccgagtgatgttggggaatggttacgagcccggaatgggtttaggcaaagacaacggcggtagaaccagcctgataagcgccagaggaaaccgtgggaagtttggattaggctataaacccacacaagcagacataagggaaagcgttgcaggaaggaagatcggaggtcaaggctcgggattgggacgagaagtcgaaggaggcccgccctgccacatcagtaggagctttataagcgcgggtttaggacatgaaggccaagttgttgcgatatgcaaagatgattctccgagtgggtcgaatttggtacgaccatgccctcctggtttccgactaggaaattggcgagtggaggagcgcccggacatttacgcgacaagcataatgtaa

SEQ ID NO: 9892 - DNA, 594 bp, Glycine max
  Peptide Sequence Number=SeqID_101577
atggcggaaccatcaaagaagcgaaagggcacttcgagtcggagtcaacgacattccgggtcacaagaaacaccaattcctttcctccattccctttggatcattgttttcataagaggaacatcgtatacgtttgaatgcattcaagcatttgaaaattccaatcttattcctttcatgtctttaaaattccctgtttattatgatctagtcaaagccttctattcaaacttagaaatccaagaaggcaccctaatgtctgaagtttatggcattaagatggtcattgaccaatccttattctatgatttaacccaatttccaagtgaaggtgtaccatttgaaggtacactgattgacaattggaagtttgatttttttgtgcatgatgcctaccggttggtttgcaccaatcaagcggatatgatcggaaggcttcttgccggttcattggcttttgaaagccgcatccttcaatatctaattgttcgcatcttgcttccgagatcttcaaactttgcacaggtttctgaagaagatctcattgttatgtgggcctttcataaaggtctacaaattgattgggcacatctt

SEQ ID NO: 9893 - DNA, 156 bp, Glycine max
  Peptide Sequence Number=SeqID_101578
atggcaagggctagagcgaggaaagccaaggaagctcttcaacaagtgttgtccatactatttgaatacaagcccaagtttcaaggagaaaagtccaaggttgcatcagccttttgggagaccaaatggtggctgattgatggctattgggggtga

SEQ ID NO: 9894 - DNA, 561 bp, Glycine max
  Peptide Sequence Number=SeqID_101579
atgaatgtcggagctcttatctctggacagatcacatcaatggcccagtctaactcctctagaattgggttccttgctcttatcacaactttatgtaggtccagaggagttgctttcgacagcttagtctttgaacgtttgagcccgctggtagcgcctccagactccatctcgacggtagagcaatttaatgaatggctagcctggccagggactcagcctcctcttcacagggaagatgaagatcccgccactcaggtaccccatcagccgaaggatgagtcatcagagtcttccactcctgagcccttgatcaagaagaggagggtagttgtaacccaggaagctgcaaccacctctgaaaagtctcttgaagccactctagagcttccggcaccagtgacagattccacttctccacaacaggcagtagacccttccacccctgaggatcaaaccaccccagtcctgtctccgaacacctttcctgtagctactcctgtacttcatttgtcggaagaggaggagggtcagacacaagacacccaggaccaatcatag

SEQ ID NO: 9895 - DNA, 622 bp, Glycine max
  Peptide Sequence Number=SeqID_101580
atgaagagaatcatgaaactggccaaatacaggctaaaggcccaagtggagaaggacgaaggcccaagtggagaaggacaaagcccccaaacttatcaacgtaatccttgtggcgtctaccctgacttatcttccttcactggaagtggcgtttacccagacttatcttccttcattagaagtggcgtctaccctgacctatcttcaccggaagtggcatctgcccagacttatcttccttcactggaaaaacagccaacagttgaggcccctccacaaccttccctcgaagaacttgtgaggcaaatgactatgcaaaacatgcaatttcaacaagagaccagagcttccattcagagcttgactaatcagatgggacaattagctacacaattgaatcaacaacagtcccagaattctgacaagctaccttctcaagctatccaaaatcccaaaaatgttagtgccatttcattgaggtcgggaaagcagtgtcaaggacctcaacccatagcaccttcctcatctgcaaatgaacctgccaaacttcactctactccagaaaaaggtgatgacaaaaatttacctaacaatttctatgcaggtgaatcttcttccacag

SEQ ID NO: 9896 - DNA, 627 bp, Glycine max
  Peptide Sequence Number=SeqID_101581
agaccagtggtccatgttgatcctgctaccgacaaggctgacggtccgccaccaagaaagaaattaagaacatatttggggattgtggtgcatgataagatggacgtgatgtatgagaactggaaggaggtccctactgctcaaaaggacttgatttgggaggatattcaggcggaatttgaaatcccagaggcttctaacagtaggaggaaaaagaagcattttaaatcaaacctcacgaggaaatgggcccttgaagccgatcaggacgatgtggacgacactcagaagctcctggctgagaagacgaagaagaagttggaggaagctgcacagtcaggaagcattgatagtgtcatggaccctccatcccccatcagacgccacgtgaagtggaagatggctcgcaccaagaaaacaggggagatgaaaacaaaggaaatcactgagaagattgatgttctcaccgctgctattggacgtccagagcaccctggatgtgtccgtgctgctgcagccagtgtcaccatcaagcaatacttcgaatcagctccacggacgtcctgcagctcttcctcactggctcttgaagaattgcagcagctgacccaacaaatcaaggactag

SEQ ID NO: 9897 - DNA, 288 bp, Glycine max
  Peptide Sequence Number=SeqID_101582
atggaactactccttttaggagctggacttagggaggaggaaagaacaagcattgctaggttccttagtgggcttaatatggaaatgtcgaaaagaaatcacttgattgtcatcatcaaaaagggggagaatgtgaatgtatgtatacatgattttgatgatgccaaagataaagcgcttctcaagtatgatccaagtcaagaattcagaaattcagaaaataactcccaagagtcacatctattcaagagatttctgaatggtcatcaaaggcctataaataggtga

SEQ ID NO: 9898 - DNA, 180 bp, Glycine max
  Peptide Sequence Number=SeqID_101583
atgaagaagatcctaggcctacaagctccaatggaccttacatcatatggcctaggatcttcttcatcaatggatttctttacttcttggaagatgaatgacaacggattggagaaggaagagagagaggagacgccacttcaaggagaagatgagtctagaagaagctcaccaccatag

SEQ ID NO: 9899 - DNA, 180 bp, Glycine max
  Peptide Sequence Number=SeqID_101584
atggccttggtggataactgggtggtgggaatggcagtcacagcatgggcttcttcttcatcctcaccctcttcatttgccccagttttctcattcgtccaagcaggatggctaaatttgactcttttcggacccacatcgatcctttcactggcgaagaccaaatccgcaaagctttga

SEQ ID NO: 9900 - DNA, 375 bp, Glycine max
  Peptide Sequence Number=SeqID_101585
atgtcttcatttacatttcaaaagacttcaatgtcttcagtcattcacgctttcaaaagactacaatgtcttcatttacatttcaaagacttcaacataagtaaaaaggggcaactgtcataccctaatttcgtccagggactattgtttgttgatcttttgatccttgctagtcgacttacgatggcatctacgaaaaggaaggctccttctacaccttcccaagttagatttgatcggtctaggttcacatctcaagaagcttgggagaggtatacggatattgtggtgcctaggaaactaccagagaggaatatggtagtttattacactaagtttgatgagttcaaggaggaactcaagagaagacactag

SEQ ID NO: 9901 - DNA, 1056 bp, Glycine max
  Peptide Sequence Number=SeqID_101586
atgtcttcagtgattgcatgctttcaaaaggcgacaatgaccttcatttacatttcgaagatgacaatgtctttagtcattgcatgctttcaaaaaggcgacaatgaccttcatttacatttcaaagacgcaatgtcttcagtgattgcatgctttcaaaaggcgacaatgaccttcatttacatttcgaagatgacaatgtctttagtcattgcatgctttcaaaaaggcgacaatgaccttcatttacatttcgaagacgacaatgtcatcagtcattgcatgctttcaaaaggcgacaatgacctttatttcatttcgaagacgacaatgtcttcattcattgcatgctttcaaaaggcgataatgaccttcatttacatttcaaagatgacaatgtcttcagtcattgcatgctttcaaaaaggcgacaatgaccttcatttacatttcgaagacgacaatgtcatcagtcattgcatgctttcaaaaggtgacaatgccctcatttacattttgaagaggacaatgtcttcagtcattgcatgctttcaaaagagaatgcagaaaatactcaaaagggagggcaaaagggtcatttttacactttttcatacccctggctcgccgaggctagcctctggctttcctgggccaccaaaattacttcatggtgaagtaaccagctcgcctgggcatgggaaggctgaagtaaagggtcccttaggttccttgagttccagaggtctagaaagaagaagaaataagagaaaggaagaagaaaaaagagaaaacaaggccgaaatgcttctgaatcgcatccgtgatcgattaccgttcgtcgttcgttctttggtcgttcttcgttcattcttcatctgtccttctttcttcgtccggttagtgcttgcttttaaggatttgaatttgatttatggacccttaggggtcccctttattgtttgtgcatcttcatctccttcttcgatcatcaatgatctttttctttgtttaaagagagtttcgactgatcgttcataccataatctcgtttaa

SEQ ID NO: 9902 - DNA, 114 bp, Glycine max
  Peptide Sequence Number=SeqID_101587
atgggcgataagctcgaccaagactggcttgaagaggtaaacttctattcgggcatgacgagccccactaatggaagcttgcttgtggagcttctatggaggctagatctttga

SEQ ID NO: 9903 - DNA, 624 bp, Glycine max
  Peptide Sequence Number=SeqID_101588
atggttctgaattctgctagtgaaatcaaattggaagaggctgctgttttgcattacacatatgctaaattctcagacttaacttctagacgtgaccgctgtggttgcaaacctacaaaagaagatgtcaaaagatgcttcatgttggaatttgacagaacttattctgttttgatcgcatgtcagaaaacaggatttcttatgccggcatttatcattgcttcaactgcaactgaagaagaaatgatgaagtggtataatgaacatgttgtgtggggtgataaagacctgaagatgaaacttttgaggaagggagtattgactcgtatatattctcccatggtcataattcaaagtttaagggaatctggagtctttagttctgtcattgcatctgccccatcactttctaaagaaaactttctgctgtcaattgatagtagtaattcttcaagagtctctgcctctgtaaccctcccttctagaaaggttggaaggaccaaagaatctcaagcagctacacggaaggctctgtctgttgaatctgctgcatttcacgaagtggctgtaccaccactgtctcccccagtagtagatgacaatgacctcatttcacataattga

SEQ ID NO: 9904 - DNA, 426 bp, Glycine max
  Peptide Sequence Number=SeqID_101589
atgcataaggcattgcgattaaatgctccattgccatatccacacctagtcaccctcttctttcaacactttaacatccctcttgattctgaaccttatgttccaatcaagagatcctttctaataggcgcttcagtcattgcatcctttggttatcaaaaagagcatgatggctcttgggtgaaaaagggtgctcaacatgttgatgaagaaggacatggtggagaagattcatctcctcttcaaaagattttggataacttcgatggtcttcaaacctttgttggtgaaaggtttgatactttggagttacaagtggacatgcgctttaatgagatggagtcaagaatcaccaaggtcgaagaagatgtttcttatattcgttcaagctttgatctatcaccactgcagccaccatcatcttag

SEQ ID NO: 9905 - DNA, 513 bp, Glycine max
  Peptide Sequence Number=SeqID_101590
atgcataccggggcaagatttcacccgggccgctgcaaagagacgagtgtggatcatgcgcaccaacatgaccactcttacacagatataaatgacgttgttactttagcaacatttctgcccagtgatcgtaatgccgatctcccccctgcggaaggatcgcacccaccaaagacacccagtggacctgaagaagtccaacagggcccctggggtttccagctctggttacgggcctctgtcggcccctacagggtgctcgttccccccagcaagttcatgtcgtcgtggcatagggatcgtgcccgcaaaacactctgtggacctggagaagtccaacagggtcttggggttgccaactctgattatgagcctctgtcgattctacggggtgcctgtcgcccccagcaagccccctcaggccccctattaaccagactccccccccagaagtactgcgcccccaggcaggcgcagggcgaaacaccacagcagcattgggatggccggtag

SEQ ID NO: 9906 - DNA, 544 bp, Glycine max
  Peptide Sequence Number=SeqID_101591
gtacaatcccgggtggaggattcatctcaaccttagatggtcgaatccttcacaacagcagcaacaacaacaacaacaacaacaacaacatacttattttcagaatgttgctggcccaagcagaccatacgttcctccaccaatccagcagcaacagccccagaaacaacaaacagttgaggctcctccgcaatcttcccttgaagaacttgtgaggcaaatgattatgcaaaacatgcagtttcaacaagagaccagagcctccattcagagcttaactaatcagatgggacaattggctacacagttaaatcaacaacagtcccagaattctgatagattaccttctcaatccgtccaaaatcacaaaaatgtgagtgccattacattgaggttgggaaagcagggtgaatctaaagagaagcagcatatccctggtaattctgatttacagaagcagcatatccctctttcattccttccaagagcaatttccaacaaaaaaaatagaagaggcagagaaggagatcttggaaacatttag

SEQ ID NO: 9907 - DNA, 567 bp, Glycine max
  Peptide Sequence Number=SeqID_101592
atgtaccctttcttgttcttagttacaacaacccaagtagatgtaccctctacttgtaccacaaaggatgtaccttccaatgtgttaaggcaaagttctcaggcagttagtcctttgaaactttgtgatggtgaaacaaaagatatctcaggcgggagacacaaaagaattcaagcggttagtcctttgttcttttggaaaagggagaagagagacacaaaaagaattcaggcgaacaaagtttggaaaccagaaaactcagaaagcttttggcaaaggaagaagaagaagaagttcaagaagatgttcaaggagactcaaaggaaactggtaatcgattaccagagagtaaaaactctgttccctttgctatccgaagactatcaagtccgatggcatgcagagacgaacatagtcatctacttcccttgtcgagagtctcaatgtctattgaccaaagctactgaagtctcccctactatcttgagacaagcaagtccaatagcatgcagggaccattaccattatccgtttttgtcgccttcaaggcaccaaggcttttgctga

SEQ ID NO: 9908 - DNA, 298 bp, Glycine max
  Peptide Sequence Number=SeqID_101593
cttgggaggattgatggggacccggtgttgagagaaacgaggatatgggctacgtgggagtacgtgagctcagttggaggtgggcaacaggggatggtggtggtacctggagatatgtcgtgggggtcaggagaccttggggacgtcaggcgagctcctgacagtcaacagataaaaggaacaaagaccacaaagcaagggaggcttgcgtggcttgaaaacgaggcctctggtaatcgattaccagtctgtgtaatcgattacacagaggaatgggtcactggtaatcgattaccag

SEQ ID NO: 9909 - DNA, 327 bp, Glycine max
  Peptide Sequence Number=SeqID_101594
atggatatctgtgaagatactgacattcctgtaatattgggaaggccattcatattaactgcaagctgcataattgatatgggtagaaagaagctggagatgggttttgaataccagaaaattgattttgatttgtttgttgaaggcaagcccgctccagaacaaaatgtttgcttacaggtaatggaagttggtcaagaggttctagagtattttctgaaaaacagtcgtttcgctaagtgcaagcctcgcgctaagtgcatctttggtcatacgctaagctgtgagtatcaagcacttagcgctcaacccttgcatcttaggtag

SEQ ID NO: 9910 - DNA, 333 bp, Glycine max
  Peptide Sequence Number=SeqID_101595
atgatgatatcagacctaagacaaccagaaaatgacattgatgtttattttagtctcttgattaaagacttggcaaagttgtgggatgaggggtgtcacaacctacccttcggcgggagggcgacgcgagactcacgagtgcgtcttctaagaaggaaaatgtgtgaagtcgccaccaacgtttattcaaggaaaacgtcggaaaaatcggaaaggcgtggtctacaaactttaagtgtgaaaggttcgggagttgtatttacgcacagggaagggtgtttcctttgctccgacatattcctcaattgtgataaggaaatcagacctacatag

SEQ ID NO: 9911 - DNA, 250 bp, Glycine max
  Peptide Sequence Number=SeqID_101596
acacttgctaacattgccacacctcttgggcttgagtttattcctcaagtaaagaagttgttggatgagggggttcccatgaaccctaagagaataaaggtcattcctgagtggcccactccaccaacaccactcattgagttggtgagaaaccatgttctttcatgggaagatgcccaggaaatgggtgttgagggaaggagcccagagtatgaagaacctcgggatttgaggtcaaatcctttccaag

SEQ ID NO: 9912 - DNA, 405 bp, Glycine max
  Peptide Sequence Number=SeqID_101597
atggaagtggaatggagaaggaagagagagaggagacgccacttcaaggagaagatgagtctagaagaagctcaccaccataggaggccatggataagagcttggaggaagaaggatatgaatgaagggagagggagagaagagcacgaaattttgtgctctaagagagctttgaaatctaaattatggttcagcccactaatccaagatcaattccaagattctccactaagtgtgcttaggtggcatgaggcatatccattgaagcttgtattcttaggatcttcttcattaatggattcctttgcttcttggaagaagaatggaagtggaatggagaaggaagagagagaggagacaccacttcaaggagaagatgagtctagaagaagctcaccaccatag

SEQ ID NO: 9913 - DNA, 165 bp, Glycine max
  Peptide Sequence Number=SeqID_101598
atggagaataagatgaagaacaaggaattaaagccttggatcttcttcatcaatggagtcctttgcttcttgaagtttaatggaagtggaatggagaaggaagaaagattattggaggtgccacttcaaggagaagatgagtcaagcacaagctcaccaccatag

SEQ ID NO: 9914 - DNA, 357 bp, Glycine max
  Peptide Sequence Number=SeqID_101599
atggatccgcccttcacgactccagaggcctatattcagcaggtcgcatggccaggagtccatccctctactgataggggggagagccatctggagccggttcgggagatgctacaatttgagcgaaggaagcacagtgtagaagcaaagcttaatggtgaatcaaagaacagttcaagagttcaacataagaatcaagaagaattcaagactcaagaagaaagtttagagtcaagaatcaagattcaagattcaagatctcaagaatcaagatcaagattcaagactcaaaattcaagaatcaagagaaggcttaatcaagataagtatgaaaaggttttctcaaaaattgaatag

SEQ ID NO: 9915 - DNA, 333 bp, Glycine max
  Peptide Sequence Number=SeqID_101600
atgaaaagatggtgggctatgcaccttcaaagctttgcggatttggtcttcgccagtgaaaggatcgatgtgggtccaaaaagaggcaaatttagtcatcttgcttggacgaatgagaaaactggggcaaatgaagagggtgaggatgaaggagaagcccatgttgtgactgccattcctatatggccaagtttcccaccaacccgacaatgtcattacttagccaataacgatccatctccttacccaccacccagttatccacaaaggccatccctaaatcaaaccacaaaacccacctaccacacgaccaatgctaaacaccacttttag

SEQ ID NO: 9916 - DNA, 409 bp, Glycine max
  Peptide Sequence Number=SeqID_101601
cttgggaggattgatggggatccggtgttgagagaaacgaggatatgggctacgtgggagtacgtgagcttagttggaggtgggcaacaggggatggtggatttatacgcgatttgtggatgtggaaaaacttgttgtgcaccattgcccgaccgccacctagtaccacatgtgatggtggtacctggagatatgtcgcgggggtcaggagaccttggggacgtcaggcgagctcctggcagtcaacagataaaaggaactaagaccacaaagcaaggaggcttgtgtggtggctggccagctgtgaacttgattgatatgcttcaaaaagggaactggaagactatggaggcctctggtaatcgattaccagtgtgtgtaatcgattacacagaggaatgggtcactg

SEQ ID NO: 9917 - DNA, 255 bp, Glycine max
  Peptide Sequence Number=SeqID_101602
atgaacaacatgatcacgttgcaacacgctgaaattaagtcatcttttgagacaagtacatatgtggttggacatgtttttaaagttatcttgtacaagaaactactttgcgtggtatcaagttcttgttatggatgtgtaacaagaactactcacagtcttccatgtgcatgcgagagactaagtttttcagaccaaggtctatctgaacccgaagttagcataaccgaagagatggaaatcatatccaagtag

SEQ ID NO: 9918 - DNA, 2610 bp, Glycine max
  Peptide Sequence Number=SeqID_101603
atggctactgcaaatggtggaactggagctgagaagcacaagaggaaaactaatgatccttttcttaagcaagggggacaccaactcatgccaagatcacctagattgtgcacacctattcggaaggaatggccggagagttttccgaatgacaatgtgattggtaatgaggataatggtttgaatagatatattacttccttagctggatctggacctcctggtactagtttttgctcctcaatagattctgaacacattgttgaagagttgcctgttaggaattataagaacccgaattatttgactattgagtctaagtataatagattgagtagagaaattgtccccaaggttgaggaacagataccactcagattaagcaaaggactcaagggaattgattctgaattttggggcctgaagtctcttcctggcaagagtgtaaatcatgactcactgaatgtctcagaaggtagaagcaatatgggcaaggctatcatctcaaacaatgcacatctaattagcagtataactcagagtacttcatctgcatataattatcctcaattgattgtaaagcaaacaaagaagggaaaggggattatttgtgaagatttaaaccaaagcttcagtactggaggagcacttaacagccaagaggatgagaaacctgcttttgcagctaagtttcaatccgagacactggtgagatcaaatgttgatgagaataagcctttattggaaggaactttcttgtctggtagcaaaggactcaacttaagagagtggctgaagtctgaaggacataaagtaaataaatcaggaaggattcgtatatttaagcaggtattggaattggttgattttgaacactctcaaggactcgtcttgctagactttcgaccatcttgtttcactttattgccttcaagtaaaattaagtatattggttcatatggccaacaagagttagatgatgaagtcatgacatgtaatgtgactaggaaaaggcctttggaacagaacacctgtgcttgccagagtttgagtacaaagcaacaaaagctctgtgaggagacaggatcttcgaggcagcagcatcacggtaccagtattcatggctgccggatgacagtaaatcaaactgactcagacacaaacagacctgtggaatcaaagagtaaagaaagtctatgccaaaataattctatttgtactgaagaaaagcagtttatgtctgcatttattaagttagaagagaagtggtattgtagtccagaagtgctcaacgatggagtatgcatgttgtcatcaaatatttatagtcttggagttctcctttttgagtcagaagttatgcgtgaatcagaggaatcaaattctgtagatgatgttggaatatctgatgacgaggctgaaacagagcaattactagattttctaattttaatcaaagaagcaaagaaaaaacgggaagcgaagctggaagaagagctaaatttattgaatgaagatattaaggaggtagaaaaaagttattcatttgtgacagattcagtatttcctttggtgcaaatgaacaatcctgaagtgagaggagacaatttatattttcaagatccttccggttcagacattagtagatccattcgaaggtcatttggtgatgaagaaagatttatgagtaatctaaatcagctagagaattcttacttttccatgagattccgagtgctgccaaaagaggcttcatctgtttcaagcaatgaaaaaaatgtgatggaaagtagatggaggttgcctcaagtagagaatgttaataaggagtctagaagaattcagagttctgttggttgtgtaggatccttctttgaaggtttatgcaagtttgctcgttacagcaagtttgaagagtgtggcagattaagaaatagagatctgcttagttctgccaatgtaatgtgtgctctaagttttgaccgtgatgaggatcacattgcagcaggaggagtttcaaagaaaatcaagattttcgaccttaatgctattgcaagcgattctgttgacatccagtacccagtaattgagatgtcaaataaatcaaagcttagttgtgtgtgctggaacacttacattaaaaatcatctggcatctactgactatgatggtgcagttcagatgtgggatgcagacacgggtcagccattgtctcaatacatggagcaccaaaagagagcttggtctgttcacttttctctgtcagacccaaaaatgtttgctagtggaagtgatgactgctctgtcaaactgtggactgattacaaggtttatggttatgatcttcgtcacactagaattccttggtgcacattagctggtcatggcaaagctgttagctatgtaaaatttatagattctgaagcagttgtctctgcttccactgacaactctttaaagctttgggacctgaacaaaaccagctcttctggtttgtcatctgatgcttgtgccatgacctttaaaggtcatagtaatgaaaagaatttcgtgggattatctgttttggatggatacattgcatgtggttcagaatctaatgaggtatag

SEQ ID NO: 9919 - DNA, 654 bp, Glycine max
  Peptide Sequence Number=SeqID_101604
atgtgggctttccttaccggtcgtcagatcgactgggctcacttggttaggtaccgaatgcataaggcattacgggccaatgcacctcttccatatcctcaattggtcaccctttttctccatcattttcaaattcctcttgacgatgaaccttttgttcaagtcaggcgatcctttgctataggtgctggtgcagtaacttcatttggttaccgtaaggatcatgatggtcaatggctgaagaaggacgcattacctccacaagacgagtgtactccttctcctcctcctcaacgagatgattcctcagcccttatgaatgaagaaaaaaattgtcatcatcaaaaagggggagattgtagaagcaaagactttgcctttgatgttttgatgatgccatatgatcgtgatgttttgatgccttatgaaaatgtgcttctcaagttttattcaagacaaaaatccaagaatacaagatacaacatcaagaagatctctagtgttttaggaagtgaattccaaattgaaatgcaaaaggtttggccaagaaatttaagcaaaaatgtctttttcaagagatttactctctggtattcgattaccagaggatgtaatcgattaccagtggccaaaatgaattataacagctattag

SEQ ID NO: 9920 - DNA, 597 bp, Glycine max
  Peptide Sequence Number=SeqID_101605
atggagataagaatgatagatgctgccagtggtggagcccttggagacatgacccctgctgaagccaaaaatttaattgagaagatggcttcaaactcccagcaatttagtgccagaaaagatgttattgtcattagaggagtgcatgaagtagccacgatatcatcttcatcagctgagactaagaagcttgaaggtaaactagatgccttggttaacctggtaacccaactggccatgaataaaaaatatgcacctatcgccagactctgtggtttatgctcctctgtcgatcaccacacagacctttgcccttctgtgcaacaatctaaagcaattgaacagcctgaagcttatgctgcaaacatctacaacaaacctcctcaacctcagcagcaaaatcagccacaacagaacaattatgacctctccagcaacaggtacaatcctgggtggagggatcatcccaaccttagatggtcgaatccttcacaacagcagcaacaacaacaacaaccttattttcaaaatgttgctggcccaagcagaccatacgttcctccaccaatccagcagcaacaacagcaacaaccctag

SEQ ID NO: 9921 - DNA, 276 bp, Glycine max
  Peptide Sequence Number=SeqID_101606
atggataaaaacttgaaggtaggagaagatgaatggagggagagggagagaaggagcacgaaattttgtgcctccaaagagtgtagaagcaagcttcatgatgatgaatcaagtagttttgatgatgacaaagatgatgacaaaaaagcccaagagaatgatttcaagattgagtcaacaagttcaagatcaagtttaatttcaagtttcatgagaagaaatcaagaagattcaagaatcaagagaagtttgatttcaagattcaagagaagatga

SEQ ID NO: 9922 - DNA, 309 bp, Glycine max
  Peptide Sequence Number=SeqID_101607
atggttatgcaaacctcgcccattggtgttgacagctgcagagataaggttgttgctgtggatttttgggttctttttatttgtgcaactcaaaggtcaagaacacttcatgataacaaaggtgatgacaaaaagctcaaaggtcaatcaaagaatgagttcaagatgttcaagatagaatcaagaacacttcaagattcaagaggaaagttgatttcaagaatcaagaatcacgattcaaggatcaagcttccaagaatcaagatcaagattcaagactcaagattcaaaagtcaagagaagacttaa

SEQ ID NO: 9923 - DNA, 960 bp, Glycine max
  Peptide Sequence Number=SeqID_101608
gggcgcaagctggatcaaaccggcgtgtgcgaactggcggccaatcagaagatgattctggtgtgcggccgttacgaagggatagatgagcgcgtaatccaaaccgaaattgacgaagagtggtcaatcggcgattacgttctcagcggcggggaactgccggcgatgaccctgattgattcagtcgcccgtttcataccgggtgtgctgggccatcaggcctcagcggaggaagactccttcgccgacggattgctggactgcccgcactatacccgcccagaggtgttggaagggatggaagtaccgccggttctactgtcgggcaaccatgccgagatacgtcgctggcgcttaaagcagtcgctgggccgaacctggcttagaagacctgaacttctagaaagcctagctctgactgacgagcaagcggtgttgctggctgagttccaacgggaacatcaggccaggcaacaggactatgaaggaaacgtatgggtcgttgaaggtagcaaaaaacgtctgcaggcattcgagggcgtggttatcgctatccgtaaccgcggtctgcactctgcattcactgttcgtaagatttccaacggcgaaggtgttgagcgcgtattccagactcactccccagtaatcgacagcattactgttaaacgtcgtggtgccgttcgtaaagctaaactgtactacctgcgtgaacgtactggtaaggctgctcgtatcaaagagcgtctgaaccgccgcggcggcgctttgtttatgctgactctccggcgggtgcggctgcgccgggacaatgtcatcgccaggtttgacgatcacccgcgcgacggactcgtgcgtggcgaacgtgcagctgcaattgatgttgcggcattgatggtaacgctctttggtcgactcgctcagatagcggctggagcgagtgtgggccacgtgaccgcataa

SEQ ID NO: 9924 - DNA, 390 bp, Glycine max
  Peptide Sequence Number=SeqID_101609
atggagcaattccttgagcaagtagcatggcctggagctctaccttcaatggtgagacccaacgaggctgttcttcctgagcccacacctgcacgggttgaaccagtgtccgctgatacacaatctccagtagtgaatccaccttctcctgagcttgaagtagttcccctatttccaccttttattatcatctctgattccccatctggagaagttgctgctccccatgattccccagttggagaagctgttaatctttctgattccttatctggagaagttgctgctctctcttattcctcagttggagaagctactgatctttctgattccttatctaaagaagctgttgatctctctgattcccctgtttttccatctgatagatga

SEQ ID NO: 9925 - DNA, 774 bp, Glycine max
  Peptide Sequence Number=SeqID_101610
atgacgggagcgtccattagttggttctcatggtggaaagaaggaggggcaggagtgttatgctcgtgtgagggattcccaaatgtccccttgatggggacgagaggttgtattaattataatcccatgctggccataagacagttaggctaccctatgagaggtgcaccgtcggaggaaatcatcacgtctttcatcgcgcgaggtcttaatgaagctaatgcgaagatacttcagaaaatccgtaaagcatggaatagagtgggaagaaaagataaggagcttaggggaagtagcaatggcgtcatcgatggctatcacaagtggttgaagtctagaacgcaagggataacttggctcccaaatctgaaaagtctaagtgagaaagaggttgaaattcctgaggaaagtgaaaaagtcagtaacgagctcaagcttagaaaggtcgagagggacgaatcaaggatggaaagcctggtgttagaggataagttaaaggcttgtcagaggtcaaagagaagtttgatggaacagctaagcaaaatagaagagaatatgttaataatcattgatcaatataaggagaagattgaaagggaagcgatagatagggtgatagagttattgcacggggaagccatgaaatggatgaatatattcgctctcactctgaatgagagtcaagagctgccaaggttgttagccagagccaaggcagtggctgacacatactcggcttccgacgaagtccacggtcttttcaatttctgttaa

SEQ ID NO: 9926 - DNA, 141 bp, Glycine max
  Peptide Sequence Number=SeqID_101611
atgaagttagtcactgcatgtcaacaggctcgctgccctctggctgacaaaggtgcggataaccataaggtgacgacgttagtctctatgtgtcaacgggctcgcttgcctctggctgacaaaaggcacggatacccataa

SEQ ID NO: 9927 - DNA, 681 bp, Glycine max
  Peptide Sequence Number=SeqID_101612
atgactacacgtcctcgtcttagaaggctactcgccctgcctcagaggactacatgtcctcgccatcagaggcaatacgtgctcacctttagaggactacacgtcgtcgccatcagagggtcacatacccacaccttcagaggaccacacatcctccgccatcagagtgtcgcgtaccctcaccttcaaaggcctacacgtcctccgccttcagaggactacatgtcctcgccttcagaggactacacatcctcgccttcagagggccacatgactacacgacttcaccttcagggggctacacgtcctcgccatcagagggctacacgccctcaccttcagaggacttcacgtcctcgccttcagaagactacacgtcctcaccttaagaggactatacgtcctcgccttcagaggactatacgtcctcgacttcaaagggctacacgtcctcgccttcagagggctacacatactcgccttcagaggactacatgtcctcaccttcagaggacaacacgtactctccttcagagggccactcgtcgtcgccttcagaggactacacatcctcaccttcagaggactacacacctcaccatcagaggattacacatccacgacttcagagggctacacgtctacaccttcagagggctgcacgccctcaccttcaaatga

SEQ ID NO: 9928 - DNA, 483 bp, Glycine max
  Peptide Sequence Number=SeqID_101613
gtacaagccctaaaggcagagcttgaaagagcccgagtagtcgaagagaagttcaagtccatagccatcaaagaatcatcacgggtcaaaggcatgatcttgaaggacgagctaaaggcttaccttaggtcgaaaagaaatttgtcccaacagttaagcgagactgaagggaatatgtgggccatcatcaatgagtgcaaagagaagctaaatctagcagcgactcacgagcaaaggctagaggatgagtacgccaagatatcagcagaaagggaagtaagggaaagggtaattgattcattgcaccaagaggcaacaatgtggacggaccgatttgctcttactttgaacaggagtcaagaacttccccccattgctagcccaaggccaaagcagtggcggacacctactccgccccccgaggagatccacggacttctcaagctattgtcagcatatgatagacttaaatggaccatatga

SEQ ID NO: 9929 - DNA, 175 bp, Glycine max
  Peptide Sequence Number=SeqID_101614
ggtattggatagcagaatccaagagcattgggctagagctactaaagaaggccctaggattctcatgaacctcaaggaggtgagcttagctattagagagcttctcaaggaagttttctcaaagaagcttctcaaggaatttttctcaagaaagcttctcaaggaagctacctag

SEQ ID NO: 9930 - DNA, 238 bp, Glycine max
  Peptide Sequence Number=SeqID_101615
cggaaggcaaaggagaagaagagaagggaggcaccatccactagggaataagccatggaagaaagggcttcaccaccaagaatgtgctttggataagaagcttgaagatgatgatttaatggagaaaaagaaagagtggggggaacacaaaattgaaggaataaaagaggaagagaagtggaactttgaagtagcttccttgagaagctttcttgagaaaacttccttgagaagctag

SEQ ID NO: 9931 - DNA, 255 bp, Glycine max
  Peptide Sequence Number=SeqID_101616
atggtcctaggcaaaccatggagtctcacaacttccctaaaaaagagttttgagatatgggaagcatcatccaccttgtggcatggtataaagtgtgccatcttgctaaacctatccaccaccacaaagatagagtatacacctctttgggttctaggaagccccaaggacaaagtccatactaatgtctacccaaggtgcaggtgcagagggggatgggtaagggtgtgtatagcccataaggcatcaccctag

SEQ ID NO: 9932 - DNA, 135 bp, Glycine max
  Peptide Sequence Number=SeqID_101617
atggtgattttccaccatggagatgcagaggaagacaaaggagaagagcttggagaggatgctttaatggaggaaaagaaagagggagagaaagagagaggggggagcacgaaattgaagggtgggatcctctag

SEQ ID NO: 9933 - DNA, 312 bp, Glycine max
  Peptide Sequence Number=SeqID_101618
atggcttccatgatggaggccatgttaggaatgaggcaactcatggagaagaacgtggccaccgctgccgctgtcagttcggctgctgaagcagatccgactctcctagccaccgcgcaccatcctcccccaaataagctaggacgaggaaggaacacactggggcacaacaacaacccccatttgggatacaaccgagcgacttacccttatggattgccgcctaattactcgccaccagtcatgcaagatgatgcgggtcatatctcttctcccatccttgaaggggagcctcctcaacagcccgaagag

SEQ ID NO: 9934 - DNA, 471 bp, Glycine max
  Peptide Sequence Number=SeqID_101619
atggccccgaggaagcttgcctcaaagaggtccaggaaggataaagcggccgaaggaaccagttccgctcccgagtatgacagccaccgctttaggagtgctgaacaccagcagcgcttcgaggccatcaggggttggtcatttctccgggagcgactcgtccagctcagggacgatgagtatgccgatttccagggggagatagttcgccggcggtgggcatcactggttacccccatggccgaattcgacccagacatagtcctcgaattttatgccaatgcttggcctacggaggagggcgtgcgagatatgagatcctgggaagagggccaggagtgtgcaccaccaccacctcatcaggctggcccggctgggtcatttgacatggagcagtatttacggcatttggttcgccagcaggcggccaaccaccgggcacatgtacagacccatgattgtctgtactag

SEQ ID NO: 9935 - DNA, 291 bp, Glycine max
  Peptide Sequence Number=SeqID_101620
atgacttccaagattattttgatgatgccaaagaatcaagagttaagcaagttccaaagaataaggagtcaaaaagcttcaagaacaatcaagtttcaagattcaagattcaagaacaatcaagtttcaagactcaagattcaagaacaatcaagatcaagattcaagaatcaagagaagactcaatcaaaaggtagtaatcgattaccagtagctaacattgtttttcaaactgatttacaaagttgtaatcgattaccaggagcatgtaatcgattaccaatgttttaa

SEQ ID NO: 9936 - DNA, 234 bp, Glycine max
  Peptide Sequence Number=SeqID_101621
atggatggcgaagagctaccttcacccgtgaattctgaggggcaggatcatcttgagctaccttctggggtagggacaaaacatgaacagcagaaacaaatcaagggacggatgcaagtagggatggggtcacgaccgaccgatcgttgccccttctttgcgctaaacaagcagagaacgtcgcgcaaggctcaaataggcaaaacgctaacccataaggaaggaggggacatg

SEQ ID NO: 9937 - DNA, 374 bp, Glycine max
  Peptide Sequence Number=SeqID_101622
agcatgatggctcttgggtgaaaaagggtgctcgacatgttggtgaagacggacatgatggagaagattcatctcttctttcaaagattttggacaggtttgatggtcttcaaacctttgttggtaaaagaagttgtcatcatcaaaaagggggagattgtagaagcaagcttcatgatgaatcaagattgattcaaagaagttttgatgataacaaaggtgatgacaaaaagctcaaagaatcaaagaacgagttcaagattgaatcaagaacaattcaaggttcaagaggaaatttgattccaagaatcaagatcaagattcaagaatcaaaggtgatgacaaaaagctcaaaggtcaagaacacttcatga

SEQ ID NO: 9938 - DNA, 261 bp, Glycine max
  Peptide Sequence Number=SeqID_101623
atgtttgtcgacccaaacaatgcaaacacatttgcattgggtgaagttgtggagactttacaatatatggtgtcaccacaagggaggaacacatggacagttgatgatctcgtgccttacgtggataagttagcgattatatctgaagagcaagagagaatcactgagccactgtcacatggtccagcattagagcgtgaattcccaacacaagagtttcacattcttcagtcaagtgttgaaactcggggcattggctga

SEQ ID NO: 9939 - DNA, 75 bp, Glycine max
  Peptide Sequence Number=SeqID_101624
atggcttttattccaagaggatacaacaggatgaagccttgtaaggtttcttatcaaaacataaagcaaaaatga

SEQ ID NO: 9940 - DNA, 309 bp, Glycine max
  Peptide Sequence Number=SeqID_101625
atggcgcctactttcttgaattatcatgctggtgctaagcgtgttgttcccgctaagcttgaggctcacgttgagtgcctgggacacgctaaggtgaaccttgggtttatcgagccttggaccaatgacgtgtttgccccaagttttgataagcctatggagctacgtcgaggcttgggtcttgcctcaccaagggcggagcttgggttttgcaaaccctttggaggatcgaccaggggattgtccgacttgggttttgggtgtcatgctcttgcatacatgtcactcaccgtgggtggcatgtactag

SEQ ID NO: 9941 - DNA, 2439 bp, Glycine max
  Peptide Sequence Number=SeqID_101626
agcggcgaaagctgggcctttgtcggtgcttacggcagcggtaaatcttcgctggcgcgcgcgctgtccggcgagctgacggcggcaaagggcgagccgcggcaggattggcagcgccgcacccgtctgtcactggagcagctgcaacagctggtgacgcaggagtgggagcgcaacaacaccgatctgctgagtgaaggcgaagatgacaccggccgcaccgcgctggagatcattcaggatgaagtaaaggatgaggcgcgggcgcaggcgctggcacagcagttcggcatcagcgctctactgactcgccgcttcaaatacctttctaccggcgaaacgcgcaaaacgctgctgtgtcaggcgctgatggcgcagccggatttgctaatcctcgacgaaccttttgatggtctggatgtggcatcgcgcgccagtcttgccgatacgctgcatcagctgcatcgcgacggctacaccgtggtgctggtgctgaaccgctttgacgacatcccggattttgtccagcaggtcggcgtgctggcggagtgcacgctgacaaacgtgggcgcgcgccaggcgattctcgccgaagcgctggtggcgcagctggcgcacagcgaacgtctgcagggcatggcgctgccggagccggaccagccggatcagctgccgcagctggcggcagatgcgccgcgcgttatcctgcgcaacggcgtggtgtcgtataatgatcacgcggtgatcgacggcctgaactggcaggtcaatcccggcgagcactggcagatcatcggccccaacggggcgggtaaatcgaccctgctcagcctggtcaccggcgatcatccgcagggctacagcaatgatttaacgttgtttggtattcgccgcggcagcggtgaaaccatctgggacatcaagcagcatatcggttacgtcagcagcagcctgcatctggattaccgcgtcagctgtaacgtgcgtacggtgatcctttcaggcttttttgattcgatcggtctgtatcaggcggtatcggatcggcagaaagcgctggcgcgccagtggctggcgctgcttggcatggacaatgcgctggcagatgcgccgtttcatagcctgtcgtggggccagcagcggctggtgctgattgcacgcgcgctggtgaagcacccgacgctgttaatcctggatgagccactgcaggggctcgatcccattaaccgccagctggtgcgccgctttgttgatgtgctgatcggcgaaggccgtacccagctgatgtttgtgtcccaccacgccgaggacgcgccgcagtgcatcacccaccgcctgagttttgtaaaacagggcgcgggctatgtctatcagcaggaggcgttgcgacttgttatgcaaaaatttaacccggtcgatcatccgcatcgccgctataacccgttgatcgatcaatgggtgctggtgtcaccgcatcgcgccaaacgtccgtggcagggtgcgcaggagacaccagcgctggagcaactgcccgcacacgatccggactgcttcctgtgcgccggtaacacccgtatcaccggcgacaaaaatcccgattacaaaagcacttacgtgttcaccaatgacttcgccgcgctgatgaccgatacgccggacgcgccgcagagcgatgatgtgctgatgcgctgtgaaggcgcgcgcggtaccagccgggtgatctgcttctcgccagatcacagcaaaaccctgcccgaactgccgctgcacaacttgcaggacatcgtgcgcacctggcaggagcagaccgctgaactcggtcagcactatccgtgggtgcaggtatttgaaaacaaaggcgcagcgatgggctgctcaaatccgcatccgcacggtcaggtgtgggccaacagttttctgccgaatgaagcgcaaaaagaggatgacaaccagcgccgctactttgctgataaaggcacgccgctgctggtggattacgtagcgcgcgaactgcaggacggcagccgtaccgtggttgaaaccgatcactggctggcggtggtgccgtggtgggcggcctggccgtttgaaactctgctgctgcctaaaacgcacgtgaaacgtattaccgatcttaacgaggcgcagcgcaccgatctggcgctggcgctcaagcagctcaccagccgttacgacaatctgttccagtgctcgttcccctattcgatgggctggcacggcgcgccgtttaacggcgaagccaacgatcactggcagctgcacgcgcacttctatcccccgctgctgcgctccgccacggtacgaaaatttatggttggctacgagatgctggccgagacccaacgtgatttaacggcggaacaggcagcagaacgtctgcgctctgtcagcgctatccatttccgcgaggaacaataa

SEQ ID NO: 9942 - DNA, 175 bp, Glycine max
  Peptide Sequence Number=SeqID_101627
atgactttgggcagcggcgcagcactggctgctgataacaacaacggccaggcgaatgcgtcagcagaagccggcgcagccgcgggcggcgcgaaagagaatctgccgccaaataatgtcgacaatagcaacattaataacggcagcatgaacaccaacggtgccgcgacttctg

SEQ ID NO: 9943 - DNA, 76 bp, Glycine max
  Peptide Sequence Number=SeqID_101628
cacagtctgtcataccctaatttcgtccgggggacctttgcttgatgacatgcgacttttctttggtccttgtgag

SEQ ID NO: 9944 - DNA, 288 bp, Glycine max
  Peptide Sequence Number=SeqID_101629
atggcagaggaatggagaaggaggaaaggtgattggagatgccacttcaacgagaagatgagtcaagaacttaaagataagtgggttcatgttgatctcatgggcccaaaatctaccctaaggctcatgagaaccctagggccttctcctgcatctctaacccaatctttttggagtcttttatccaatgcccttggcagggtaaggtctgaaaacccctttcctgggcatcttcccatgagggaacatggttccttaccaactcaatgcgtggtgctacaagtatag

SEQ ID NO: 9945 - DNA, 213 bp, Glycine max
  Peptide Sequence Number=SeqID_101630
atggcctttggtaatcgattaccaatggggtgtaatcgattacacaggatcgcgatggcagcgcaattaatccatgatcgcgtggtgatggagtgcttagagggagtttgggagaccctcgaaggcaatgagaggtgccgatttcgtggcacaattcgactcactgttacttcattagtacatccggaggaacccgcacgcacacttcagtag

SEQ ID NO: 9946 - DNA, 636 bp, Glycine max
  Peptide Sequence Number=SeqID_101631
atgggtgaagtagaggaggtgcaagggcagatgaaggccgacatggagaccatgaaaaagcaaatgaccataatgatggaggtcatgatgagcatgaagaagataatggaagccaatgcggttgtagttgccgctaccagcgttgttgctaaggtgaacccaacacccccatttgtcctcaaccaaatgaatcctccaaccccaggtatggtaggaaaagatttaggaagtacgggcggcccacatgacgtacaaattcaaaatgaacacgccttcccaccatatggcttacctcccaactatacaccacctaatgtggcatacactcctggtgaggatgtcaataactccgctcccatactcattgtgagccggcaacctcatcatgcacatatctctcaacccatgggggagacatatgaaataccccaccataatctagccgactttgagccttgccttggatatgccactgaagagcaagcagttggtggtatactcctgcaaaacactttggagggccctcaatttcacccccaaccacaacctttgcattccacaacaggtaaaatccctcctattatggaagaaatgggaaaagttggatcacatagaggaaaggctcagggccattga

SEQ ID NO: 9947 - DNA, 402 bp, Glycine max
  Peptide Sequence Number=SeqID_101632
atggctgaagccaccacagttgatacctttgctctggatgtcactatggatgccacatcgatcgctgctaggtccaccaacccatccacgttcggaaagaggactcctccaaagatcaacagtgcgagaatatctatgaacggggcccactcgcctttacctgccaagaatcttgcttttgcctccaattattttctcggtattccaaccaccccatttttgacttgcttcctgtggtctaattcctgcgccgagatttggactatcttggaaattctagctaatgagggatataaccctgagaaagagttagaagtccccaaaggtgaagcacctcaacggctgatcataatactgggcgagggaggcaatggcccctgtggagacttctaccatggctag

SEQ ID NO: 9948 - DNA, 129 bp, Glycine max
  Peptide Sequence Number=SeqID_101633
atgacattgagggaagacccattgccaatgagtactttggccattgtggtccatgcatttgacggacacgtgcaaagccttgttgtgtcccctgccctcaactggcatctcctcgttggcaaaagtcag

SEQ ID NO: 9949 - DNA, 549 bp, Glycine max
  Peptide Sequence Number=SeqID_101634
atggccccaaggaagcttgcttcaaagagatccaagaaggataaagcggctgaaggaaccagttccgctcccgaatatgatagtcatccttttaggagcgctgaacaccagcagcgcttcgaggccatcaagggatggtcatttctccgggagcgacgcgtccagctcagggacgacaaatatatcgacttccaggaggagatagtttgccggcagtggagggtgtacgagatatgcgatcctggttcctgggattatggccagaggaggaaccgggccgatgggtttgatgaggaggccatcgcccaattgctgtgtatactggggcaggattttgcccggactgctgctagaagacgggtgtggatcatgcgcaccaacatgaccaccctgacccagatatggatgacgttgctgctcagcaacatccagcccagcgatcataattccgacctccccctgccgaagtgtcagctggtgtacgccatcctgacacggatgagcattcacgtggctcagttaatcgctgatgccatctatctattgcag

SEQ ID NO: 9950 - DNA, 295 bp, Glycine max
  Peptide Sequence Number=SeqID_101635
atgtctcttacaactctttttggaaagcttcaggaacacgaaatggaacttatgagactaaaccaacatgaagaaaatgacaagacaaagaaaggaatttctcttaaagcctcatcttctattcaagaagaaagtgacaaagaggactcgaatgaaatagaagaagatgatgatttcagtttcttcataaagagattcaataagtttctaaggaataaaggaaatcaaagaagaacaaacttcaattcaaagaaaagaggagaagattcatcttctactccaaagtgctatgaat

SEQ ID NO: 9951 - DNA, 297 bp, Glycine max
  Peptide Sequence Number=SeqID_101636
ggtaatagacgcactgccgccacctccagagcccctcagctcatctacataggctggagcattgcctacaacccgtggctgaacagcaggcgaccaagtccaaagccaaaggtagcaagataccttggatacgcatatgatcacaaaaagctcaaaagtcaagatcacttcatgataacaaagatgatgacattcaagaatgagttcaagattgagtcaagaacacttcaaggatcaagaggaaatttgatttcaagaatcaagaatcaagattcaatattcaagattcaagaataa

SEQ ID NO: 9952 - DNA, 87 bp, Glycine max
  Peptide Sequence Number=SeqID_101637
atggagaaaaatgaagaaacaacaatggaagagaagtggaaggaaaaggagaagaggataggggaggcgccatccactagggaataa

SEQ ID NO: 9953 - DNA, 363 bp, Glycine max
  Peptide Sequence Number=SeqID_101638
actccagtggtcgtggagccaaggaagagcttgccctcttactccaggtttgctagactgaggcctgatcctcaggagcttgtagcccgactgtgtatccctgggaggcgatttgtacttaatgccgaaggtctatcgtggaagctctcgaggaaagatcttaccactctggcccaaacctggagtgttctatcttattctaacttggccccgacatcccatgcttctgatcttaatctagatagggccaggttagcttacggacttgtaatgaagatgaacatgaacttaggatcacttatttccagtcagatttcactcattgctcagtccaactcctcgcagcttgatttccatccctga

SEQ ID NO: 9954 - DNA, 246 bp, Glycine max
  Peptide Sequence Number=SeqID_101639
atgggtgctcaacccattgatgaagaaggatacttaccagttggagaagatttttctcttcttcaaaggattttaggcaggttcaatggtcttcaaacctttgttggtgaaaggtttgatgctttggagttacaagtggacatgcgattcgatgagatggattcaaggatcaccaaggttgaaggagatgtctcttacatccgcacatgctttgatctaccaccaccaccaccaccatcatcttag

SEQ ID NO: 9955 - DNA, 249 bp, Glycine max
  Peptide Sequence Number=SeqID_101640
atgagtgaaatagaggaggtgcaagagcagatgaaggccgacatggaggccatgaaagaccaaatggccacaatgatggaagccatgatgagtatgaaaaaaatgatggaggtcaatgcggctacactcattactgtaagtatcgccactaaggaggacccgattcacccatctggcctcaatcaatttcacatgcgtctcaaagctttaattcaagacaaagaaattaaagatattcaagatggatga

SEQ ID NO: 9956 - DNA, 879 bp, Glycine max
  Peptide Sequence Number=SeqID_101641
atggccaagttcgatccagaaatagtcctcgaattttatgccaatgcttggccaacagaggagggcgtgcgtgacatgaggtcctgggtaaggggtcagtggatcccgtttgatgccgacgctatcggccagctcctgggatatccgttggtgttggaagagggccaggaatgcgagtatggccagaggaggaaccggtctgatgggttcgatgaggaggccatcgcccagttactatgtataccggggcaggattttgcccggactgctgcagggaggcgagtgcgaatcatgcgcaccaacatgatcaccctgactcagatatggatgacgttgctcctcagcaacatcctgcccaccgatcataattccgacctccccatgccgaagtgtcagctggtgtatggcaccttaccaggccaccctctggacccagataagtccaacagggcccctgggatttcctgccttgatcacaggactctgccagtcgttcggcgtcccccgtcacacctagcaaggcccgcggacgcgccgccacctcatcaggctggtccggccggatcatttaacacagagcagtatttgcggcatttggttcaccagcaggcggccaaccaccgggcacatgtacagactcatgattgtctttatcagttgagtctcagcctgcagagccagggctttacttctttttcgtgccctactccggaccagctcagggcagaggtcgcatggcctggagattggcctgaggcccaggcaggagaggcaccagcaggggcatcagcagaggctcccgacgaggcagatgaggcccgcgaggatgaagagatgaccgatttacttgatttcttaggagggagcggggccacatga

SEQ ID NO: 9957 - DNA, 340 bp, Glycine max
  Peptide Sequence Number=SeqID_101642
atggtgcctactaggcaccctctggaccaagatcagtccaacagggctctagggtttctggcactgatcacgggcctctgccagtccttcggagttcccggtgatgcacatcaggccgcagatgcaccgccaccacctcagctggtcgatcccgtagggcggccaaccccagagcaggggcagggttccgtcccttttgcatgccctactccagagcagtttggggccaaggttgcatggcctggagacttgcccgagccccaggcaggggaggagcctgctggatcccccagcgagcaagatgagtcccatatggatgaagatatgactgacttgctcg

SEQ ID NO: 9958 - DNA, 408 bp, Glycine max
  Peptide Sequence Number=SeqID_101643
atgtacaatttagagcataaaaaggacactaaaattgaagcaaaaagcacacaatggtggcctagggtcagcaaaaaccagaatctcgtgagtgcttgcgtccttaaatgttttgatgataacaaagatgatgacaaaggtgatgacaaaaagctcaaaggtcaatcaaagaatgagttcaagatgttcaagatagaatcaagaacacttcaagactcaagaggaaagttgaagaacacttcaagattcaagaggaaagttaaattcaagaatcaagaatcaagattcaaggatcaagctttcaagactcaagattcaagaatcaagagaagacttaatcaagataagtatgaaaaggtttttctaaaagtcataactcttccaaatggttctcttgaccagacatga

SEQ ID NO: 9959 - DNA, 1215 bp, Glycine max
  Peptide Sequence Number=SeqID_101644
atgtcttccaggaaaagaaagagtggtggttcaaggcccaccactcaatatgatacaagaagattccactcttttgaggcttggaccagatatactgacaatgtgttgggaaaacacatattagctgagaggaaagtggaaatttatcacacagagttggatgaattcaagggcgagctggagaggcgtaactttcacaagcgcctcaccaacttagctgatagtagcattgacctcgcgttggtgaaggagttctacgccaacctttacaatcctaaggggccttcacctaaacaagtcagaattcggggccacttaataaggattgatgcagacaacctcaatgcctttctagaaacacctgtggtgcttgctgagggtgaatctttccccgtctactcaagatactgtaggatgcctactgacactagagaaattgaggcagcactgtgcatacccgaccgaggtgttctatcctactgcaacctggcttcgacctctcacatatcagatctgactgtggatcaggctaggttaatctttggtctagttactcagctagacatgaatgtcagagccctcatttcagggcagattacttctatggcccagtctaactcctcaagacttggatttcctgctcttagcacagctttatgcaggaccagaggagttgcctccgacaatcttgtctttgaacgactaagcccattcattaatttggcatacataaggaagaattgttggaaccctgatgatccaacaattattattaggggggccagaagaccaagggcaaggccagttgagactccttctacatcagcagctcctcctccagctcgtattgcagcagctccttctaccccacctcctctggtagcacctcctgactccatccctatagtagaacaatttaatgaatgggtagcctggccatggactcaacctcctcttcacagggacgacgaggatcccgccgctcaggtaccacatcagccatcggatgagtcatcagagtcttccacccctgagcccttgatcaggaagaggagggaagctgcaaccactcctgaaaagtcccctgaggccactccaaagcctctgggaccaatggtagataccacttctccacagcaagcagtagatacttcaacgcctgaagttcaaaccaccccagtcctgtctccgaacacctctcttgtagctactcct

SEQ ID NO: 9960 - DNA, 591 bp, Glycine max
  Peptide Sequence Number=SeqID_101645
atggggacaaatcaaaacggcaaaaggttttatcaagtcaaggttaaaggtctagatgtcactagcctcaaggaattgggacgattgatgggacctctccaaaggcaagccttccgcaaagtgtacgggaagattctagagttgaccgcagcggaagtatttacggaagctgtcgtatccctcgcccaatactatgaccagccgttgaggtgtttcacgtttggggacttccaaatggtaccaactattgaagagtttgaggaaatattaggatgccctcttgaagggagaaagccgtatcttttctccggctttcttccttccttgagcaagattgcagttgtggttggagattcagcaaaagagttggatcgcatgaagcaaactcagaacggcgtagtgggcctgcctcggaagtacttggaagacaaggcaaggaatatggcaagccaagaaaagtggggcccgtttgcagatattttagctttgctgatttttggggttgtcctctttccgaacgttgacggtttggtagacttagccaccattgatgctttcctcgcatatcaccatagcaaggaaagtccagtg

SEQ ID NO: 9961 - DNA, 264 bp, Glycine max
  Peptide Sequence Number=SeqID_101646
atgcggaaattgattaaggaaaggatggaaaataaggtggttaattttgtgggtcttaataaggtggttcttggcataaaatggatgaatgggatgaaatatagaaatggaaataaattaagctacagggctccaaatgaggtgattccaaaacgaagtgaaagaacaaggatgaagatgaaaggaaggaaagaatcactctttccggcgagggcaacacacaaaggttgtgaaagtcctttgatacagccagggtgttcttaa

SEQ ID NO: 9962 - DNA, 339 bp, Glycine max
  Peptide Sequence Number=SeqID_101647
atggattccaactcccaacaatttagtgccaaaaatgatgttattgtcattagaggagtgcatgaagtagccacgaattcatcttcatcagctgagactaagaagcttgaagcacctgtcgccagactctgtggtttatgctcctctactgactaccacacagacctttgcccttctgtgcaacaatctgaagcaattgaacagcctgaagcttatgctgcaaacatctacaatagacctcctcaacctcagcagcaaaatcagccacaacagaacaattatgacctctccagcaacaggtacaatcccgggtggaggaatcatcccaaccttaagtga

SEQ ID NO: 9963 - DNA, 627 bp, Glycine max
  Peptide Sequence Number=SeqID_101648
gaaagatcaagaacttaggggcattcgtaatggcatcattggtgggtaccatgaatggctgaaagttcatatacgaggtttggattggctcgccaagttaaaagtcgtcagcgaagagagttttgaagcaccggaagaggatgaagaagtccaagctcttaaaagcgagttaggaaaggcgaaacttgccaaagagaagttcaagttggccgctacacacatccggaaggagtgtgccggattacgggaagagaatgcaaccaccgcacgagcccttgaacaagagaccaagagggctcgcaaggaagagtccaaaagaagcttgtctcagcgtttatgcgagacggagaccaacatgctagctatcatcgccaagtaccaagaagagttaggtctagccatggcccacgagcataggatcgcggacgagtatgcccaagtatacgcggaaaaagaggctagaggaagggtgatcgactctttacaccaagaggcaaccatgtggatggatcggtttgctcttaccttgaacgggagtcaagaacttccccgcttgttagccaaggccaaaggcgatggcggacacctactccgcccccgaagagattcatgggcttctcggctatt

SEQ ID NO: 9964 - DNA, 1479 bp, Glycine max
  Peptide Sequence Number=SeqID_101649
agtctagatgtcaccagccttaaggagttgggacggttgatgggacccctccaaaggcaagccttccgcaaagtgtacggaaagatcttggatttgaccgcagtggaggtatttacggaagctgttgtatccctcgcccaatactatgaccagccgttgagatgcttcacgtttggggacttccaaatggtaccgactgttgaagagtttgaggagatattaggatgccctcttgggggaagaaaaccgtaccttttctctgggtttcttccctccttgagtaagactgcagctgtgtgggtcccgtttgcggatatactagctttgctgatctttggggttgtcctctttctgaacgtggacggtttggtggacctagccgcaattgatgctttccttgcatatcaccatagcaaggagaatccagtggtggctatcttggcggacttatttgatacctttgaccgaagagtcgattgggaccaacacttggctgggataggagacaacacaattaattggtttcctcgatggaaggaaggaaaggagggagttctcttctcatgtggggactaccctaatgttccattggtagggacgaggggttgtattaactataatcccgcacttgccataagacatcttgggtaccccatgaggggagcaccaacggaagagagcctctcgcctttccttgtgagagatttcagcgcgcaaagcctcaaggttatacaaagagtccacaaggcatggagaagtccgttgaggaaagacaaagagcttagaggcatccgtaatggcgtcatcggtggttatcatggatggctaagagttcatacgcgagggttagattcgctctccaagttgaaagttatcaatgaggagaacttcgaagctccggaggaagatgaagaagtccaagctttaaaattagagctagggaaggcaagactcaccaaagaaaagttcaagtcagccgttacaaacatccggaaagagtgcaccgagtcacgagaggaaaacgcggctactgcaagagcctttgaacaagaaaccaaaagggcccgcaaggaggaacatggccgagataaattccgaggagctttgtggggcagcaacaatgagctcaagcttcagagagaggaaagggaccagtcacgggtgcatggcatgatcttaaaggaagagttagctgcctgctcgagatccaaaaggagtttggctcaacacttggaagccatggagcaaagcatgctagctatcatagggcagtacaaggaagagttaaaccaatctgtgacccatgaacaaaagcaagtagaggatttcgcacaattgtacaccgaaaaagaagcaagagggagggtgattgatgcattgcatcaagaagcgactatgtggatggataggtttgccttgaccttgaatggaagtcaagacctcccacgactactagccaaagcaaaggccatcgctgaa

SEQ ID NO: 9965 - DNA, 312 bp, Glycine max
  Peptide Sequence Number=SeqID_101650
atggcaaggtttttgattggtcttaatagggagattcaaggcatggtagagttacaccactatgcctctttggaggatctcattcatcaacctatcaaggtggagcaacaattaaagaggaagcaaatatacaagaaaaaggctataaatagagggcttttggtgcattttttcaaccttgatcatttgagaaattatagttcaaatttcagacctcatttgagacataaatttcgtgccccttctcttcctctccctccactcatcttttcccaccttcaagctcttacccatggctttttatggtggtga

SEQ ID NO: 9966 - DNA, 615 bp, Glycine max
  Peptide Sequence Number=SeqID_101651
atggctcctagttccacattccaattctcaattctcttgtgtcttctcttagtttcatttctgggtgttgaaggggtacttcccccatcatgcaatcgctatgagtgccccacctataatatcaaatatgtaggcaaaaactttgaaatccgtcgttacaattcacctgtgtggatttcaaatctggctgttcaagacccttctttggttggagctacaagatctggcttcaaaagactatttagttatatttatggtaacaacaactataagaaggaaatgaacatgacaacgcctgtgatcagtgaagtatcaattaatggtggaaattcctcaattgttgtgagcttctatgtgccgaaagtgaaccaagcagacccacctttggcaaatggtctctatgttcagagatggaaaactatagatgtagcagtaagacaatttggtggatttgtcaaagattctaatattgggttgcaagtgtcggccttgaacgatagtcttaccggcactacatggtccgctattgttaagaataagtacattgtggcacagtacaattccccttttgaattgtacaatagagtgaatgagatatggtttttttatgaatga

SEQ ID NO: 9967 - DNA, 177 bp, Glycine max
  Peptide Sequence Number=SeqID_101652
atgggtttgggtcagaacgacgacggcgtggcaagcttggtagagttcaaggagaaccacgaaaggttcgggctaggatataagcctacacgtgccaatgtgaggagaagtgccttagaaagaagggcggaagctttgttagcgcagcctagatatgtgaagggtgggtcaccatga

SEQ ID NO: 9968 - DNA, 237 bp, Glycine max
  Peptide Sequence Number=SeqID_101653
atgctgctgaagggcttgctcagcgagccagattggctaagcgagactaatctgcatagcaaggaagccagctcgctcaacaagagaaaaacccaagagaatgtaaattcagagagcaacgtgctaagcacgcaaccagcccgcccagcgaagcctttgtcgcttctcgcgcttagcgtgtcaaagctcgctaagagcctaatcactaactctcactcagcgagacatgctggctga

SEQ ID NO: 9969 - DNA, 384 bp, Glycine max
  Peptide Sequence Number=SeqID_101654
atggaaccaattgcatcccttgcccagtattatgaccagcccctaaggtgcttcacatttgaggacttccagctagtgccgactgtggaagagtttgaagaaatcctgggatgcccattgggaggaaggaagccatatcttttctctaggttctatccttccacgacaagagttgccaaggatgttacagtaggcccgtctatccgctacaaggtcaccactcgtgcgtcgaaaaaggaaaaggcgaattgggaccaactcttggctagcatggaggggcgtctgttaatttgttccctcgctagaaggaaggaagaatcaggattctatcttcatgcgaaggatgtccaaatgttccctagatggaacaatgggttgtattaa

SEQ ID NO: 9970 - DNA, 279 bp, Glycine max
  Peptide Sequence Number=SeqID_101655
atggggatgtctcctccacctctagaacctcaaaatcactcacagactcatctcatgctctcaagatggcttccttttcacgctcacgcaactctggctcgcttagcacacattagtgaatttcggcttagcgcgcgtcttctcgctcagcagatggactcaagcggtgcgcttagcgggatgatccctcactcagcgaacatgcacaactcatccttcttccagattcttcctcgtgctcagctaaaggagtggtgcgctcagcggatggctcactaa

SEQ ID NO: 9971 - DNA, 333 bp, Glycine max
  Peptide Sequence Number=SeqID_101656
atgaagcccccttatgtccaggaatatcatatctttctaaaggcttttcctcattctctggagggagaggcaaaagatttgctatactaccttgctcctaggtccattttcagctgggatgaccttaagagggtgttcttggagaaattcttccttgcatctaggaccattgccatcagaaaagacatttcaggcaacttagtagagagagcttgtatgagtactgggaaagattcaagaaattgtgtgcaagctgccctcaccaccagatttctgagcaactccttctgcattatttctctaagggacttagaaacatggagaggagtatga

SEQ ID NO: 9972 - DNA, 403 bp, Glycine max
  Peptide Sequence Number=SeqID_101657
ggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgccccattaaagcgtacgagaggaccgggaaggacgcacctctggtgtgcccagttatcgtgcccacggtaaacgctggggtagccaaagcctccggtagcacagccgagacagcgatgggttctctgccccagcggggatggagcgaaagaagttttgagaattcaagagaag

SEQ ID NO: 9973 - DNA, 225 bp, Glycine max
  Peptide Sequence Number=SeqID_101658
atgaggctactatttcaccttccactagtgaaagtgagaagcataagggaagaatctagtgaagaatctacccccttttgtgatcaaggggttcccatgaaccctcagagaataaaggtcattcctgagtggcccactccaccaagtgttgagggaaggagcccagagtatgaagaacctcgggatttgaggtcaaatcctttccaaggtggagggaacgcttga

SEQ ID NO: 9974 - DNA, 438 bp, Glycine max
  Peptide Sequence Number=SeqID_101659
atggcggttccaaagtcagaaaagatgcaaagacaagatgaaactaacaagaaacaagcggttcctctcgatgtggagaacaacgatggtttgtggtggctaatggtggttgtggctacacgaaaaaggctgaaatgcttaactaagagatgctctcgggaacggaagcttctagacactccagacatcttctcaaagatcccaacggcttcctccagaagcttcattaagaggcttctaacacactccaaacctcttctcaaagatcccaacggtcagattatggacaagtatcttgtgaagttgaagaacaaatttctagaagatccaacggttaacaaaggctgggcagggtttttaccgaggctgcttcatgtagctttctctagaagtttcattaagaggcttcctccagaagcttcctcgtggcttctttga

SEQ ID NO: 9975 - DNA, 198 bp, Glycine max
  Peptide Sequence Number=SeqID_101660
atgttgtggaagcttgggaggattgatggggactcggtgttgagaggaacgaggataagggctacgtgggagtacgtgagctcagttggaggtgggcaacaggggatggtgggtttagtggtacctggagatatgtcgcgggggtcaggagaccttggggacgttaggtggggtgttattgtccaaaaccaagcttga

SEQ ID NO: 9976 - DNA, 192 bp, Glycine max
  Peptide Sequence Number=SeqID_101661
atgatggaagcaatgatgagcatgaggaagatggtggaggttaacactgctacagttgtttctgtgagtacttctactgagatggactcgattcacccgtccgatttcaatcaagtggttcgtccaacctcgaatgtagtaggtcaacgaggtgaggcagcggaaaatgcatgcgggcctcattatgttcag

SEQ ID NO: 9977 - DNA, 861 bp, Glycine max
  Peptide Sequence Number=SeqID_101662
atgttagctatcatcgccaagtaccaagaagagttgggtctagccacggcccacgagcatagaatcacggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattgggaaaacaccataactaaacgcgccgcaagggatccctatcgcaccagatccaaatctagaacgatgggtgatcaagaggagacacaggaacagatgaaagccgacatgtcggctctgaaagaacaaatggcctccatgatggaggccatgttaggtatgaagcagctcatggagaagaacgcggccaccgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccatcaaagaccctcaagattatgctcgaagggatgtcgagttctatcccccgatccccgaagggccggcaccaggcacgttgcctcaacccaacattgcagcattgccaatagttttgtccatggaagggccgcccccggcaactga

SEQ ID NO: 9978 - DNA, 222 bp, Glycine max
  Peptide Sequence Number=SeqID_101663
atgactgagaaaactggggcaaatgaagagggtgagaaagagggagaaacccatgctgtgactgccattcctatacggccaagtttcccaccaaacccaacaatccataaccctagccaaggttcatcaacctccatttctccgagaatgcgactcgaaacgcaacgtgtgcttgtcacggagaagccccggggcgttccattgagcattgtagggctctga

SEQ ID NO: 9979 - DNA, 360 bp, Glycine max
  Peptide Sequence Number=SeqID_101664
atgctaagcttgtgcattcaatatcctaatgaggatgttccatatgttctcaagactggactaatacatttgctgcccaagtttagtggtcttgcaggtgaagatcctcataagcatcttaaggagttccatattttctgttccaccatgaaaccccctgatgtccaggaagatcatatctttctaaagggttttcctcattctctagagggagtggcgaaagattggttgtactaccttgctcccagatttttcaggagaatgatagagcttatccagcgcaagttgttgcagcccagatacgtacactgctatataaacatgaaggctgcacgggtttttaatcaagtcagagattga

SEQ ID NO: 9980 - DNA, 417 bp, Glycine max
  Peptide Sequence Number=SeqID_101665
atgaatcaaaaatctgcacctgatgccagactctgtggtttatgctcctctgccgaccaccacacagacctttgcccttctgtgcaacaatctgaaacaattgaacagcctgaagcttatgctgcaaacatctacaacagacctcctcaacctcagcagcaaaaacaaccacaacagaacaattatgacctctccagcaacagaccatacgtccctccaccaatccagctgcaacaacagcaacagccccagaaacagcaaacagttgaggcccctccgcaaccttcccttgaagaacttgtgaggcaaatgactatgcaaaacatgcagtttcaacaagagaccagagcctccattcagagcttaaccaatcagatgggacaattggctacacagttaaatcaacaacagtcctag

SEQ ID NO: 9981 - DNA, 165 bp, Glycine max
  Peptide Sequence Number=SeqID_101666
atgacgaggataagggctatgtatgagtacgtgagctcagttgaagagtggtacttggagatatgtcgcgggggtcaggagaccttggggacgtcaggtggggtgctattgcccaaaaccaagcttgaccaatcccgacccaacccgggcatagtcagtcagtga

SEQ ID NO: 9982 - DNA, 558 bp, Glycine max
  Peptide Sequence Number=SeqID_101667
atggcctcgaggaagctttcctcaaagagatctaggaaggacgccgtggccgcaggggctagtgccgctcccgagttcgatagccatcatttcaggagcgttgagcaccagcagcgtttcgaagccatcaagggatggtccttccaccgagagagatgcgtccagctcagggacgacgagtacacggatttccaggaggagatagctcgccagcattggacgtcgctggtcactcccatggccaagtttgatccagatatagttctcgagttttacgccaatgcttggcctacagaggagggcgtacgggacctccggtcatgggtgaggggccagtggattcctttcgatgcagatgcccttagtcagttcctgggatatccgctagtattggaggagggccaggagtgcgaatatggtcagagaaggaaccaggccgatggatttgatgaggatgtctttgctcagctcctattcataccaggtcaggattttgcccagaccgctgccgggagacgggtgcggatcatgcgcaccaacatgactaccttgacctag

SEQ ID NO: 9983 - DNA, 408 bp, Glycine max
  Peptide Sequence Number=SeqID_101668
atgagtacctctaaagacaagggcaaaagaaaaagaattgaggagcccaagaatgaagctgctaagggtccaacacaaaagaaacaaaatcaaggtgacaactatttctttcgcagtaagcctgaacatgtaaagaagaaatgtaccaaatatcatgctatgtttcttactttggtctgttctgaggccaatttagcttcagtacctagaaacacttggtggttagattctggtgccacaactaacattagtgtttcaataaagggttgccccagaaaccaattgattctgaaagatggatctttgttggagatgcttcctatggtgaatcctttaatgcagaattgcgtggtactaagcgtagaattgatattacaaactcaggagcattatgacataagtgcttag

SEQ ID NO: 9984 - DNA, 519 bp, Glycine max
  Peptide Sequence Number=SeqID_101669
atgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttaggaagtacgggcggcccccatgatgtgcaaattcaaaacgagcacgccttcccgtcatatggcttgcctctcaactatacgccacccaatgtggcgtacactcccaataagaatgtcaataactccactcctatacccattgaaagccagcaaccccaaactgatcatgcacataggaaaggctcaggggccattgaaggaggtgaagattatgcctttgctaacctagaagagttgttcctaatacccaaacatggtcattcccaagttcaaggtgccggactttggcaagtacaaggggactactcgctccaaggaccatctaaagatgtactgtcggaagatgggggcatacgcaaaagatga

SEQ ID NO: 9985 - DNA, 120 bp, Glycine max
  Peptide Sequence Number=SeqID_101670
atggtagaggcctctggtaatcgattaccagcctgtgtaatcgattacacagaggaatgggtcactggtaatcgattaccagatcgtgatggcggcgcagctaaatccatgatcgagtag

SEQ ID NO: 9986 - DNA, 282 bp, Glycine max
  Peptide Sequence Number=SeqID_101671
atggttgatgtcatgtggtctctgtatgagacacataagcatgttagacttctcgaagaccaagcatactactactctggctacatcatttgtgggactaacatgtggccttattttttcgcagagggttttgaggatgggtttgagatgtttgcagcctctgtgcaaagattgttggacctgaaagttgtagcagaggacactgatagtcatgaagtcatacaacatgctttactagtggcacaagaagacttagcaactagatgcaactttgaaggatag

SEQ ID NO: 9987 - DNA, 981 bp, Glycine max
  Peptide Sequence Number=SeqID_101672
atggacttaacagaaggatgtagaagtggaaataatagccaaaccttgaccattgccaaggaaagcatgctcatagctcgaggtggcttgatcgtgagcgctcttgaaggagaattctttgtcagagcaaatcttgttgaggacgttccggtacttcttcttcagccttcggatcttctccacgagctgattcttactgaaatcgagttggagtttcgacatgatttggttgtagaacaaagcgccgctgaaacagccgccgcgagtcatccaacggcgacggcggcggctttttctccgcgagtcatcgtgctcgacttgcattttgtcgaacttcactatctctgctgcaccacctcagcgccgctcaaggacgccaagcttcagatcccaagcttccattgcttcagctctgcttccgcctctgctctcgcgcgcaatgccttttaccttccttcttccacgcgctatttctccctcatatttggattgttcgattccatggatgatcttgctgatcagtttgggattgggatgcttcgcttgaccaccaggcagacgtttcagctccatggtgttctcaagaaggaccttaaaatggtgatggctaccaacaaaggagtattcaactcatcagcagattctggagaagcaaatgaactttgtgtcactgctccttctggaacagattttgtggttgtggatgcaaagaagagagggcatgctaaacttggtcagaagcagcctgtgcatagaaaatctattgacacatttgggcaaagaacgtcgcagtatagaggtgtcacaaggcatagatggactggtaggtatgaagcgcatttgtgggataatagttgcaagaaggaagggcagactaggaaaggaagacaagtggagcaccttgtgcactgctctgtggttgagaactttgactgtgttgctgattttgctgagaattattgttctgaggctgagagttag

SEQ ID NO: 9988 - DNA, 816 bp, Glycine max
  Peptide Sequence Number=SeqID_101673
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcggggcatgatcttctgagatcgttttggtctgcgcgtaatctctgctctgaaaacgaaaaaaccgccttgcagggcggtttttcgaagttctctgagctacaactcttgaaccgaggtaactggcttggaggagcgcagtcaccaaaacttgtcctttcagtttag

SEQ ID NO: 9989 - DNA, 189 bp, Glycine max
  Peptide Sequence Number=SeqID_101674
atgtcgcgggggtcaggagaccttggggacgtcaggcgagctcctggcagtcaacagataaaggaacaaagaccacaaagcaaggaagcttgtgtggtggctagccagctgcttgaaaacgaggtctggaagctaggaaggcttctggtaatcgattaccaagggagtgtaatcgattaccaggcttag

SEQ ID NO: 9990 - DNA, 291 bp, Glycine max
  Peptide Sequence Number=SeqID_101675
atggatgaccaagaggaagtacaggaactaatgaaagccgacatgtcggctttgaaagagcaaatggcttccatgatggatgccatgctaggaatgaggcaactaatggagaataacgcggccaccgctgccgctgttagttcggctgccgaagcagacccaactctcccaactaccacgcaccatcctatcccaaacgtggtaggacgagaaaggagcacactggggcacatcagcaacccccatcggggatacaaccgagtggcttacccctatggattaccaccctaa

SEQ ID NO: 9991 - DNA, 120 bp, Glycine max
  Peptide Sequence Number=SeqID_101676
atggaagaagaaatctctcttcaagagaagaatattacaatggagatcatattttctgaaaactttccactggtaatcgattacaatgtttgtgtaatcgattacacagttataacttga

SEQ ID NO: 9992 - DNA, 183 bp, Glycine max
  Peptide Sequence Number=SeqID_101677
atggagcttttccacagaaaccgtggcagcacttttcccagcacgcgttctgtttgcctattaatggaggatgctatttttacactatggacatggctaaagaactttgagaaggactttgccttcacctacagctattggtcgtctaacatagcattaggatttgtcttttcaggggggtag

SEQ ID NO: 9993 - DNA, 264 bp, Glycine max
  Peptide Sequence Number=SeqID_101678
atggatatctgtgaagatactgacattcctgtaatattgggaagaccattcatgttaactgcaagttgcatagttgacatgggtagaaagaagttggagatgggttttgaggatcaaaaaattgattttgatttgtttgttgaagacaagcctgctctagaacaaaatgtttgcttacaggtaatggaggtgggtcaagaggttctggagaacctgctttataatctatacattggagtatttcagcttacccttgattgttag

SEQ ID NO: 9994 - DNA, 375 bp, Glycine max
  Peptide Sequence Number=SeqID_101679
atggctgaagagcaacctcgacgagtgaccttggaagattactcaaagcctatacaactgaacatcttcattgatgggttacggccgcagtcaaagcagttactcgacgcttctgcaggaggaaaaattaagttgaagacacctgaagaagccatggacttaattgaaaatatagctgtcagtgaccatgcaattttacatgatagagttcacattcctaccaagaagagtttattagagctttcatcacaagatgccttgttggcccaaaataagttgttgtccaagcaatttgaagctttaactgaaacactaagttacaggttgcccactttgtggtggagctcatgggtcaggcttgtgtattctcattga

SEQ ID NO: 9995 - DNA, 300 bp, Glycine max
  Peptide Sequence Number=SeqID_101680
atggaggacaatcattgtgctttctatgttaaaactgttgtgaatccatctgggcaagaacatgttggtcatatcctgctaactatgaggttgtatgtgcaatgtgaaaattgtacacacttggtggtgttgggagaagtatatgaggaggggggggggtctacgatacacaatgtggcttatgcaaatgatgtggtaagggtcagtgttgaaaaagttatggacgatgaagctcaagtctcgtttccgacttcagaaatccagtatgtcaggcaggtccttcacacattcattgcatga

SEQ ID NO: 9996 - DNA, 268 bp, Glycine max
  Peptide Sequence Number=SeqID_101681
ggccatgcttatgtgttccctaaaaaaaaagtacaggttagctcgcctgggcgagctgagctcgcttgggcgagcaacccttgtacgaaaatggtgtcgcaacatgcccttttgcgggcgagcgaggcgaggctcacgggtgcgctttccaagggaggaaagatgcgcggagtcgccaccaacgaaggtattagcacctctcacgtcgacaaaagcggggctcttgctcctacgtaccctctatcgaagaggaaatcagacctacgta

SEQ ID NO: 9997 - DNA, 366 bp, Glycine max
  Peptide Sequence Number=SeqID_101682
atgtaccctctgttgttctcagtcaaacccaaggaaaaggaagaatcaaaagaattctcagactatgtcgttttgaattctttgacaacggagaagggagacacaaaagaattcaggcgattagtcctttgttcttttggaaaagggagaagagagacacaaaaagaattcaggcggttagtccttggcgaattctttttggcaaagggagaagggaatgaaaagatgaatagcacaagttttcaaggtttagaaaaccagaaaacttcagaaagcttttggtacaaagaagaagaagaagaagttcaaagagatacaagacttgtaaaggattgtaagaataagtgttcaagattgaatgaatga

SEQ ID NO: 9998 - DNA, 298 bp, Glycine max
  Peptide Sequence Number=SeqID_101683
atgctgtggaactttacggattacgtaatcatcccttttttgccttctggaacgttacggaactttacggattgcacactaacacttccttttaatttctggcatgtcacggaacttcacggattgtgctatgacgcttttcttttagcttccggcatgtctcgtaacttcacaaattgcctaacgatgggtgccaaatacctcgaagtggtcgagcgagggtcgcatcccaacaacggatggtccccggacgaaattagggaatctggtaatcgattaccagagagtaaaaactctg

SEQ ID NO: 9999 - DNA, 669 bp, Glycine max
  Peptide Sequence Number=SeqID_101684
atggagagaagtatgattgatgctgccagtggtggagcccttggagacatgacccctgctgaagccaggaatataattgagaagatggcttccaactcccaacaatttagtaccaaaaatgatgctattgtcattcaaggaatgcatgaaaaatctgtacctctcgcaagagtctgtggtttatgctcttctgtcgaccatcgtacagaccttttcccttctatgcaacaaccaggagcaattgagcagcctgaagcttatgctgcaaacaattacaatagacctcttcaacctcaacagcaaaatcaaccacagcagaataattatgacctctccagcaatagatacaatcccggatggaggaatcatcccaaccttagatggtcgagtccttcacaacagcagcaacaacaacaacagccttattttcataatgctgctggcccaagcagaccatacattcctccaccaatccagcaacaacaacaacaacaacaaccccagaaacaacaaacagttgaggcccctccgcaaccttcccttgaagaacttgtgaggaaaatgactatgcaaaacatgcagtttcaacaagagaccagagcctccattcaaagcttaactaatcagatgggacaattggctacacagttaaatcaacaacagtcctag

SEQ ID NO: 10000 - DNA, 267 bp, Glycine max
  Peptide Sequence Number=SeqID_101685
atgtacatgatcagtttggggttgttagctctcaatgagtatggaagtggacttattgacattctcattgggagtggaccgcccatacttcccaaatctttgcctaccatagctaaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaag

SEQ ID NO: 10001 - DNA, 207 bp, Glycine max
  Peptide Sequence Number=SeqID_101686
atgatattgcacgagattagaaggtctaactctctaaaaatagtccccagtggcgtcgccaactgtcacaacctacccttcggcgggagggcgacccggggctcgtgggtgcgtattccaagaaaggaaaatgcgcggagtcgccaccaacatttattcgaggaaaacgtcggaaaaaccggaaaaggtgtggtctacgaactttaa

SEQ ID NO: 10002 - DNA, 273 bp, Glycine max
  Peptide Sequence Number=SeqID_101687
atggtcattgaccaatcccttttccatgacttaacccaattatccagtgacggtgtaccatttgaaggtacactgaatgacaaccggaaatttgatttctctgcacatgatgcccgccagttggtttgcaccaaccatgcggatatgaccggacgccttcttgccggttcattggcttttgaaagccgcatccttcattatctaattgtgcgtattctgcttccacgatcttccaaccttgcccagggcgtcaacttgactgggcacacttag

SEQ ID NO: 10003 - DNA, 144 bp, Glycine max
  Peptide Sequence Number=SeqID_101688
atggttaaagcacgtcaaaaggggggcaaaagagggaggtggttgccacccagctcgcttccaccagaaggcaccgccttctgttggaaccccctggaaggcccaagtgggcctggttgctatttgcacacccctttttactaa

SEQ ID NO: 10004 - DNA, 138 bp, Glycine max
  Peptide Sequence Number=SeqID_101689
atgtctaccttcatgatgaaaaatgtgggagaccaactgttaattaggcaagctttgaaaagtgttgtttttcaccttctcgctaagccaatctgttggcttagcgagcatccgctaagcgcatcaataatggactaa

SEQ ID NO: 10005 - DNA, 789 bp, Glycine max
  Peptide Sequence Number=SeqID_101690
atgggatcaagtcaaaagccttcacttaaaaagaggttttatccaatcaaggtcaagagcctagggatcaccagtttaagagagttagggcgattgatgggtcagctccagcagcaagccttccgcaaagcctatggtaagatttgggacctagctagggtagaagtctccatagaaccgattgcatccctttcccagtattatgaccagcccctaaagtgcttcacttttggggacttccaactatcacccatggtggaagaattcgaagaaatcctaggatgtcctctagggggaaggaaacaatacctcttctcagggggagtcctctttccaaatgtggatgggttggtggacctggaagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctgtttcacacctttttctccaagaaggtaggcccgtctatccgctacaagaaggaaggaagaatcaagattctatcttcatgcgaaggatgtccaaatgttcccttgatgggaacaaggggttgtattaattataatcccgttctcgccataagacagcttggctaccccatgagaggagcgccattagacgaaagcatcacgcctttcaccgcacggggttttagtgaccacaacgcgagggtactccaaggagttcgcaaggcatgggatgcggcgtga

SEQ ID NO: 10006 - DNA, 209 bp, Glycine max
  Peptide Sequence Number=SeqID_101691
atggcaatatttgctgacatggtggagaagtgcattgaagtgtttatggatgaattctctgttttcggctcatcttttgattgttgtctagcaaatctagaggtgattgaagtagacaaagctaagattgatgtgattgacaagctacatcccccagtgaatgtcaagggagtaagaagctttttagttttggctaggttctacaagcg

SEQ ID NO: 10007 - DNA, 274 bp, Glycine max
  Peptide Sequence Number=SeqID_101692
gatcagtcgcactaagtggaccctatgggctcagcgcacatccaccgctaagtgcaacttcagcgcgcttagcatgacaagggaatctggaagagcacaagaatcaaggtcatgcgctaagcgcgagatcagctcgctaagaaagacgtttgtctcttaccagagctgcatacttttgcatagaattcgagatagtgctctagaggcagcagagaggcagaagctaagcaaggaagctagggttcatcactttgagagattagagagtgtttga

SEQ ID NO: 10008 - DNA, 902 bp, Glycine max
  Peptide Sequence Number=SeqID_101693
ggattcggcaagagagttggatcgtgtaaagcaaactcgaaacggcgtagtgggcctaccacggaagtacttagaaggcaaggcaaaggatatggcgaatcaagaggagtgggtcccgtttatggacgtattagcattgctaatcttttggggttgtcctctttccaaacatggactgttggtatcgcccctgattttcgccaagacataaggcatccatgtacgctccgaagccatctctcgtgtgtcgaaaagagaagagtagattgggaccaacatttggctgggataggaggcagaacaatcaactggtttcctcgatggaaggaaggaaaggagggagttctcttctcatgtggggactacccaaacatgccgttgataggaatgaggggttgcattaactacaatcccgcacttgctataagacagttagggtaccccatgaggggagcaccgacggaagaaagcctctctcctttccttgtgagagatttcggcacgcaaagtttcaagattatacaaagagtccataaggcgtgggaaagcccattaaggaaagataaagaacttaggggcattcgtaatggcatcatcggtggttatcatgaatggctggaagatgaagaagtccgagctctaaaaacagaactaggaaaagcaagacttgctaaagaaaaattcaagttggtcgctacaaacgtccagaaagagtgtgccgggttacgagaagaaaatgcagctatcgcaagagcccatgaacaagaaaccaagaaggctcgcaaggaagagcatggccgtgacaaatttcgtggagctttgtggggcagcaacagtgagctcaagcttcgaagggaagagagagaccaatcacgagcacatagcatggtcttgaaagagga

SEQ ID NO: 10009 - DNA, 177 bp, Glycine max
  Peptide Sequence Number=SeqID_101694
atgtgggttatggcctctggtaatcgattaccaaggagggatgggtcactggtaatcgattaccagatcgtgatggcggcgcagctaatccgtgatcgagtaaagatggagtgcttagagggagcttgggagaccctcgaaggcaacacgaggtgccgatttcggggcaccatttga

SEQ ID NO: 10010 - DNA, 316 bp, Glycine max
  Peptide Sequence Number=SeqID_101695
tgttgagaggaacaaggatatgggctacgtgggagtacgtgagctcagttggaggtgggcaacaggggatggtgggtttatgcgcgcattgtggatgtggaaaagcttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctgtga

SEQ ID NO: 10011 - DNA, 207 bp, Glycine max
  Peptide Sequence Number=SeqID_101696
atgggactccccaagccagatgtatgtcagccgcctccttacccaagaagccaagcccatttttggcatgagagtgagcttagctattggaggggtgcactctgttggtggatggcgcctcctctcaccttttctcctttatctttcgttgcaacttgttcgaacccagcaagtgcaccggattgcgcaagtagtataaaacggtaa

SEQ ID NO: 10012 - DNA, 135 bp, Glycine max
  Peptide Sequence Number=SeqID_101697
atgtataacatcgggggaagtggtttggtggtggagcaaaggcagaagcagcagcaacaacaactgcaaagggaagtgattcgagaaagagtttcaatgaagaaagaatcttttatattcaatgaagagagctaa

SEQ ID NO: 10013 - DNA, 210 bp, Glycine max
  Peptide Sequence Number=SeqID_101698
atgtatactggttcagccacttcccgtgcctacgcccagtcctcaagcaacccacttgagattttccactatctctgcaaatcctttacagactttgaacacaccttgggatccctcacccttgtgttcaaagattctccaagaggcaacccgtctcttgattacaattctcactatccaagagacaatcagtctcttgattacaactaa

SEQ ID NO: 10014 - DNA, 591 bp, Glycine max
  Peptide Sequence Number=SeqID_101699
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgctgatgccgctggcgattcaggttcatcatgccgttgtgatggcttccatgtcggcagaatgcttaatgaattacaacagtactgcgatgagtggcagggcggggcgtaatttttttaaggcagttattggtgcctag

SEQ ID NO: 10015 - DNA, 423 bp, Glycine max
  Peptide Sequence Number=SeqID_101700
atgaatgagaaaactggggcaaatgaagaggatgagaatgaggaaggaacccatgttgtggctgccattcctacatggccaaacttcccaccagcccaacaatgtcctcgctcagccaatatcggcccttctcattacccaccacccagtcatccacaaaggttatccctaaatcatccacaaagtttgttggccgcacatccaatgccaagtgcaaaccaaaacaccaaccaagaaatgaattttgaagcgaaaaagcctgtagaattcacccaaattctggtgtcctatgctgacttgctcctatatctactcgataattcaatggttgccataaccccagccaaggttcctcaacctccatttttccaaggatacgactcgaacgcaacatgtgcttatcatggatacaatgctaaataa

SEQ ID NO: 10016 - DNA, 228 bp, Glycine max
  Peptide Sequence Number=SeqID_101701
atgacaagtgccactggcactttttctattagttttgcatccagaaaaatcatactccatgtggagcttgtagaccttggatcttcttcatcaatggaatcctttgctttttggagatcaatcgcagcagaatgcagaaggaagaaagatgatcagagacgccacttcaaggagaagatgagtcaagaagaagctcaccaccataggaagccatggataggagcttga

SEQ ID NO: 10017 - DNA, 318 bp, Glycine max
  Peptide Sequence Number=SeqID_101702
atgttagccatcattagcaagtaccaagaagaattaaatctagtcacggcccacgagcacaaagcggcagacgagaatgcccgagtatacgcggaaaaggaggctagaggaagggtagttgactcgttacatcaagagataacaatgtggatggaccgatttgctcttactttgaacgggagtcaagaacttccccgattgctggccaaggccaaagcaatggcggacacctactccgcccccgaggagatccacagacttctcaactattgccagcatatgatagacttaatgacctatataattaggaaccgctag

SEQ ID NO: 10018 - DNA, 183 bp, Glycine max
  Peptide Sequence Number=SeqID_101703
atgccaaaagatagggggactggtcttgatttcagggattgtcatcatcaaaaagggggagattgtagacaaaggatcaagctgaatgttttgatgatgccaaaggttgacatgcgtctcaaagctttattcaagacaaagaaattaaagatattcaagatggatgatcaagacagtctctag

SEQ ID NO: 10019 - DNA, 300 bp, Glycine max
  Peptide Sequence Number=SeqID_101704
atggactcgggaaggttccagattagtataccaggtgacggctaccccagtaagactttcctagaagaaatgcatcaacgatttttcatttttcgagtatgcccccattttcctgctgaacatcttcagggccccccaaagtcttcggcagtggtacgccgcaaaacggttgcccctcaaaggcatatccgacgtgaggctagaagtcgactagattgtggcctcgaggtgcttcatgtgtctcccccatgggttgagagacctgtgcatgaccaaattggggatgttggctctcaatgg

SEQ ID NO: 10020 - DNA, 524 bp, Glycine max
  Peptide Sequence Number=SeqID_101705
ctaaacataaaacggacaacaaatctggagtcaatgagcaacctgaagcttatgctgcaaacatttataatagatctcctcagcagcaaaaccaacaacaacaaaataattatgatctttcaagcaacagatacaatctaggttggaggaatcatccaaatctgagatgggcaagtcctccacaacaacaacagcctgtccctcctttccagaatgttgctggtccaagcaggccatatgttcctcctccaatgcagcagcagcaacaacaacaaagacaacacgcaactgaggccccttctcaaccttccttagaggagttagtgaggcaaataaccatccaaaatatgcaatttcagcaagaaacaagagcctccattcagagtccgacaaatcaaatggggcagatggctactcagttgaaccaagctcagtcccaaaattctgacaaattaccttcacaaactttgcagaatccgaaaaatgtgagtgccatcaccttgaggtctggaaagcaaaattga

SEQ ID NO: 10021 - DNA, 405 bp, Glycine max
  Peptide Sequence Number=SeqID_101706
atggagaggagtatgattgatgctgccagtggtggagctcttggtgatatgacccctgttgaggctaggaatttgattgagaagatggcttccaactcccaacaattcagtgtaagaaatgatgctattgttcttagaggagtccatgaggtggccacgaattcatcttcatcgactgaaaataaaaagcttgaaggaatacttgatgccttggtcaacctagtaactcagcttgccatgaatcagaaatctacacctgttgtaagagtctgtggtctatgttcttctgcagatcaccatacagatctctgtccttcttcccagcaatctggagtcaatgagcaacttgaagcttatgctgcaaacatttataatagacctcctcagcagcaaaacctacaatag

SEQ ID NO: 10022 - DNA, 118 bp, Glycine max
  Peptide Sequence Number=SeqID_101707
gcggcacaagagaaaagcattgaagaaaacacctggaaaggctataagttacccttttcacaagcctgaggaaaaccatcctccagggaaggactcgaccatctttgataacttttag

SEQ ID NO: 10023 - DNA, 552 bp, Glycine max
  Peptide Sequence Number=SeqID_101708
atgggtgatcaagaggagacgcaggaacagatgaaagccgacatgtcggctctgaaagaacaaatggcctccatgatggagggccatctcatggagaaaaacgcggccgctgccgccgctgtcagttcggctgccgaagcagacccgactctcttgccaactacgcaccatcctcccccaaacatagtaggacggggaagggacgcactggggcgcgatggtagccctcacctgggatacaaccgagcggcttacccttatggattgccgcccaactattcaccacccatcttgcaagaagatgcgggccacattgcctctcccgtccatgaaaaagaacctcctcagcagcccgacgaagtccataaagaccctcaagattatgctcggggggatgtcgagttttatcccccgatccccgaagggccggcaccaggcacgttgcctcaacccaacctcgcagcatcgccaatagttttgtctatggaagggccgcccccggcaactgaagaaaggaggaagctcgatctccttgaggaaagattgagggct

SEQ ID NO: 10024 - DNA, 904 bp, Glycine max
  Peptide Sequence Number=SeqID_101709
gaggtagaacaatcaattggttcccccgatggaaggaaggaaaggagggagtcctttttctcatgtggagggtacccaaacattccgctgattggaacgaggggttgtattaattacaatcccgcgctcgctataagacaactagggtaccccatgaggggagcaccgatggaagaaagcttgtctcatttccttgtgagggatttcggcgcgcgaaatttcaaggctataccaagaatccataaggcatgggaaaccccgttaaggaaagaccaagaacttaggggcattcgtaatggcatcgttggtggttaccatgaatggctgaaagaagaggacgaagaagtccaagctctcaaaagggagttaggaaaggcgaaacttgccaaggagaagttcaaaatgcaactaccgcaagagcccttgaacaagagaccaagagggctcgcaaggaaagagtatggccgtaacaaatttcgcggagctctgtggggtagcaacagtgaactcaagctgcgaagggaagagagggaccagtcgcgagcacatagcatggtcttgaaagaggaattagttgcctgttcaaggtccaaaaggagcttgtctcagcgtttatgcgagacagagaccaacatgctagctatcatcgccaagtaccaagaagagttaggcctagccacggcccacgagcatagggtcgcggacgagtatgcccaagtatacacggaaaaagaggctagaggaagggtgatcgactctttacaccaagaggcaaccatgtggatggatcggtttgctcttaccttgaatgggagtcaagaacttccccgcttgttagccaaggccaaggcgatggcggacacctactccgcccccgaagagattcatgggcttctcggctatt

SEQ ID NO: 10025 - DNA, 366 bp, Glycine max
  Peptide Sequence Number=SeqID_101710
atggccaaaatacaaggcccagacgaaggaaaaacctattctaatatttacaaagataagcgggctccatacttagcccatgggctcgaaatctaccctaaggctcatgagaaccctagggccttcccttggatctctaacccaatctacttggagtcttctacccaatgcccttgcgggattggattgcatcaaatagggatacaaaagaattctcaggcgggagaagggggacacaaaagaattcaggtggttagtcctttgttcttttggaaaagggagaagagagacacaaaaaaattcaggcggttagtccttggcgaattctttttggcaaagggagaagagatgaaaaagaatgaatag

SEQ ID NO: 10026 - DNA, 258 bp, Glycine max
  Peptide Sequence Number=SeqID_101711
atggagagaagtatgatagatgctgccagtggtggagcccttggagacatgacccctgctgaagccaggaatttaattgagaagatggcttccaactcccagcaatttagtgccagaaatgatgttattgtcattagaggagtgcatgaagtagccacaaattcgtcttcatcagctgaaactaagaagcttgaagctggccttgaatcagaaatctgtacctgtcgcaagagtctgtggtttatgctcctctactga

SEQ ID NO: 10027 - DNA, 357 bp, Glycine max
  Peptide Sequence Number=SeqID_101712
catcctctccaagcttcttatccaaggcacattcttggtggcgaagctccttcttccatggcttattccctagtggatggcacctcctctcaccacttctcgtttatcttccgctgcatctccatggtggaaaatcacaattcaaggaactcattgaagctcaaagatccagcctccattgaagcttcacaagcaagcttccatcaaggaattaaacttcaatgttcagacttctttagaggcactaaatttcgtgctcttctcttcctctcccttcattcatcttcttctaccttcaagctcttatccatggcttcctatggtggtgagcttcttctagagtcatcttctatttga

SEQ ID NO: 10028 - DNA, 555 bp, Glycine max
  Peptide Sequence Number=SeqID_101713
caagacacgaggcatccatgtccgctccagagccatcgctcgtgtactgaaaagagaagaatagattgggaccagtttttgactgggataggaggtagaacaatcaattggttcccccgatggaaggaaggaaaggagggagtccttttctcatgtggaggatacccaaacattccgctgataggaatgaggggttgtattaactacaattccacgctcgctataagacaactagggtaccccatgaagggagcaccgacggaagaaagcatgtctcctttccttgtgagggatctcgaaaagagttttgaagcaccggaagaggacgaagaagtccgagttctcaaaagcgagttaggaaaggagaaacttgccaaggagaagttcaagttggccgctacacacatccggaaggagtgtgccggattacgggaaaagaatgcaactaccgcgaaagcccttgaacaagagaccaagagggctcgcaaggaagagtatggcagtaacaaatttcgcggagctctgtggggtagcaacaatgaactcaagctatga

SEQ ID NO: 10029 - DNA, 78 bp, Glycine max
  Peptide Sequence Number=SeqID_101714
atgaggtccttcaatggtgattttacaccatggagatgcagcggaagactaggtagcttccttgagaagcattcttga

SEQ ID NO: 10030 - DNA, 150 bp, Glycine max
  Peptide Sequence Number=SeqID_101715
atggatctaaaggcagaaaccaatcaaggtaaaacggtacttagggatggacataagcagatgctaggaccacgatcaatagatcgtcatttcatgcccagcactggaccagtggaaagcgcagctgggggacagcctagtatcctttaa

SEQ ID NO: 10031 - DNA, 126 bp, Glycine max
  Peptide Sequence Number=SeqID_101716
atggagagcgtcatcaaggagagaggtaggaagagggttcaacgcaaggagacggaaaaagttgtatttataggcttaacctacaacagtccacaacctttggtaatcgattacaacctattgtaa

SEQ ID NO: 10032 - DNA, 1041 bp, Glycine max
  Peptide Sequence Number=SeqID_101717
atggcatccaggaaaaggaaaagcaccacttcaaggcctcaagctcagtatgataccaggagattccaatccttggaagcctggaaccgatacacagataacattctagaccagaggatccttccggaaaggaatgttaagatttatcataccgaatttgatgagtttaaggcagagttggagaggcgtaacttacacaaacgcctcgccaatctccaagatggaagcataaatgtagctgtggtgaaggagttttatgccaacttatatagcccagaagaccagagccctaagcaagtgagggtaagaggacatttaatcaagattgatgctgacagcctgaatacctttttagagaccccagtagttttggaggagggggaggcactgcctacctattccagatttacgaggatgaagattgatcctcaagagtttgttgcccagggccatccttggaagcttctaaggaaagatctcaccactcttgcacagacatggagtgtcttctcctatagcaacctgactcccacttcccacacctctgatcttaatatggacagagccaggttggtttacggcttagtcacaggaatggacatgaatattggagccctaatctcaggtcagatttctaccattgcccagagtaactcctctaggctcggattctcagccttgatcactactctatgcagagctaaaggagttacctctgatagtctgacctatgagagcctgagcctagccattaacttggcctacattaagaaaaactgttggaatatgtatgatctgacaggctcgaccagcaaattttcttcttctttcgcaccaccagctccttccacttctgctactcctacaccagcgcctcccacttctgccacccctacaccaactgcccaggactctcagcgctttgaagccatgcttcaaagtattcatcaggggcagattttactactgcaaagcttgcaggcggtagctcctccagggtccattctgtcagtagagcagtttattgagaaggtattgtga

SEQ ID NO: 10033 - DNA, 550 bp, Glycine max
  Peptide Sequence Number=SeqID_101718
ggcaaagaaggcctccttctgggggggccagagccatcagtgagataccactctggaagagctagaattctaaccttgtgccaggacctacgggccgagggacagtctcaggcctcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacggctgatcttccccaagagctcacatcgacgggaaggtttggcaccctcgatgtcggctcttcgccacctgggggctgtagtatgttccaaggggttggggctgttcgcccattaaaagcgagcattgagagggaccttttccctagtacgagaggaccggggaaggacgcacctctggtgtgcccagttatcgtgcccacggtaaacgctggagcctccggtagcacagccgagacagcgatgggttctctgccccagcggggatggagcgaaagaagttttgagaattcaagagaag

SEQ ID NO: 10034 - DNA, 135 bp, Glycine max
  Peptide Sequence Number=SeqID_101719
gtgaaaaagaggctaggttttgaattgcagaaagtagtagttgggctaagcgcttatccactgctaagcatagctttagcgcgcttggcgcaaaggagaatctggcagagtatcagcatcaaagccgcgtgctaa

SEQ ID NO: 10035 - DNA, 621 bp, Glycine max
  Peptide Sequence Number=SeqID_101720
tgattcgacaagcaagactttgccacgttccactggtaagttgaaacacttgagatatttcagcattcagaataatcgcaacatcaagagactccccaattctatttgcaagctccaaaatttgcaattcttgaatgtttcgggatgggaggagctggaagcattgcccaaaggattaagaaaattgattagtcttcggtgtttggagataactacaaagcaacctgttttgccttacagtgagattaccaacttgatctcgcttgcacatctgtctattttgtcaagccataatatggagtctatctttgtaggggtgaagttacctgctcttaaaacattgagtgttgatgactgtcacagtctgaagtctttgccactggatgttaaaaactttcctgaattagaaactctggttgttgataactgtgttaatcttgacttggatcagtggaaggaccaccatgaagaacaaagccccatgttgaagttaaaagttgttggattctggaatttaccacagctgccggccttacctcaatggcttcaagaaactgccaactccttacagaccttgaatattttagactgcgacaatcttgaaatgcttccggagtggct

SEQ ID NO: 10036 - DNA, 57 bp, Glycine max
  Peptide Sequence Number=SeqID_101721
atggacacccgtctccgtgtgattggtgatcccatgaatggagttcaacgggggtga

SEQ ID NO: 10037 - DNA, 390 bp, Glycine max
  Peptide Sequence Number=SeqID_101722
atggaaaggagtatgattgatgctgccagtggtggagctcttggtgatatgacccctactgaggctaggaatttgattgagaagatggcttccaactcccaacaattcagtgcaagaaatgatgctattgtccttagaggagtccatgaggtggtcacggattcatcttcatctgctgaaaataaaaagcttgagggtaaacttgatcccttagtcaacctagtaactcaacttgccatgaatcagaaatctacacctgttgcaagagtctgtggtctatgttcttctgcagatcaccatacagatctctgtccttctttgcagcaatctagagtcaatgagaaacctgaagcttatgctgcaaacatttataatagacctcctcagtag

SEQ ID NO: 10038 - DNA, 144 bp, Glycine max
  Peptide Sequence Number=SeqID_101723
atgtggaccaccacgggggagaagcttgccgcccagctcgcccaggcgagcagggttgcttcctctagaagcaacagccttctggaggaatcttctggagggcccaagtgggccagattgctatttacaccccctgtttactaa

SEQ ID NO: 10039 - DNA, 393 bp, Glycine max
  Peptide Sequence Number=SeqID_101724
atgtcttggagaggacacattacttctcaatgccccaccacaaaaaccatgattatgaggggccaagacatttatagtagtcaagatgaggctactacttcaccttcctctagtgaaagtgaagaagcaaaaggggaagaatctagtgaagaaatctatccccaagaagatggacaaccattagtggttaaagagaagtgtaaggagacacttgttagcactgccacacctcttgggcttgaggttattcctcaagtaaaggagttgttggatgagggtttggttcgtgtcgagggaaggagcctagagtatgaagaacctcgggatttgaggtcaaatcctttccaaggtggaggggatgatgcaatcctaccccccaagggtattggatag

SEQ ID NO: 10040 - DNA, 363 bp, Glycine max
  Peptide Sequence Number=SeqID_101725
atgaggggtcaagacatctatagtagccaagaggaggctatttattctccttcctcaaatggaagtgagggtgaaaccaagggtgatgagcatattgaagaggtttacccctatgaagaaggtgatcttctaatggtgagaaggctcatttggagttatgtagaagcaaggcttcatgatgatgacaaaggtgacgaacaaaaagctcaaagatcaaataacaactcaagtgaatcaggaacaagtcaagagttcaagaatcaaggagaattcaagactcaagaagaaatcctagaatcaagaatcaagattcaagatctcaagaatcaagatcaagattcaagactcaagattcaagaatga

SEQ ID NO: 10041 - DNA, 423 bp, Glycine max
  Peptide Sequence Number=SeqID_101726
atgtcgcgggggtcaggagaccttggggacgtcaggcgagctcctggcagtcaaccaacaaaagaacaaagtccacaaagcaaggaggcttgtgtggcggctgaccatctatgtatcttgggtctggaaaccgcatgcacacttcagcagcctgtggagtggatactacctacacctactccatatcaacaagtggagccagttcaagtgatagaggtgtcatcctctgaagaagatcttgaagaggacctagaggagttacctcttgaacctgctgtggatgaccttgacttacctgaggatgatgaagacccactccctgatgttgattttccagaggatatcatgtcagcatctgaggcagactctacagaggagagtggccttggagggacagcgaatagtgacgactcttcatcatag

SEQ ID NO: 10042 - DNA, 183 bp, Glycine max
  Peptide Sequence Number=SeqID_101727
atggtgattttccaccatgaagatgcagcagaagacaaaggagaagaggtagcttccttgagaagctttcttgagaaaacttccttgagaagctttcttgagaaaacttccttgagaaacttctttgagaaaacttccttgagaaacttctttgagaaaaacttccttgagaaacttctttga

SEQ ID NO: 10043 - DNA, 144 bp, Glycine max
  Peptide Sequence Number=SeqID_101728
atggagattcctttttcgtccttgctcgttgggaaaccgcgagccaagttggaaaattctgcttcggttgaagggttcctctcggtgtggggtctcaacggagaacaacggcattttgtggtggctaatggtggctgtgggtga

SEQ ID NO: 10044 - DNA, 294 bp, Glycine max
  Peptide Sequence Number=SeqID_101729
atgttaggatttacacgcgattctcctcaaatttcagccagcccgcctcaattagactttgcaccttacgcttcgaggtcatacagtgctcaatggaatgtcccggggcttctccatgacaagcacacgttgcgttcgagtcgtattctcggagaaatggaggttgatgaaacttggttggggttatggctaccattgagttatcaagtagatatgggagcaagtcagcataggacaccggaattctgggtggtgtttgtcattggaagtgtggtaggtaggctttgtggttga

SEQ ID NO: 10045 - DNA, 123 bp, Glycine max
  Peptide Sequence Number=SeqID_101730
atgtatatgttacgctttctacaccgttttacagaaagcaacgatgttgaatatgagaacttctacatcggtggtgacataggcaccgatgtaaaaacatatttaacctgcataataatttaa

SEQ ID NO: 10046 - DNA, 594 bp, Glycine max
  Peptide Sequence Number=SeqID_101731
atgcctttcatcacacggggttttagtgaccccaacgcgagggtacttcgaggagtccgtaaggcatgggatgcggtccaaaggaaggacaaagagcttaggggaaacgaggaagaggccgaagctctggaagagagtgaggaggtacaagccctaaaggcggagcttgagaaagcccaagcagtcaaggagaagttcaagtcaacaaccatcaaagtccgaaaggagtatgatgaactgaaagacatcaacttggccaccgtcaaagccttggagcaggaaaccaaaagggcccggaagaaagaacacgaccgaaacaagttccgaggagctttatggggcagcaacaaagagcctaagctccgaagagacgaaagggatcagtcgcgagttgaaggcatgatcttgaaggacgggttaaaggcttgtcttaggtccaaaagaagtttgacccagcagttaagcgagatggaagggaacatgttggccatcattgataaatacagagaagagttgaacctagaagcagctcatgagcataggctagtggatgagtacgccaaggtattcgtggaaaaggaagcatgggggagg

SEQ ID NO: 10047 - DNA, 222 bp, Glycine max
  Peptide Sequence Number=SeqID_101732
atgcgagagtgcgagccgagaccagatgacgcgagactagacgacacacgacacagcaatgcgatgcggtggttgcctggttctgttggaagccgcgagtcccacccacgaacacggcgagctcaagagaagattgctacttgtgtcaatgacaagcttgagagaagcttggaagccgcgagtaccacgagccataacccacgaggtccacgacgagcttga

SEQ ID NO: 10048 - DNA, 402 bp, Glycine max
  Peptide Sequence Number=SeqID_101733
atggagagaagtatgatagatgctgccaatagtggagcccttggagacatgacccctgctgaagccagaaatttaattgagaagatggcttcaaactcccatcaatttagtgccagaagtgatgctattgtcattagaggagtgcatgaagtagccacggattcatcttcatcagccgagactaagaagcttgaagcttatgttgcaaacatctacaataggcctcctcaacctcagcagcaaaatcagccacaacagaacaattatgacctctccagcaacagaccatacgttcctccaccagtccagcaacaacagctccagaaacatcaaacagttgaggctcctctgcaaccttcccttgaagaacttgtgagacaaatgactatgcaaaacatgtag

SEQ ID NO: 10049 - DNA, 198 bp, Glycine max
  Peptide Sequence Number=SeqID_101734
atgcaggagtaccgtatggttatccacacctttcgtcaaccaggggcaaacgagcccgttgacgcgcagagactaacatcgtcttctgcaccttttgtcatcctgacccatgaagtcaggttttttactctcgtcgtccggagacattcaagcccgacgacgcacgagattcttatctgctgggcgaggggcgattaa

SEQ ID NO: 10050 - DNA, 99 bp, Glycine max
  Peptide Sequence Number=SeqID_101735
atgctgagtccgatcgggagccatatcggagttgtactgatattgcctaaggaaggcagtaatcagatccttccaagtgcggatgcgagaagcttctag

SEQ ID NO: 10051 - DNA, 354 bp, Glycine max
  Peptide Sequence Number=SeqID_101736
tttgtgatgatttggatgttgaattacctggatgtggggaagcttgggaggattgatggggacccgttgttgagagaaacgaggatatgggctacgtgggagtacgtgagctcagttggaggtggacaacaggggatgagtggtacctggagatatgtcgcgggggtcaggagaccttgggggcgtcaggtggggtgctattgcccacaaccaagcttgaccaatcctgacccaacccgggcatactgtgaatcttgtgtgatatatgggttatggcctctggtaatcgattaccaagggcttgaaaatgaggtcaggaagctaggagagcttctggtaatcgattaccaaggg

SEQ ID NO: 10052 - DNA, 2580 bp, Glycine max
  Peptide Sequence Number=SeqID_101737
atggactcggttgtgaatgctgcggtggaagagatatgtgctgggattgaagatggactaactctcgcagccctgtgggccaagcttgaagactcaccctctctttcatcctccaatctctgtctcaattccactgtcaaaagagccatatggacaaacctgcttcgcattcccactctccggtttgaaccacaaccctcttcttcggaactggaggatgccgagaagctcaatacaaagatctttgctcaccagagcctcacggataactttgtcggtctctacgactcgcaatctctccaagatgcccaaatgcgtgtccttcgccttcttgctaatgctagagcgaatggtgtcacgcaaactcagcttgccaaacagttgcacattgatcccaataacttccattatgtgttgaggagtcttgagtgtcaaggcttgattgtcaagcgctcggcaattgagaaaaagaaacaaatctccagtcatggtgaatccaaaaattatccgtgtgtagctacccatttagtatacttgcatcgctatgcgaagcaacttgcctctcatcaaaggtttgagtttgaaattaccaaattcaactcccctgatgatgacgatgaggatgcagatggaaccacccttcaaacagatgttcatcttaaggattataaacctcagatgaaagctatttgtgaaaaacttgcagaagccaatggcaaggttcttcttgtgtcagatattaagaaggatcttggttactgtggatcgcgtccaaaacaaagggcttggcgacaaatttctcaaaggttgaaagcacatggcattgtggaacagtttgacgctaaggtgaatggcaagattgaggcttgcctgcgccttcttgacccaataactacagaatctggaaatgaagataaaaagttgaactccgggaaaatctgtcaagttattgatcagcttgtggagcttcccatggagcatcaaatttatgatattattgatgctgcaggatcttgtggcattactttgaaggagggagcttggtcagcttcccatactgtggctgatagccttaaaagcatagagactgaggatgtaggcttggctgcaatttatagttgtttcactcctagttgtttctattctgctctagaacttggaggatatcttatcctgtaccgcaatatatgtgaaaggcttgggattgaactgaaaaagagtcacattcgacttgtaaatttgtgctatagatttggaatgaaagtgcaggaagaacaatgcctaaaatctaaggcaattcgagtttggacttctaaaaatttcaaccctgaaccagaagttgaacttatttgcaagcttgatgaaaacaaaactttaaacgatgtgcctgacagttcaaaaataatatctgaatttgagacttcaactaccagtggaaaacttgctgaccctgcaaaattggaagatagaggagttggtgcagaactatcttgtgtatctccaagaaatactgagtcaaactttgtaggaacgtcagcagacttgcaagatttggtccttgaccgaagaagtacagtttctcactgcaaatcagtcagttcatcagcggaggcagacaatgcaccatcaggagcatttccatctgacatgttgaaaccattctctactggatcaaatcaaagatatgcaagtctatctttaagtgtggataacactagaagggcaaataggatactagaaagactaaaggatgaaaggttcattttgaaatctgagataaataggtgtcttatttgctttgagaaggataagtctacaaaagtggaccgcaagactattgaccgaatattaactaaacttcaagaacaagagcaggtcaaatgtataacagtacattcacctgttatttctgaatattccaggacaaaagattgtgtggtagttgtacatccatccatgagtctaactcctgagttatttgatgaaattcaagatagaatacgatcatttaattgttatattcgcagcaaaagtgcttcacatcagaaaaatgatgaattgctacctgtaatggaggatattcagaaaaatcaaagcgttatagttccagatgggcaggctagtaaagcagaagccatgcgtgctaatggatttgtattagcaaaaatgattcgtgcaaagctgctgcacagttttatttgggattgtctgcataggtcaacaagccatattaatgttttatcatctaaaaaatgtgtcttcgaggtaactgatgctcctcatagtagcagcaaactattttttctagaagcaactattaaagaaatgccagttgaactattcttaaaagttgtcgggtccactaaaaattatgaagaaatgattgaaaagtgcaagatggatttacgtctctctgatcttcctccggaggagtacaagtgtttaatggatgctcaagcaacaggaagattgtcattagttattgacattttacgccgattaaagttccgttcatccttacccaatgtgactgtgatagtgagttgggagagcaacccaactaatgatggcaatgcataa

SEQ ID NO: 10053 - DNA, 1278 bp, Glycine max
  Peptide Sequence Number=SeqID_101738
atgccatgccaattgggaggtgttgaagttaagaagggcttggaagaggctgacacaaattctgatcacaatgagtcctctcaagaggtaaagtggatccctcctccgaatttctgcataaaaggaaactttgatgtcttcttgaaagataaaagtggaacaggttttgggagtctgtggagcaaaatgaatgcaaagggggttgctcctgtgaattccacttatgggaccttgattaatgcttatagcaaaggtggactcaaagaggaagcactagcgcggttacagaggatgcagagtcaaggaatggagcctgatgaggtcaccatggggattgttgtacctacgttcacgactacattaagagaaattttaattacttacacacttttgcaagcttacaaggctacagagactttcaaggaaatgataaaatatgacattcaaccagatgattttactttcagagctcttgcaaacattttgctgaattatggagtttcaaagcaggctgttggtaggctggaagtaatggtggaaagggatgctcctcgtggtttgcaagcatggattttggcactctcatgtgcatatgaaggactggttgtttgcctttttattggctacatggttgaggctatgattggagcatttcaatcacagtatttagaattactactggtttggctccttcatagttcgattattgcaactttgaagttgggaactcctcaacgccaaactataggcattacttggactcctcttcctgcgtctaaagtgaagcttaatgttgacaagagctccttgggtaacctgggaccttcaggatttggcatattaattcatgattctcatggttcttgcgaacagaaaagaggacacagcgcagagccgcctcaacatctgaaacagactctatccctaatccctatcttcttctctgctctctccgcacgctttggctcctctgatctcaggtgttgttggcttggtatccgtgcaagttctgctgtagccgatttgaaggctactatccatttgggagcaactgagctgcttggagagtatttttcttcttctagaaaaaattacagaccctcatcccagagagttagctgtatgcattgcgagacatatcagaaattcattcagttttctggttgcggttggccaccttccattatacttgagggagattcttcaagggcacaagctaccttagaggctgaaattgcggctgcgtataatttgaattctggcatttgctgcatctga

SEQ ID NO: 10054 - DNA, 393 bp, Glycine max
  Peptide Sequence Number=SeqID_101739
atgatgatcctttcggaactgattgcaaccaagaaagacatatttgagagaccaagcacaatgtatattaacactaggtctaaggttatgaacaaaacaggtaggcttggagataaagtgagaggtctgaacttgaaggtagaagaaacggtgcaaagcgtgactccagggcttggagcatggtggcccacgaggtttagaacccatttcacgacatccactggaccagcaaagggcgggcccctccatatagaacgaggcaacgggaaggtgggaggaggagagggaggctgtttaggtgaaaggggggctggagtgaatgatgtgagccgatccaaaactgaatcgagcttgctaagcaattcggagttggcttgggacagtgtttgctag

SEQ ID NO: 10055 - DNA, 1599 bp, Glycine max
  Peptide Sequence Number=SeqID_101740
atgggaagggaggtcgctgctatagacgagaatgtcgtcaaaaaatacggcgacaaatttcctcagatagggccggaggagcccgaagggcataacgcgaaattcgtaatggccctggtgtgtgcggaacgccgttttcggtatgtcggaggtggccatgcggatttgatgaaagccctgtcggagatcaagcttcgtgaaccaagaagctttgccgagatcatcaagaagctcgtccaccgtaggcatgggaaatttgtccttcactgtaatggaattcaacgcccggccggaattgagcatggccgtgatctgggattcaatttctgccttttggtagtgggggtagcgataagggcggacattgactggggacgcagtaggaaggagaggtatgtggtgttggatggggttgagggtgttggtctgagggaaggggaggggagtgggctggcaggagagggtgaggggggtacatcagcaaataatgacgatatcggcgccgcagatggggaggtgaaggaggtccaaggtgaacgggtgggtttttatggtgagggtgatttgaggggagacggtgtcgcagtcaagggtgtggccgttgccgaccatgacgcggagaggggtagtggaggcggtggggaggtggaggaagcgggcaagccgtgtttggatgaagttccttccatggcgtttaggctgatctgggagatgagggtaggatcagggtcgggttcgggaaaagggtcaggggaaagtatgtcttcgtccgcgatgaacagctcttcggcggagaggcgcttaatcggaagcttcggggatggcagggaaggaggggaaggtgttttcggggtgagggcaccgggagggggtgacggggaaaaggccgagatggggttcggggaagcaactcagcaaagaggatggagcgataccgatggtgcggttagccaagcgttcgaaggcggtgaggtaatctgtgacggagcccgtctgttgaagcttgaacaggttcccttgggggtcatcgtagaaggagggggcgaaacgggattccaaggcttgcagcatcgccggccaagaggaaaagaacccattccgatgcatccactgataccaagaaagggccgggccgtccatatagaaagaagcgatggtgaggcgttcgagctccgggataccttgataatcaaagaactgagatattttaaatatccagccgagtgggtcatggtcgtcgaacctgggaacatcgagcttgaggtgatggtagcgagaggcaggggaaggaggaatgtgggccgtagggttgggggaaggggtattgttgggttgcagggtgatggcagtaaggcgatcaaagagggattcgatttgggaaaggcgatggatagcttcttcgagcttgtccgtggtagtgagtcgggtatggtggtcgggcatggggtcgaggggcagaatggcgtcaatgcttcacacgaagtcctcgaggtatgtgggtctgtgggttactcgtttgggcctgttaatgctgttattgttgatactgggttccttattctgcataatgctatcaatatcattccctatttgtcatag

SEQ ID NO: 10056 - DNA, 189 bp, Glycine max
  Peptide Sequence Number=SeqID_101741
atggctgttcaaaattctctccaaataactagaagtggtactggaggttatgatgatgatgggcgtgccaagatgactgatcaaaactgcactttcagaaaaacaaattacaaggttttgaattgcagtcatagtcgcgatttcgttgcaatccttgatgtcggggaagttgcagacaaatgtggctga

SEQ ID NO: 10057 - DNA, 1566 bp, Glycine max
  Peptide Sequence Number=SeqID_101742
atggctgaccagaagaatcaaaacccggattcaggaaccattagtgttgaatcagcaaaagaaaaaagaaggaacaaacttcccaacttcctgctatcagtgagactcaagtatgtgaagctagggtaccattacgtaatctccaatgcaatgtaccttctgctcataccccttctaggcatagcttcggctcatctttcaaccctttccatcaaggactttctccaattatgggagaatctcaagttcaaccttgtctcggtaaccctatgttcaagcctcacggtgttcctcgccaccctctacttcatgacccgtccaaggggggtgtacttagtagattttgcatgctacaagcctgacgtggattgcacgtgcacgcgggagattttcgtggagaggtctggtctcacaggctcattctcggaggagaacttgtcctttcagaagaagatccttgagaggtctggtttggggcagaagacgtatcttccgcccgcaatcttgagtttgccgccgcgaccgtgcatggcggcggccagggaggaggctgagcaagtcatgtttggagcaattgaccagctgctggcaaagactggtgtgaaggctaaggatattgggatcttggtggtcaattgcagcttgttcaaccccacaccttcactctctgccatgattgtcaatcactacaagttgagagggaatgttttcagttataatcttggtggcatgggttgcagtgctggccttatctctattgaccttgccaagcacctcctccaggtccatcccaactcttatgccttggtagtgagcatggagaacatcactctgaactggtattttggcaacaaccggtcaatgctagtctcaaactgtctcttcagaatgggaggagcagcaatcctcctctccaaccgctccggcgaccgccaccgcgccaaataccaactagtccacacagtgcggactcacaaaggagcagatgacaagtcctacggctgtgtcttccaagaagaagatgagacaaaaagaattggtgtggcactctcaaaagacctaatggctgtggcaggagaggccctaaagaccaacatcacaacactaggacccttggtcctccctatgtcagaacagcttcttttctttgccacattggtggctaggaaagtgttcaagatgaagataaaaccatacatcccagatttcaagttggcctttgagcatttttgcattcatgctggagggagggcagtgttggatgagttggagaagaatcttgagctctctgattggcacatggagccctcaaggatgacactaaataggtttggtaacacttctagcagttccttgtggtatgaattggcctacactgaagccaaagggaggatcaagaaaggtgacaggacttggcagattgcatttgggtcagggtttaagtgcaacagtgctgtgtggagggctttgaggaccatcaatcctgctaaggagaaaaatccttggatggatgagattcatgagtttcctgttcatgtgcctaaagtggcaccaattgcttcctaa

SEQ ID NO: 10058 - DNA, 1383 bp, Glycine max
  Peptide Sequence Number=SeqID_101743
atggtggtgagaatagcaatttcgggcaatgagaatagccacggccagcatcatggcaagtccggcggagccgccggaggagtggcggtgacaccggcgaagagaggccgtcccttcggcagcggtaacaacagtgcctccgccgccgcttccgccgcggattcggcggctccgtcaaacctccttggtccttcccttcacgttcacaactcctttgccgatcagaacaataaaagaattgtcttggctcttcaaagtggtctgaagagtgagctgacctgggcgttgaatattcttacgctactctcctttaaagaaaaggatgacatgcgcaaggacgcaactccccttgcaaaaattcccggcttgcttgatgcgctccttcaagttatagatgattggcgtgatatagcactcccaaaggaattagccaagacaacgagggtgaggacgttaggtgcaagttctgttgtaactggatttgggtgtgaatatcaggcgctgggctcaactggtactcaccaccgccctggggatgggggttatgagagaatgaatctcattgtaggatggtgctctttgtgcagtgtaggatctggctctgctggtatagaatcaacgcagcagaatggcgtgacaaaatctcgtttttcggagttgtggcttgatgaagatagcctatttaatttagatgatgaagggcgaacagaaaaacagcaatgtgctgttgctacttcaaatatcatcaggaacttctctttcatgccagataatgaagttataatggtccaacatcgccattgtttggaaacagccttccaatgcatagaagatcatcttgtagttggtgttacttacagagaaaaacgtgcagtgcaggccatcatggggatgttggaatctgcagtcaaagcctggcattgtgctgctgctgaattacttgggcgtttgatcattaatcctgacaatgaacctttcttgcttccattttttccacagatacacaaacgcttaattgatctcatcagcatgccagctttagatgctcaggcagctgctataggtgcactctataaccttgctgaagttaatatggactgcaggctgaagattgctaacgagagatgggctattgatcgtttgcttaaagtgattaagacaccacatccggttccagaagtttgccggaaatctgccatgatattggagagtctcgtgtctgaaccacaaaacagaagtttgctgctagcctatgagaatgcttttgcagagatagttttcactgatggaagatattccgatacatttgcgaggatattgtatgaactaacatctagaccaagtagcaaagtcgcagcggctcgtggcatatggggtatgtaa

SEQ ID NO: 10059 - DNA, 414 bp, Glycine max
  Peptide Sequence Number=SeqID_101744
atggagctctttctaaactattttttgtatggtgtcattttttacgtaaaagctatacaaatcgcagaaagcattggcgagttcgggctgagggtgacacgtggcattggtctcgccagtaccaccagcgatttgagcttcatgggactcgccagtgggactggtgagttgagcagctccttaattaatggcattataaagcactcccaatctgctgcacaactcgccagtagagttggcaattcccagcctgctcaactcgccagtccaactggcgagtctcatggagctcaaatcgctggtggtactggcgagaccagtgccacgtgtcacccccagtccgaactcgccaatgccttctgcgatttgcatggcttttacgtaaaaaataacaccatacaggaaatagtttga

SEQ ID NO: 10060 - DNA, 1575 bp, Glycine max
  Peptide Sequence Number=SeqID_101745
atgagaaatttcatgggatttactaggcagactgggagaggtcagggtcttttgaatacgttgaagagagtaaagaaaggggataaagggggagttagcttgagtcagttgaaaactgagaaggaagttgggaggaaagtgcttgtttccctgaggcctattagaagtagagtatcaactaatggttcaagtggtcaccatcatcgacatggaggctctacaagtggacttggtgggtattctccgaggaagaggaaaagtgaagctgctgttaaaactccttccccatctaagcattctgttgagaagaaacgtgctggattggatcttccccctgcagggacaaataatccttctgctgttgtttcttcaagttttctagtatcaaattgtgctgtgttgtccaacaatcatgatgtgattttgactagttctcttgatctagcccttgcgaagcctctgcctaatttacctgcttctgcttctgagaaagctgtcatggattgtttcaataaactcttgctctctgcccgtcttgtggagattgctggttcgtttggatctttgaaggcttaccactttgaaaccaaggtcagcaatggatcatgtgcttttcttgagccatctgttaagtatgtggaccactctgttaccatcaaagcttgtgcgggtttgaatggtatgaagctgggaggggaagtactaacagttcttcaggctatgcctgatgcatcaccctcggaaaatgctggtgagccaccgtcatatgggattccagagcatgcagaaccactgctcagaaagccaacgcaagtactagagattaataatgtgtttgcagactctatttggtctttatctgatgtgacaattgaagaaattttggatgatgtccgattggaatgtgcaagatttgggactattaaatcaattaatgtagtcaagcatagcagtgacgagaatttagcaaccaaattagaagaatgtgaagtcataaacaaagtggatgctaaagatgtttctcaagacacaaactgtattactaataatacagaatatagtttttctgacaaggctaattactccaaatttaaaggaacaaatgggatggaaatccatgataacaaagaaatggaagaagataaagttgatgagggtagcagtgttaatgttgataaaagtgctgaagtttttgatgataaatcatgtagagaacaccttgtagatgatacagcagttgaagatgcagaggataagaacataccttgtagtatcattcaagaatgtctgggtcaacaggatactctcgatgatgggccagaatttcttgatatgatggaaggctttgctgaatgggataccagtgcagaattggttggtccccaaaagagcattgacacggaagatgatatttatggtcatgtatttacacctggttctgtccttgttgagtatggaagagctgaagcatgttgttcggaagcacattgtttgcatggacgattctttgatggcagaatggtgacggtggaatatgttgctctcagtctatacagaacaagatttacaacatga

SEQ ID NO: 10061 - DNA, 507 bp, Glycine max
  Peptide Sequence Number=SeqID_101746
atggttacaatgattttgtgcagtgtgtttgcattattaagcctgcacttgtttatgtatggatgcaacctgtacatgtggaagagtacaagaatcaaccataatttcatatttgaattctcaccaagcacaacactgaagcacagagatgcatttctgatgtgcactaccctcatgacaactgtgtttggggcaatggtggtacacctgctactaagggctggaggtttttctcctggccaagttgatgccattcctggaatcatttttttggttctgctggtagacttttttatggctgaccaactaactagccagattccattgctaaggcatttggaaacaacaggttgtcacatttttgctagagttttcaagtcacaccaccctgaggcatgccattctggaaggctatacatagaaataacttaccttatctcatttttgccatattggtggcgtgcattacagattctgtatcaactgcttctagaattggtggcatga

SEQ ID NO: 10062 - DNA, 3645 bp, Glycine max
  Peptide Sequence Number=SeqID_101747
atgaactcttccacaaggttggattcagctgtgtttcagctcacaccaactagaaccaggtttgacttggttataactgtgaatggaaagaaggagaaagttgcctcgggtttgctcaacccatttctatcccacttgaaggctgctcaagatcaaatagctaagggtggttattcaattgttcttgtgcctgagcatggcagtgacgcctcatggtttaccaagggaactgttgaaaggtttgttcgctttgttagcactcctgaggtattggaacgtgtgtatactatagaatccgaaattgcacaaattgaagaggcaattgcaattcaaggaaataattctatagggattagcattgtggaagaataccaaataaaacatgtggaaagcactgacggtaattttgaaagaacaggcaggaagactcagcagaatacgaatgaggagaaagctattgttctttacaagtctgatacactgccacctgaaacaaatggaagcaccaaatcagaaggaaactcaaaacttcagcttttgaaagtcctggagacacgtaaatctatgctgcagaaagagcaaggaatggcatttgcacgtgctgttgctgcgggttttgacattgactacatgatgcctgctttgatgtcatttgctgaatgctttgaagcatcacgcttgatggatgcatgtagaaattttatttctctttggaaaagaaagcatgagagtggccaatggcttgaaattgaaactgctgaagtgacgcccaatcatgctgacttctctgcaataaatgcatcaggcatcatattttccaatatggttactacttcccatactaaattggacttagaaagtaatgggaaaactaattcagatgtgtttccaacggacagacaaccaactgcaggttacaaagatgatgttcaaggtcattttccaaataatgggttttcctcctggtctgttcattcttccccaggtgctttaccaatgtttcagccatatccagttcaagggataccctactatcagacttatccagcaaacagcccatttatgcagccagtttgttcaacaccaatgggacatagaaggcattccatggataatggacagcttatagaatccgaaactcgggatgaaatggatatgaagagggagcgttcactgactggagaacgatggaagaaggctggccgatcaggcagacagaaatctggaatggtggtcattaggaacatcaattacataacaaagacagaacgatcttcgggcagtggatcatgttcagattattcctctgaaagtgatggagataaagatgctcatgagtcagttaagacctcaaaaagaagagggaccagtgacaaatcttttaaaatgttgaattcatctgataaggaagtaacagactctgggaaagatgctgatggaggacagtggctagcattccaaaattgtttactgagaggagtagatgaagatagacatgccattgaccaagttcagtttgatcaagtgagaagaaaaaaacatgttgcagttgatgatcctatagattttacggagcggaatatgcatgaagctcgaggaggtggaaccatagatatgcttagcattagcaatggattgacccgcatgcctaggtcatccaatgatgtcttgttatctaggtcaggacagtctgttaatggtaatttacattcttcctcagatgtggcatctgtcaatggacaaggttattcaagcaataaattggaaaggaagttgtttcacgatacgaatgatgactcctatatagtcagagtcaaagattcaggaaattttgagagaaatgctattgacatggactccgagttcccaaaggtgtacaggaaggaagaaaatacttccaattatcagccagatgaattgagtttgatgcctgaacgaggagcagaaaaggggtcaatgggttatgaccctgccttagactatgaattgcaggctcagtctggaagcggtgctttgcaagataaaaaaaacaaaggttcattattagctcacacgaaactgagatctaagatgttggataaagatctgaaatcaaaacctactccaaataattctgatgtaaaaaagactgttgggccaataaggagaggaaagactaataaaccaagtccattggatgaagcaagagcacgcgctgaaagactacggaacaacaaagctgatccccaaaagctgaagaaagagaaggaagaggaagagataaaacgcctcgacgctttaaaaatggagaggcaaaagagaattgctgccaggagtaattcaattgccaccaagtcatccacgccaccacagcaaaccaagaaacagattccaaggaaattttcacctagctcttatataggatccaagtttagtgattcagagccgggttcatcctcacccttcccaagatttcccatcagaattgcttctgctggatccagcgagtcttcaaaagccccaaaaaccagcagattgagtactggaagccagttagctacaaacaaattaagccgatcagtgccttctctgcccgaatctaagctagagaagggtgatggtacaactgatactaaggcatcgatgacaagacttagaagattgtcagaacctaaaatgagtaccattcgtcatacttcctctgtctctgttaaaccacgaggtgctaggacaacttcagtgactaaagcagctaatgagactgagatcaaaaagatttctgctattgtgaatcatgataaaagcaagactgcaacccttcccgaactaaaaattaaaacacctaaagctaataacatcgtccaaaataaatcatcaattaaagagaggacacagaagctgaatgttaacaaatcttctatgaattcagaaggtgccgtgctgaagagaaatgaatttggaatttcatccattgatgatgaagatgataatcctataattgaaaagaatgttgtaatgcttgagcgtgaaaaaacttgtggccccaatattagcaatgacaagtcaaaagaaaaaacagggatgccaaagagacagtatgacaatgataaagtgatggagaaacctgagacagtgtcaagttatgttgctgttcgtgccccagtttcagtagatatggaaaccttggagaacaaatcacatgtgctacccttattgtccaaggttaaaacaaatgatacagataaagggcattcaaaatcatctagcattcatattactgatgaagcatatcatgccccacatgctcgagtttcttctttggaagattgttgcacacgaaactctgagcatggtaaagtacctaccacaagcttggacagtgcatcacttggtatggagacttttagatcacgtgtgtctgattccagaaactcaacacttgagaagattcctgaagtgattgagaagcctcaggtaaaggaatcatcgaaagggttgagacggctgttaaaatttggaagaaagaatcacaactcgcctactgctggacgtgacatggaatcggataataccagtattgatggttccgaagcaaatgagattggaactaatggttcctcgaatgaaggtagcatgatcctaatggcaaccagcatattaccatag

SEQ ID NO: 10063 - DNA, 342 bp, Glycine max
  Peptide Sequence Number=SeqID_101748
atggggtcctatgatggtcacagttcgaccggagagggtgctacgacagtttgggtacattcagagcatccatccgccgctgttagcgcttcgttgtcatatgatgatataaatgataggtggatgcatttctcggaccatgtagtagctgtgggtgacctttgtgtagtgtctaggcaagcaggtgaccagcccatacatgcacctgccccagaccatgaggactacatgcaggcggacatcccagaggatgattacgaaggctatgaggcgatcgcaaaaagtttggagcgtgtgctcaaccttaggatggtcactgcagggacagatcgagttacatga

SEQ ID NO: 10064 - DNA, 279 bp, Glycine max
  Peptide Sequence Number=SeqID_101749
atgagtcaattttttatgcttgccattgggttgattgtggaggtggctcatgcaacaagacatccaagttctcctataattgtgaatgcaatgctggctattacaatctctaaatgtcactgcattcccttgcttcagagaatgttctttgggatgggttactctgaacttggaatatcaatgacaaactcatctacttctacaccaccagctttgaatgacaacattaagaatgaggagaaactggaatttgatcaattaatagatcgacctgcttaa

SEQ ID NO: 10065 - DNA, 1542 bp, Glycine max
  Peptide Sequence Number=SeqID_101750
atggaaaaggagcgacccgcacggagacccgacccgtttcacgcacgaccgccgccgccgccgtcggagacgccgcgcgaccccatggagttcctttcccggtcgtggagcgcctcggccctcgaagtatccaaggcactcgcatctcagcaacaacttccaccttcttccaacaacgttagcatcgtttgttataataataattctaatgcgtctataatactcgaagacatagctggtgaagtggaagagtctgctgcaactgtttctggcaaccctttctccttcgcttcttctgaaacctctcagatgatcatggaccgcatcatgtcccactccgaggtatcaccacgcacctcaggaagactctctcacagcagtggccctcttaatggctccctaacagatagccctccggtttctccttctgaaattgacgatttcaagtataaccgttccaacaacaaccacaacactgtcaacatgatcaccggcttgaatggtcaatactggggtgccggcggcgcggcgacgaccgccggtggtggcaagacggtggggaggtggctgaaggacaggaaggagaagaagaaggaggaaactagggcccacaatgctcagctccacgcggcggtttcggttgccggggtcgccgccgcgatggccgccatcgccgccgccacggctgcctcgtcgggctccaggaaggacgagcagatggcgaagaccgacatggcggtggcgtcagcagcgacgctggtggcggcccagtgtgtggaggctgccgaggccatgggggccgagcgcgaccacctggcctcggtggtcagctccgccgtgaatgtgaggtccgccggtgacatcacgacgttgacggcagctgcggccacagctttacgtggggctgccacgttgaaagcaagggtccttaaggaggtttggaacatagcagctgtgattcctgtggagaagaatttgggcggtggcagtggtggcggcgataatggtaatggtagcaatggtagctctaatagtagcttcagtggtgaaattgtaccagaagaaaatttcttggggatttgtagcagagaattgctagccagaggttgtgaacttctcaagcgcacacgcactgatgtggtgcttggagtgatcaaagatatgcctgcttggcctggacgccacttgcttgaaggtggtgagaaccgtcgctactttggtttgaaaacagtgatgcgtggtgttgtggaatttgagtgcagaaatcaaagagagtatgatgtgtggactcaagtgatggtcataggttcagatttaggtgaagtgaaaaggaatcctttgtttcctccttgtgctcctaagggtgtcagctatgaaaacttcttcaaggagtgtaagaaacctgcttggtattttctggccaaggattatggccattgtgacatgcaagatgatgacactattaggagatcaacgctctcacaaataaaattactcatacccataatggatgatgagaacacaacaaagattatactgtag

SEQ ID NO: 10066 - DNA, 1497 bp, Glycine max
  Peptide Sequence Number=SeqID_101751
atgcctcataatccggtttcacttgttcgtgatcacaacatcaaagaaaagctagtggaacttggtataagtgtgaaaagctacaatggggatttgttgtttgagccatggagtatatacgatgagaccggacatgcttttacaacctttgatcccttttggaacagatgcttgcatatgcaaatgaaagctttttcacttattcctcctcaattaattctagcggaaggaaaagttgggaaatgttcaattgaacaactaggtcttgaggatgaatcagaaaaatcgagcaatgcattattaggaagagcatggtatccaggttggaacaagactgacaaggctttaaccgaatttgttgaacagcacctacttcactactccaaaaacaggttaaaggttggtggggattccacttcactcttgtcaccatatattcattttggagaactgagtgtgaggaaagtttttcagttggcacgtaccaagcagatattatgggcaaatgaaggaaacagtgctggtgaagagagtgcaactgtttttctcagggccattggacttagagagtactcgcgctatctttgtttcaatttcccatccaccatagagaagccactgcttgggaacttggcatttttcccttggaagactgatcctgccaactttaaggcttggagacaaggtaggactggctatcctttggttgatgcaggaatgagagaactatgggcaacaggatggatacacaacaaaataagagtcatagtttctagtttcgctgtgaaaatgttgctcataccatggagatggggaatgaaatatttctgggacacacttttggatgcagatcttgaaagtgatatcttgggctggcagtacatctcaggctgcttgcctgatggccacaagcttgagcgcttggacgatcctgcgattcatggggctaaattcgatccagaaggtgagtatgtacgccaatggttgcctgagttggcaagaatgccagctgagtggattcatcacccttggaatgcaccccttactgtgctaagagcatcaggagttgagttaggtcaaaactatccgaaaccaatcattgacatagatcaggcaagagaacaattgactgaagcaatattcaagatgtgggaaaatgaggcagcttcgaaaggatctggctcagaagagagacatgaagttgttgatgagagtgaaagtttggccattccaaaagttttcttgaaggacaaggtttcgcacatcacttcttcatctaatgatcagaaggtgccaacacttgataatccccagattgatcctcctaatagaaagagaccaaaatgttcggcagaggtcgagcagaagcagaataattcgcgaaatcttagcaaggataccggggtgtcaagcattgatcaagacgtgtcctccacggctgaatcttcatgcaagagggagagttcaagctcttattcattctctgtcccacaataa

SEQ ID NO: 10067 - DNA, 1419 bp, Glycine max
  Peptide Sequence Number=SeqID_101752
atgaaggttggacacaccattgcttgctttgatgacaaacatactttagaggagccttatccagttgtacttccagtgatagagctaccttacattttatctactctcttagcttggactttcactggtcttctctacatatgcccagacaaacctcctaagatgtcatcaccagtcaggcatgcatccttccttcaaatggtcaagatcctggctgcattagaaattgttcgtcaaggtgcagatgtgatgccaaagagccagcttaatcaagttttaaatgctgaattaggtcctggctggtcatcaaaattaattagttttgattatgaacctatagctgctgcaagtattggccaggtgcacaaagctgtcatgaaggatggcatgcaagttgcaatgaaaattcagtaccctggtgtgggagatagcatcaatagtgacattgagaatgtgaagcttcttttaaactacacaaatttaattcctaaaggactttatcttgacagagctataaaggtggccaaagaagaattatctcgcgagtgtgattacaagttggaggcagcaaatcagaagcggttccgagatcttcttactggcacagacggattttatgttccaatagttgtggataatatttcaagcaaaagagtattaactactgagcttgttcgtggaattacaattgacaaagtggctttactggaccaggaaactcgtaattatatcgggaaaaagttattagagctcacgttgatggagttatttgtattccgggactggttgaatcagttgacaaggcattattcaacttccggtcttcacttggtagctacacagtacactattagactactggagcctaacacatattatcaccttttttctctctccaaataccaaactgatcctaattggggtaatttcttatttgatgaagttacaaagacaatcaatctgattgattttggagcagcacgggattaccctaaaagatttgttgatgattatttaagaatggttctagcatgtgcaaatggtgatagtgatggggtcattgagatgtccagaagactggggttcctcactggaatggaatcagatgtgatgctagatgcccacgtccaagctgggtttattgtgggcttgccattctcaagacctggtggatttgatttccaatcaaccaacattactcaaagcatttctcatcttggggcaacaatgctcaagcacaggctcactcctccacctgatgaagcctatagtctacacagaaagctttccggtgcttttttggcatgcattaagattggggccgttgtcccatgtagggaactgctgcttgaagtatacaagcatcataagtttggtgaagaaaatgagatattatccactggttcagtgtctgcatag

SEQ ID NO: 10068 - DNA, 579 bp, Glycine max
  Peptide Sequence Number=SeqID_101753
atgaaaggaatgagaacctatgactatattctagccatgaaagaagagaatgaagccatggaattggaatcattcgatgattctgatttctcttcagatgagagctttgattttgactcacctgaaaagccaacactaatgtcagggtttctatgcaaaggaaaccagttgaccagagagaaagccctactggcagctgagaaggccagggaaaggattatgagagaaaagccaatgggtgaacataattcattaaaacctcttccattggaaacaaaatgcggaccattgatgaatacatataaaaatatggacactgaagattttggctcaacatcttttatagcaaaaggcagacttaacgaatcaccaggaaggttttcaagcccaagaaggagattttctgctggttcaccaacggtgttctccagcagcatgatggcatctccacatcacaaatatagaagcagcttcgacttgaaattaactggtgtgtccagggagctcgaaacacatatttcaaggcaggttctttgttcagtgatcagcaaagatgatagcgaaccatccccaagataa

SEQ ID NO: 10069 - DNA, 2919 bp, Glycine max
  Peptide Sequence Number=SeqID_101754
atggcagcgtcttcgctctgttcctctttcacctccaaaacgtggaacccgcacgcgcgctatcaccacaaaaccctagcacctccctattccgcctttcttcgcggagacctccagctccatccaccttcggtttccggaacgcggcggagaaggcgccgccgatcgggttcggtggcgtccctcggaggcttgttgggcggcatcttcaaaggcgccgatacgggagaagccacgaagcagcaatacgctgcgaccgttaacataatcaatggattggaaccggagatttctgctttgtcggattcggaactgagggacaggacttttgcgctgcgagaacgcgcgcagcatggccagtctttggattcgctcttgccagaggcgtttgctgtggtgagagaagcttcgaagagggttctgggccttcgtcccttcgatgtccagctcataggaggcatggttcttcataagggagaaatagctgaaatgaggaccggagaagggaagacactggttgctgttttgccagcttatttaaatgcattgagtgggaagggagttcatgttgtaactgtcaatgattatctagctcggagggattgtgagtgggttggtcaggttcctcgctttcttggattgaagagtgtcgaagatcttgtcataaggggtttcaattactgtatcattgatgaggttgattcaatccttattgatgaagctagaacaccgcttattatatctggacctgcagagaaacccagtgatcaatattataaggctgcaaagattgcagaagcctttgaacaagacatacattacactgtagacgaaaaacagaaaacagttctactttctgagcaaggttatgaagatgctgaagaaattttagctgtcaaagatttatatgatcctcgagaacagtgggcttcatatatcctaaatgcaataaaagcaaaagaactatttcttcgagatgtaaactacatcattcgtggaaaagaggtcctaattgttgatgagtttactggtcgagtcatgcaggggagaaggtggagtgatggccttcaccaagcagttgaggcaaaggaagggttgccaattcaaaatgaaactgtaacgctggcttctatcagttaccagaatttctttcttcagttccccaaactttgtggtatgactggcactgcagcaacagaaagtacagaatttgagagcatttacaagcttaaagttacaattgtgccaacaaacaaacctatgataagaaaggatgaatctgatgtagtttttagggcaacttcagggaaatggcgtgcagttgtagtagaaatctctaggatgcacaaaaccggtcgcccggtgcttgttggcaccactagtgttgagcagagtgattctttgtcagagcaattgaaagaagctggaattccgcacgaggtacttaatgcaaaaccagaaaatgttgagagggaagcagaaattgtagcacagagtggtcgtcttggggcagtgacaattgctaccaatatggctggtcgtgggacagatataatccttggtggtaatgcagaatttatggcacggttgaagcttcgtgaaatattgatgccaagagttgttaagccatctgaagaaggctttgtatcaataaagaaacctcctccctccaagacatggaaggtgaatgagaagttattcccatgccaactatcaaataaaaatgttgacatggctgagaaggctgtgcaattggctgttgaaacatggggcaagagatccttaactgaacttgaagcagaggagcgcctatcctatacctgtgaaaagggtcctgctcaagatgaagtcattgccaagctgagaaatgcatttctggaaattggaaaagaatataaagtcttcactgaggaagagaggaagaaggttgtggaagctggtggactacatgtagtaggcacagagcgtcatgaatcacgtcgaattgataatcagctgcgtggtcgaagtggcagacaaggagatccgggaagctcacgctttttcttaagtcttgaagataacatatttcgtatttttggtggagatcgaattcagggcttaatgcgagctttcagagttgaagacctacctattgagtccaagatgttgaccaaagcattagacgaagcccaaaggaaagtggagaactatttctttgacattcggaagcaattgtttgagtatgatgaagtacttaacagccaaagagatcgagtttatacagagagaagacgagcccttgaatctgacaaccttcagtctcttcttattgaatatgctgaattgacaatggatgacattttagaagcaaacattggttctgatgctccaaaagacagctgggatcttgaaaaactaactgcaaaaattcagcaatattgctacttgttgaatactctatcccctgatttgctggggaacacgtgttcagattatgaggaattgcggaattatctccgtcttcgtggtcgtgaagcctacctgcagaaaagggatattgtggagcaacaagcagcaggcttaatgaaagaagcagagcggttcctaatcttaagcaatatcgatcgcctgtggaaagaacatttgcaggcactaaaatttgttcagcaagccgtggggttacggggatatgcgcagcgggatccacttattgagtataagcttgaaggctataaccttttcttggatatgatggcacaaataagaagaaatgtcatatattctgtatatcagttccaacctgtgctggtaaagcaagatcaggacaaaacagagaatcggaaatcaggaaaacgtaatattgcacgcactcaggttaatccaaactctgatccagttggcactgtcgagccttcaacatcaagtactacttcctaa

SEQ ID NO: 10070 - DNA, 3123 bp, Glycine max
  Peptide Sequence Number=SeqID_101755
atgacgttggtgttgggttacaagtgtgaggtgaagtcccacatcgggtgtaccctcgaatctccccaacagtgttggcattggcgtgcttggtggcgagggcctgggcgatgccagaccgctaacgcctccatcaacggcggggggggggagtctccggttttgggccgagactcggtggactcctcggcgatggagcagcggagaatagggttagggcgagagcgagggaattttcgagtgggagaggtgaagaaggacgttggggaaagggtttggttaggcgggaataggatgtcgttgaagacggaaaccatggcgggcgcgcagtggagaataaggaagagttttagcagcaatatccatccgtctagccagacaaggaaaatttctgtaggagttatggcagattcaattggttgcacaagaaatggagccacgaaaggggatggggctgtcgtgccaaatactgaaagggtaatctctaatgtgagaaattgccctggagaaaagagccaagttgaaggagtgacaccttccttcaatatgaagcaaactgggggtccaagagaggtgaagtgttcttggttctctaaatccttctaccaaagaacacctacttctgaggccattctgcaagccaatcaagactctactttactagtctctcctggtggctgggatgagcctaatggaatagaatctgcagctgggaaacacaacgttcagtttttctctcatcagacttcagtttttgcttctaataattacaagaagtttgatgcggacactaccagaatgaagggaaggaaggacgggaccactgaaaaggaaaagcaatttacatttaccactgcacagcaagtcctagagtctgacaaaaccgatctagaagacaaaataaatagagcagaaaacagaactgagaatttgaggatgaagctttgccaaatattggggaccacttcttcccctaagagtagccattcaggttctcatgctcataacacggaggaggaaagtttgccacttgagcagcatttgaaccagaaggaaaataaatccactaagaccatacaaaattcggatactatagaaactgattcagaaaatcctgatcatactcctcagaggccagtaactcgttctttaagcagaaagagagcgtattccaaaaagcaaccaggaaaaggtaaaagtggcccatcttcaaaaaacacagagaagcttggagaaaaaagtatattctcttttgaggaaaaatggactggaaggcaaaatgcttttccaaatgatggttccttgaagaaaaagagtcaaagaaagaattctaaaattgggaaaaataagatctgcttaactgaaaatgacaccacagataaacttcatcaaggcacttcgaagactgatctaccattgcatgacagaacaacattttcacttgggaagatagcggggggatttagctcacctgaatatcagacaaaacaccctcagacagagaacacaaaccaggaaaaagaattttaccagccaccaatagtatatacagataagcatggagaagttgaggtttcagaaaatggaaaccagcaagaatatagaagcaatccagttatacagaatgttgctgctaagtcacaagatgattttccaagtcctacatttcaacttaagtcacctattttaagtttttctcctaactcaacaccaaaaacaggccaaaaggaaactgatgttaatagtctagcatcaactgaaaggacattttctctgggaagcattcatagtttaagaactccccaggcttcagagccagacttcaacaggctaggagaacaaatgcaactttctgtatccttatcacaccaaaggtctcaagttgataattttcagtgttttggccctgaactggaaatcttacgtttctgtcttttgccattccttattagatttcaggatatggaagaactcaagtcttttattcccagaaaagacaaatcttctgagacagagaaaaaagagcagggtggtggttcatctgattcatcatctgaagaggagaactttcaaggatatcatgaagggacaggagacagtgattggatcgatgaagcttctgagcagaatcaagatgggtttgtaagggctgttgaactgttagccttggaattgggcaaacttcagagcaaacttaagtcaatgacaagtcagaaatcctcagaaattttgaagtctgttgctgaagaaatacatctgcagttgcagaatgttcatacccagattcagacagacatgagcactgttgaagatcttgaagcagatcagatagagatcaagagagccatggaaaagcaaagtatgaaagcacgggtcaccatgtattacgcaacaaaaatcgtggacagttatgatgttttgggtaaagttttgactggccaccacttcgtgaatgatgaagaaccagaagatgtagtgaaggaaaagcctgctcgggagggcaccggagtcaaaagaagtaggaatgcacaagttcataatttatgtgaaaggaagcgaagagataagatcaacaagaggatgcgtatattgaaggagctcatacccaattgcaataagacggacaaagcatcaatgcttgatgatgccatcgaatatcttaagaccctaaagcttcagatacagatgatgtcaatggatgctggattttgtataccttttatgatgctacgtaatgctgctcatcatatgatgaacacaccccttttacatcagttaatgggacttggaatggggttcaggccagacacagccataccttgtagcctccctcagttccctattacacctttgcctgccatcactgacaacagagttcacttttttggtttccctaaccaagtgccacccatgccaatttctcatgcacctttcattccaatgcttggaaatccttctacacaaacccctcttgcaactagcacagctatcaacctggcagaaaaccctgcttcttcccagttaacaactctaatggcctcagtccccaagaacttgtatctaagtgggcaatctgaatatgcaacaaagcaagcaccgagtcaagtttcccttcaccactag

SEQ ID NO: 10071 - DNA, 543 bp, Glycine max
  Peptide Sequence Number=SeqID_101756
atgggcaaagcctctagttcttcctcctcttctatctccagctgcagaaacccttccaattattcaactgcatcctctctcacacaccaacatagtgatcaagaccaccttcgcacagatcttaggcttggactaagcatttccactactcatgatcaacatgttggctcttctagttcaggggggcactggcaaccgatgcagccacatctaagtagtttttcacaagctactgaagtgaatcattgcagtgatcataccagcttctttgtgaaggtgtacatggaaggcattccgattggtagaaaactcaacctgttagctcatgatggctaccacgagttagtaaagacccttgaacagatgtttgacactaccattttgtggggaactgaaatggacggagtgcaaccagataggtgccatgttctaacttatgaagatggagaaggagatttgattatggttggggatgtcccttgggagatgttcttatcagctgtaaagaggttgaagatcacaagggtggagacattcgggtga

SEQ ID NO: 10072 - DNA, 1422 bp, Glycine max
  Peptide Sequence Number=SeqID_101757
atgaggcattctcatattttgacactagcattgtccttatattttcttgctttatttcttcccacccaagctaggcaccattaccacaaaaaacacaagcactcatattatcataatgcacctgaaatttcaccatctcctgctcctgcaccttctaatgctcctgatgatgcttctagtcctagcccctctggtaacgagaactaccacaatgcatccagtaacttattcgatgtacgaacatttggggccattggagatggaataactgatgatacagagtcattcaagatggcatgggacactgcttgcgaaagtgaatcaccggtcaaagttatccttgttccccaaggtttctccttcgttattcaatctactattttcacaggtccttgtaaaggtggcttagtactaaaggttgatggcactcttatgccacctgatggacctgaatcttggccaaagaacaacagcaagcgtcaatggcttgtcttttatagaatcaatgggatgtcacttgaaggaagtggtttaatagatgggagaggagcaaaatggtgggaccttccttgtaagcctcataagggacctaatggaacaacatctccaggaccttgtgacagcccagttgccataaggtttttcatgagttccaacttgactgtacaaggattgaggatcaagaacagcccccaattccatttcagatttgatggctgcgaaagtgtccacgtggaatcaatttacataaccgctccagcgctaagccccaacactgatggaatacacatagaaaataccaatgacgtgagaatatacaattcagtcatttctaatggtgatgactgcgtgtccattggagctggttgccatgatgttgatataaagaacatcacctgtggacctggtcatggaattagcattggtagtctgggaaatcacaactctagagcctgtgtttcaaacattacggtgagggactcggttataaaagtggcagataatggggttagaatcaagacatggcaaggtggatcaggatcagtatctggtgtgacattcagtaacattcacatggaaagtgtaaggaaccctattataattgaccagttttactgccttagtaaggattgctccaacaagacctctgcagtctttgtaacggatatagtttacacaaacataaagggtacatatgacataaggcatccaccaatgcgttttgcttgcagtgactctgtaccatgcaccaacttgaccctctcagatattgagcttcttcctgctcaaggaaacatagtgctcgatcctttctgctggagtgcctatggaaactctgagacactaacaattcccccagtcttttgcatgctggaaggccttcctcagtccatttcaggcaatgacatagatcattgctga

SEQ ID NO: 10073 - DNA, 168 bp, Glycine max
  Peptide Sequence Number=SeqID_101758
atgggtctatatgcaatcactgaaagagagaaagaggtacttgaagaagacgagaccgcaagcaagttgaaaaggacatggctgctgctaaaaagctcaataatacctatttcgtttgaaaaggacatggctgctgctaaaaagctcaataatacctatttcgtttga

SEQ ID NO: 10074 - DNA, 117 bp, Glycine max
  Peptide Sequence Number=SeqID_101759
atgatgcctccggatactacatctagaatgagaggcatcatatacaaataccacatgtgccagcattgcaacgatactaggatgacgctttctgcaaaagggcaaaagcaaaaataa

SEQ ID NO: 10075 - DNA, 1443 bp, Glycine max
  Peptide Sequence Number=SeqID_101760
atgcccaccgaatccattaaaactaaaaaatcttctaccacgaacacttgtcttcattcttcaaccttcgtttcgtttctaccactccattccagaatgcttcgttacctgttggtgttcttcttattgggcttgggaacccgggtggagtcacacgaggaatcgggtcattggagctgcgagtccgagtcggagatccgagtcgagactgagttcaaacccggtgtaatcacactggatggtcacgctgatgattggaaggacattgatgggtcctactttcccctccttcccgcccttgacccagatgctgaaaatgaattcaaagggggaaagatgagcgttaaaagtgtccatgatggccgcgatatcttctttctgctgcaagtagatggtgactatgcctactctaaaggtgaaagcaataaatgtccatctgttgctctcatgtttcaaattggagatagtgcctcttatcatgatatgggtggctgtaaagaacattcgacctcatgcactgacaagacctgcaaaggtcatgaagttgacattatgcacttttcgataggaagtgctattccaggacgactttacggtggcaatcccctagacaatagagatgggaatggtggcgataggtttggtcacttggttgatctatatgcttggaatccacattgtagatacttggatggaattggtcctccaggttctggtggtggttgtgtcggcaacgataaccgtgataatagcggtgacaataataataacgatggtggtggcgatgatggtattgatggtggtgataatggtggcaatggcgatagcggcgacaatgaaggcaacaacaatgacggtggtggtggcggcgacgatggtggcgacaatggtaggagtgacaacgccagtgatggtgatggtgatgatggtggtggcgatgatgacagtgatagtgatggggttgctaatgattcaagtgcgcagaatgactggaaaggtgcttggtggcatagcagcttcacagttcactcaggattcgtagaggatgagagtccatatgcagataatggaaaaaagggcacatacttttttgaattctcgaggtctttgaggactatggatcatcttcaacaggacgtgcaatttaacattggtggatccagtaagatgtctgttgcattctggtatccagtagatggtcaaccttggcatggttctgggcactactctgtttactgtgattgggttcccattgacatatctgttggtaaatctttgaatggcaagtcagtagatgcagcatcaaatagctcgtggaatgttgctagtgccttttctgttatactatcagtagcagcactttgtgtgtctgtttttgtgagctatagggtgttcagccccaagagtgtctcttttacaccgatagagaacaacaacctttaa

SEQ ID NO: 10076 - DNA, 1614 bp, Glycine max
  Peptide Sequence Number=SeqID_101761
atgggaagtgatcctttttcctccacgcctttcaatttcaacgaattccagggcggttatggctctatacaaagagaggatgttgtactccaaggggaacacggtttctcttcaacaatggagtcactaagagggagaaataatttacctacaacttcagagcaaaaccagaagcagcaacatgatctcaattttgatcccttgatgatcgaggagttcaactttgaacctattcaacaaccaaagcagcctcttcaagaaactaaggaaccaaagaagaataaacaggttctgccatcttctttagcatcactggagctcttgagcaattatggaagcaggttcaagaggctagggaagcaaaacatcagcgatagttctgttcaaacttgtgtgggtcctcagaagttgtcaactgaagaaataatgagattggctggagcaaggtacattcagcactctacacaattgtgtgatgatgtttgcatccccgtgcacccttatggatttggtcttggagttttatcccaggaagaaaatagagacatagaactcgctcagtttcttctagcagctgctgagagggtagggtgccaacaatttgaacgtgccagcattttactctcctcccattttcagtggaactcttcaggtgatggtgccgttcagagagttgtctttcatttcgctcaagcattactagagagaatcagaagagaaactggaggaaaggtgacactgaacaagtgtgagaaaaattgtgaaagggaaatgtttgagaagttaagatcggatactaacatggctgttacatgccatcaaaaaattcctttcaatcaagagatgcagttttctggggtacaagctatagtggaaaatgtaacatcaaaaaccaaagttcatctcataaactttgatattggatgtggggtgcaatgcacggctttgatgcaagcactggctgagagacaggaaaagcaagttgaacttctgaaggtaactgccattggacttcaaggcaagaccgagctagaagagacagggaaaggcatcatagagatcaaggtagagcaatttggcattgaagataatgaagctgtagctgtatattctccttatatgctgaggactatggtgtcggattctgattccttggaacacttgatgcgggtgatgagaaaaatcagaccaagtataatggtagttcttgaggtggaagcaatgcataattcaccctcctgtgtgaatcgcttcattgaggcattgttcttctacgcagcattttttgactgcattgggacctgcatgaagcaggatcatgaatgcagaatcagaattgagggaatattatctgaagggatacgaaacattgttgcaatggaagatggagaaaggaaggttaggaatgtgaagatagatgtttggagaaggttctttgcaaggtatagaatggtggagactacatttagcgagtcatctttgtaccaagctaacttggttgccaaaaagtttgcgtgtgggaatttctgtactgtggatagaaacgggaagtgtctaatagttggatggaaggggaccccaattcattcaatttcagtttggaagtttctttga

SEQ ID NO: 10077 - DNA, 294 bp, Glycine max
  Peptide Sequence Number=SeqID_101762
atggcttcaaggggtgagccctggtgcaacagtaaggctctgttgccttatgacttggaggttgtgggtttaaatcttggtaacaacctctctccttgctggagtaagactgtatatttattgaccctcaccaaatcacaactctcggtgggagcctcatacactaggctgccctttttaatatatggcttcaagtttatcttgtttgcgcaaaatggaagatttgtctgccctgcacaaccaatgtccaatgagccaggagatctgtcttccattattggaattggaaaatga

SEQ ID NO: 10078 - DNA, 669 bp, Glycine max
  Peptide Sequence Number=SeqID_101763
atggattcgaggaagggcaaagcttctgtttctgcatcttcactgagtgctgcacctttgagtgtttcaaataaggtggatcagatggtgtcgccccctagggatgtgagagctgttgagactgatgtggatatagaccttagggaaatttactttttaatcatgcactttttgtctgtcgggccatgccataggacttttctaaatttcaaggaggaacttttagagcatcagcttctacctagaagatatcatgcttggttttcaagaagtggtgaacccagtggggatgatgcggatgaagatgatgatggcatctctttacctttagattacagcaatctagtgggcaggtatcctcacataactaaggatcatttggtgaagcttctgaagcaattgatgctgagtacggtcaatcctttgcatggaaaacttgaaggaagtagtcctaatgcagctgatgttcctactttacttggatatggttcattttcgcttcttaatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10079 - DNA, 339 bp, Glycine max
  Peptide Sequence Number=SeqID_101764
atgcgccctctgcagctccgaacgcccgcacccgcgccgcaacccgatgagcgcgtggtagtccacgttcccggtgtccccggaagcgatcctctgtttgagttcctgggtttttacggtgagagcgcagagcttcccggggatttctctgtagcgtacgctgtggtggcgcttcttccaggtggggcccgcgagcttgtggtcccggaggatggtgttgtagaggagcttgaggtgttcgaggtcgtggagggagtctgggaagcaccgaatggattcgaggagggaggctcgggtttcgagggcgtggatgcaggtggggtccagggcgagggttct

SEQ ID NO: 10080 - DNA, 477 bp, Glycine max
  Peptide Sequence Number=SeqID_101765
atggattgtttggatgaagggttctctatcaagatgggagagagagtctggatattttgtatgactcttgggttcttaaggaaccgatggctacttaggtgccttgggtggatattcatgatgtggggtatacagtccaagacctttgggaggaagatggttggaggttggagaagctttaattacactttgcttcctgatgatgttaagcagaatatcctaaccttgtgccccaagtttgttccaagcatgcctgatttggatttggaagctcccccttcaggcgaatgttcagtttttcttgaggtgcttactgggagaggcattaacgtgtcgtctttatgccctaggtctgctgggtctgggttggatattcttcaaggagggatgggggatacgtccttgttgggttggttaaggaggaaggaatctgttgtggggagtgtttgcattcaggttcagtcaagagacaaatga

SEQ ID NO: 10081 - DNA, 570 bp, Glycine max
  Peptide Sequence Number=SeqID_101766
atgtaccagcgtcctgtgtacataagaaaaaaggagtgtagtgtcaattctcctgactatggacccttgcctccagatccacctggatggtgccttgcaccatttgacccagatgggccacaagcagagggtattctttggtcggtgttttccttctctctattgctcgtaggatacattctggagattttaggaatgcctttatcaaaagcactgtacacattaagctacatgtgtatcactgcaggggcatcaggcttagtcgtgactgctatctattacattgttgacatagaacatctcagaaagcctacagttttactgcaatggatgggaatgaatgctcttgttgtatatgcattggcagcttgtgacattttcccagcagttatccagggtttctattggcactctcctgaaaataatttggttgacgccagtgaagctttaatgcagatcatatttcattccaaaaggtggggtacactggcctttgtaatagttgagattatattctggggtcttttggctggtttcctccacaagaaaaggatatatataaaattgtaa

SEQ ID NO: 10082 - DNA, 156 bp, Glycine max
  Peptide Sequence Number=SeqID_101767
atgaagtatacattatcatcgacaggtatacgaaaatggaagtttacatggaatgcgaggtcaatgcagaaactagttccaacgagcaacggctacttaacgtctatgctatatatacactattatatgaaaagtgctaatgttcctaatgcttga

SEQ ID NO: 10083 - DNA, 918 bp, Glycine max
  Peptide Sequence Number=SeqID_101768
atgacgtctccatcgcctcctctgccaccactttcgcctttggtacccatacagccgcggcccacaaccttgtcgggcccgcttcctatgcctgttcttcatctatccggtcttgttcgcactatcatttccttcaacaaactcttcagcattgtttctccttgtgggactgccatggctacatacaagcttccattaacgatcgttgcattctgcgcacctgctaaactaggtgcaattcgccggaataaaccttgggaccccggtatcacttttggaagcaatgcgtttatcccccaacaccttgaggataatgtgtttttgatggggctgggagtgataggtgctgaccctcaaagttcagcaacaagtgcagcacgtaacaagtgtgctcaagtacccttacctagcatcaggctaatggaagaggatctcaagttccagggtaaacctatccttctagtggtgaaaccccaaggtaccatgttgaacgatgatgccttggacatcattttcgaatggggatccacgcattccctttcaggaaatccgaagcttacctacttgctcagaaatggaaatgcttacttacttgctcagaaatggaaatggttctggcatgaggccaagaaaacaaaccttcatggtatacaagtgaaaggtgataggtatatcttcagtggagccgagaattcactgcggcagtggataaaaataaaaggcacgatatacacaataaggagggcagatgcaataatagactattaccatttaggaaaggaagaccccaagatagttcctcgattctggattggcatagaaggcaagaggcaaaagaagcactccgagaatttggactgtgattgctctgcctcaagcaaagtggaaagaaagagtgctcctgaaagaaggctttga

SEQ ID NO: 10084 - DNA, 270 bp, Glycine max
  Peptide Sequence Number=SeqID_101769
atgaaactggccaaatacaggctaaaggcccaagtggagaaggacgaaggcccaagtggagaaggacaaagcccccgagtggagaaggatgaaggcccaagtaatccttgtggcgtctatcctgacttatcttccttcattggaagtggcgtctaccctgacttatcttccctctttggaagtggcgtcatccaaatctctgtaacctgtatcaaacaatccgctcctactcaggttcacatcatctggtatcagagcttcggctcttga

SEQ ID NO: 10085 - DNA, 372 bp, Glycine max
  Peptide Sequence Number=SeqID_101770
atgttacgaaactttacggattacgcaacaatgctctttttgacttcgggaatgttgcggaactttacggattgcgcaacaatgtttcttttttacttctggaatgttgcggaactttacggattacctaacgatagggaacaagctaaacatgtattttatgttcaagacccttgtgatgaaaggtggtcagtggttctaaacgggaaaacaattggtgttaatgtagaagatgatgattcatacattgatacttatgttagtcctttgtccacacaaatgtcacctaacatcgttggagaagaagaagctgacgacgttcgtgctaatcgtaatgatcatgatgaaggagaattaattaacatcgtctaa

SEQ ID NO: 10086 - DNA, 369 bp, Glycine max
  Peptide Sequence Number=SeqID_101771
atggcgaacaatccttcaagaacacagaagaaagaaaaaacctccaagaggaagcaaggtgaatactcacaagttgctctcaaccatttggacacatggttcacaaatggaagcaagaaaaatgactacaagatgatatatgaattgtcaaagctggtacaaatgaaaggaactttttatccaaagctagtcaaggttttctacacccctttcattgagtacttcaatattgatgtctctaataagattgtggactttactaaagcatctagtgagatcaccgaaaggcatctcaagaagcttgggatgagatttattgatgatgaatggataatggttggagagccggcagctggaaactttgactag

SEQ ID NO: 10087 - DNA, 563 bp, Glycine max
  Peptide Sequence Number=SeqID_101772
cacccactgaattaacccatgagagtgactcccaccacaaggggaggaccttactgcaattgaagaaaaggtgtgctgcaacctcctccgaattgttgcataacgggaacattgggtcacttatctctacttgtctccctcttagattcatcttcattggtaagcggtctttgataagccgccatgtaaataccgctgccttaggtggtatcttaagtttccacaaaagcacaaaaatcccatcctctgtgtccccccttatttcctctgcttctattataattcacgcttgtccttgtccttgtgctggcgagggtcacaggtgcgctttccaagggaggaaagatgcgtggagtcgccaccaacatttatttgtagaaaatgtcagaaaaaccgaaggaaaccggtcaaaaagaaaattccaagttcggaagttgtatttgcgtttgaggaaggtcgacaaaagcggagctcttgctcctacgtaccctccatcgaagaggaaatcagacctacgtagttcttctttaagggtgaatcaagcgattctttttacttggaag

SEQ ID NO: 10088 - DNA, 897 bp, Glycine max
  Peptide Sequence Number=SeqID_101773
atggcttctaggaagagaaaaagcattggtacaaggcccacatctcagtatggcacaaggagattctcttcattagatgcttggactagatacactgataatgttctgggaagaaacattttacctgagaggaaagtagagttatatcacattgagctagatgactttaaggtcgagctagagagacgtaatttccataaatgcctcaccaatttagccgatgggagcatagacctagctttggtgaatgagttctatgcaaatttatacagttctgaggagcgtccaccaaagaatctcaacacattcctggagacacctgtggtattagctgagggaaagactctacccgcctattccagatactgtaggttgcttatagacttcagagagatagaggctgccttatgcatacctggccgagggttcattttgaactctgagggccaacctgggaggattatcgggaaggatctgactacactagctcaggtgtggagtgtcctctcatactccaacttggccccttcatcgcatacctctgatttgacagttgacagagctaggctaatctttggcctagtatctcacttggatatgaacataggagcactgatctctggccatatgacctctatagcccaatctaacacctctagacttgggttccctgctttaatcaccgcattatgcagagccagaggggttgtctctgacagccttaccttcgagcgcctgagcccggtcattaacctagcctacatcaggaagaactgttggaaccccgaggatctaacagtctctatccgaggggctaggagggcgagggcaaggccagctgagcttccttctacatctgcagcttctactccagcatccacttcagcagccccttct

SEQ ID NO: 10089 - DNA, 297 bp, Glycine max
  Peptide Sequence Number=SeqID_101774
atgaatccggtcaacctgttgatccaaagcaatacagagtgtagcattattgatggaagcttgcttgtggagcttctatggaggctggatcttaaagcttcaatgaggtcctttaatggtggttttccaccatggagatgcagcggaagacaaaggagaagaggtgagaggaggcgccatccactagggaataagccatggaagaaggagcttcaccaccaagataagccttggataagaagcttggaaggatgcttcaatggaggaaaagaaagagggagagaagtggaactttga

SEQ ID NO: 10090 - DNA, 405 bp, Glycine max
  Peptide Sequence Number=SeqID_101775
atgaccatccagaatatgcaatttcaacaagagacaagagcctccattccgagtctgacaaatcagatggggcagatggctactcagttgaaccaagctcaatcccaaaattctgacaaattgtcttcacaaactgtgcagaatccgaaaaatgtgagtgccatcaccttgaggtctagcaagcaaattgaagtgtctccaccagtagcagcacctgtacctgaacctgtcaagcttcattctacacctaaaaaaaagggtgagctagctgcacaaaagagaaagcttccggatcatgagggagctaacaaaaattttcatgcaggtggaccttcttctagtagttctgacgtgcagcagcctcctatccctattccatttccacctagagcatcaatgtggtga

SEQ ID NO: 10091 - DNA, 234 bp, Glycine max
  Peptide Sequence Number=SeqID_101776
atggcaataactgaagctacagggctccaaatgagaggtgacgactcttctctggcaacaatttggatggcgatttgctcttaccttaagaacgggagtcaagagcttccccgattgctagccaaggccaaagcaatggcggacacctactccgcccccgaggagatccacggacttctcggctattgtcagcatatgatagatctaatggcccatataattagaatccgctag

SEQ ID NO: 10092 - DNA, 216 bp, Glycine max
  Peptide Sequence Number=SeqID_101777
atgtccaatcaaaagagcactgagtcatgcatcaagaatctagaagtccaggtgggacaattagcaaaacaactggcagaccgaccgtcaagcagctttggagccaacatagagaagaatcctaaggaggagtccaaggctattatgactagaagcaaaatggtgagcatgaatgaaggagagaagaggataggtgcagaaaaacaacaaatttaa

SEQ ID NO: 10093 - DNA, 183 bp, Glycine max
  Peptide Sequence Number=SeqID_101778
gtctcctatattcaatggtgtggattatcattactggaaaacccgtatgcaaattttcatagaggctatagatttaaacatcagggaagccattgaaattggtccttacatccgtactatggtagtaggaaatgcaactatagaaaaacctagggaacaatggaatgaagaagaaaggaaatg

SEQ ID NO: 10094 - DNA, 333 bp, Glycine max
  Peptide Sequence Number=SeqID_101779
atgggttctccacctgcctccactcctcctcctcctcttccttctcctccttctcctcctcctcctcctcctacttcggacgcatccgcttcgacgtctgccgtgaagcggacacgtaaagcctcacgtctacgatcgttgtccactagaccacctggtgctgagagaccagtggtgcatgttgatcctgctaccgggaaggccgacggtccccacaagaagaaattaataacatatttggggattgtggcacgtgataaggtggacatcacctacgagaactggaaggaggtccctactgctcagaaggacctgatttgggaggatattcag

SEQ ID NO: 10095 - DNA, 429 bp, Glycine max
  Peptide Sequence Number=SeqID_101780
atgaagggtggtgcaccgtcggaggaagtcatcacgcctttcattgcgcgaggcttcaatgaagctaatgcaaagatacttcaaaaaatccgtaaagcatggaatagagtgggaagaaaagataaggagcttagaggaagtagcaatggtgtcatcagcagctatcacatatggttgaagtctagaatgcaagggataacgtggctcccaaagctaaaaagtctaagtgggaaagaggctgaaattcttgaggaaagtgaagaagtgcaagctttgaaaacagagcttaaaaagacaagagtggtgaaagagaagctaaagacgacagtcattagggttaggaaggagtgtgatgagctgaaaggtatcaacatgaccacggttgaagcgttagagcgggaaacaaaaagggcccgaaaggaagaatga

SEQ ID NO: 10096 - DNA, 914 bp, Glycine max
  Peptide Sequence Number=SeqID_101781
agtttgatgagttcaaagaggaactcgagagacgccattgggatgagaagctgatcaactttttggatggcaacactgatgttgccattgaaaaagaattctatgcaaacctctatgaccccgaggacaaatcacctaagcaggtgagggtgagaggtcatttgattaagtttgatgaagatactcttaacacatttttgaagatccctgttgttgtggaagagggggaaacactgtgtgcttactctagatttgcactcctgaggcctgatcctcaggagttagatgctaagctctgtatcccagggaggggattcgagcttaatgctgatggttatcctttgaagattctgaggaagaacatgactacccttgctcagccttggagcgttctttccttttcaaaccttattcccacttcccacacttctgatgtcactctggatagagccaaactcatttatggcatcattatgaagatagacatgaacctggggtacctcatttcccaccagatctctctgattgcacaacatgacacatccagactaggattccctgccttgatcacaactttatgtaaggctaggggagttcagtcagatttgaggaccttggagagcctgagtcctgccattaatatggaatatattaagaagaactattggaatcttgatgatccaacagtaaactttagaggactcaggaaggccaggggtaagagatctgaggccccttccacttcagcaacatcagaggtaccaacaccttcttcttcttcagtgcccccctcttcatccactcagattccactaattcctcctacaccgatacagatgccacttctaactcctctatctgcaggaccatcagatttcatttttacaccgaatatgcttcactccatgctctag

SEQ ID NO: 10097 - DNA, 252 bp, Glycine max
  Peptide Sequence Number=SeqID_101782
atgagtaaccaagtatcgcaacctaccctttggcgagagggtgacgcaaggttcacgggtgcgtcttccttgggagaaaaatgcgcggagtcgtcaccaacgtttattaaaagggaaacgttagaaaaatcaaaggaaaggaaaaagggggaggaggttgccgctcagctcgcccaggcgagctgggttgcttcctccagaagcaaccctgcttcgaaaatactattggaaggtccaaattcaaaattttga

SEQ ID NO: 10098 - DNA, 259 bp, Glycine max
  Peptide Sequence Number=SeqID_101783
agtggtacctggagatatgttgcgggggtcaggagaccttgggaacgtcaagtggggtgctattgcccaaaaccaagctttaccaatcccggcccaacccgggcatagtcagtcagtgagaacctgtgatgtacctaaacaggcttgtgtggcggctggccagttatgtatcttgggtgggcttaaaaatggagacaagaagttgaaatggcctctggtaatcgattaccaatggggtgtaatcgattacacatggtga

SEQ ID NO: 10099 - DNA, 360 bp, Glycine max
  Peptide Sequence Number=SeqID_101784
cttggaggggttgatggggacccggtgctgagaggaacgaggataagggctacgtgggggtatgtgagctctgttgaagagttgatttgcaccatctcccgatcgccacctagtaccacatatgacggagtggtacctggagatatgtcgcgggggtcaggagaccttggggacgtcaggtggggtgctattgcccaaaaccaagcttggccaatcccgacccaacctgggcatagtcagtcagtgagaacctgtgatgtacctaaacaggcgagctcctggcagtcaaccaataaaagaacaaagaccacaaagcaaggaggcttgtgtggcgactggccaactatggatcttgagtga

SEQ ID NO: 10100 - DNA, 588 bp, Glycine max
  Peptide Sequence Number=SeqID_101785
atggctaagtttgaccctgaggtagtcctggagttttatgctaatgcttggcccacagaggagggagtgcgagacatgcgttcatgggtgagggtgttggaggaaggccaggagtgcgagttcaaccagagtaggaacagggccgatgggttcgacgaggaggccaatgcccagctgttatgcacaccagagcaggatttcgctcggacaactgcagggaggcgggtgcggatcatgcgcaccagcatgaccaccttgacccagacgtggatgacattgctgctcagcaatgtcttgcctagcgatcataactccgatctccctctggcaaagtgtcagctggtgtatgccatcctaacacggatgagtgtccacgtggctcagttgattgctgacgccatctatttgtttgcatgtatgccacccaccaggcaccctctagacccggataagtctaacagggccctggggttttcggcattgatcacgggcctctgccagtcattcggggttcccgtcacccttagtaaagtgatccgaccgctgatcacctgtaccttcattgagaagtattgcacgcctaggtag

SEQ ID NO: 10101 - DNA, 723 bp, Glycine max
  Peptide Sequence Number=SeqID_101786
atggcagccaatgaccatgccatccttcgtgatcgagcctacccacctacaaagaagagtcttctcgagctcacatcacaagttgcgctactagcccagaacaatctcctagccaagcaactagagaccctcacagagacggtgagcaagcttcatcaacagttgcaggcagtgcaacctgcccattcttcagtcatgcacattagaggatgcaacatctgtggtggggcccatgagtcaggcatgtgcatggtccaagacgatgtatccaaagaagtaaactatatgaccaatccataccatcaagggttccatcaaggaagacctccaggatacaatcaggggggaatttctctcaaggccaaggtttctctatcaaatcacaagagactgagtctgccattaggaatcaagagggccaacacagagaagaatcccaaggaggagtgcaaggtaattttcattaagagtcggaggagggagaatgcagagagagaaaagagagctaagggagtattggaggatgtgagtaatgaggaaggagagaataataagatagaagagggtgatgaagagaaagaagagagcaaggaaaagggtgaaaaggtcttacccactaagaccaagagtcagttagcaatggaggctagaaaagagatacccttagtcccagtgaaggacatcccatatcccttggtgccatcaaagaaagataaagaatga

SEQ ID NO: 10102 - DNA, 282 bp, Glycine max
  Peptide Sequence Number=SeqID_101787
atgattcaaaggactaaccgcttgagaattctttgtcccaacacattggagggtacatcttttgtggtacaagtagagggtacatctacttgggggattgttatactgagaacaagaaatggtacatctcttgtggatcagttcaactggagggtacatccacttggtttttcaaagagaacaagggaggggacatcccttgtggatcttttggcttgtaaaggattttacatggttgaaagaaatctcaagaaccgcatattgcttgaggactggatgtag

SEQ ID NO: 10103 - DNA, 168 bp, Glycine max
  Peptide Sequence Number=SeqID_101788
atgggattaaaatcaagaactcacatgaaagttgtcatcatcaaaaagggggagattgtagaagcaaagcttcatggtgaatcaaaggtgattcaaaggtgttttgatgataacaatgatgataaaaaagatggtgacaaaggtgatgacaaaaagctcaaagattaa

SEQ ID NO: 10104 - DNA, 2964 bp, Glycine max
  Peptide Sequence Number=SeqID_101789
atggggcgtgggctccgaaggatgaagcagcggaaagaaacaaaatctttggattttgatggtgggtgtgaggccgatgaggccaaaaaaacgaccaatttcgccgaaaacaatgatgacgtggcagggggttcttcttcttcttctgatcgagaaggcgtgagaaagaagcttggcgaaaaaggtaaaaaggataaagaggatgtgaaagagaaggagatgttagagggcgatttgatggacaagaaagatgatgttcaagacgaaaatcgcggtagaaaaagaaagatgtttccgaaggatgacggtgagagtgaggccgatgagggcaaaacggtgatcaagtttgctgaaaagaatgatgatgtggcaggaagttcttcttctgctcaagagggtggaaggaaaagtaaagtggataaggaagacgtgaaaaagaagaagaataagatattagagggcaatttgttggacaagaaagacgaaaagggtggtgaaagtggggttgatagaaagagaaagaagcttaagagtgatgagggtgagattgaagtgcctgtttctactactgattcttcacaaaacggcgttcagaaactgtatagtcttagggcgcgtaaagacaatacacaagaggggatgctgctgccaaaagtcatcaagagaaattctgattcaccattcatcaagtttgttgaagaggagtccttaatgtgccatcaatgccagaggaatgataaagggaggatagtaaggtgcacaaaatggtatcctcatttgaaagaggaggatattgctcaggaatgtcctgtgtgctgtggtaattgcaactgcaaagcatgcttgagatctgatgaacctattaaaaaaatgaaaggcaaaacaaatactgatgaagatgacaagattgaacactctatgcatttgctgcaagtacttcttccgtatttaaggcagttggatgaagaacaaatgattgagaatgagatagaagctaagatgcaagggctctcggtctcaaagctaaatatagtaaagacagattatgcaaaagacgagcgtgtgtactgtgacaactgcaaaacatcaatatttgattaccacagaagctgtacaaaatgctcttttgatctttgtctcatctgttgccgggagcttcgtaatgggcagcttgtaggtggtgcagatccaattgagtgggagtttgtctttcaaggtcatgattacatgcatgctcaaaaagaaaaggctctaaaggaaagaaaaatggtaaagcaaaatgcatcaaatgctgatgctaagcctgaggttcgtgaatggtcaagatgtgggtggcatgcagaaagtaatggtaacattccttgtccaaaagtcaatggtgaatgtaaccatggtttccttgaactgagaaccatattaggcaaacattttatcactaagatagtgcataaagcaaacaaactagcacaggcattcactcttcaagatgtagttaagaaccctgacaacttctgttcatgtttgaggcttgatagaagcacagatgttatttataacaatatgaggaaggctgctttccgtgaagattccagtgacaactatttatactgtcctagggctgtagatctacagcccaatgatttaaggcattttcagtggcattgggaaaagggggagcctgtcattgtcagcaatgtgcttgactgtacatctggtttaagctgggaaccacttgtcatgtggcgtgcatgccgtcagataactaacactaaccatgatcaacatttggatgtgaaagcaattgattgcttagattggtgtgaggcagtaattaatatccaccaattctttactgggtatacaaaaggtcgtcaggattggcttggttggcctcagatattgaaattaaaagattggccgccttctaatttatttgaggaacgtttgcctcgtcattgtgctgagttcatatcttccttgcccttcaaggaatatactgatcctctcaaaggtgctcttaaccttgctgtgaagttgcctgatggttctctaaagccagacatggggccaaagacatatattgcttatggatttcctcaggagtttggacgtggtgattcagtgactaagcttcattgtgacatgtctgatgcagtaaatctgttgactcatattgctgaagtgaaattggaaccagagcaacttcctatcgttgagaagttgaaacaaaatcactttgagcaagacaaaagggagctactaagtgatgatcaggatggagaaactaatcataacgtgcttaataattcatcttctaccacaaatgcttcagacaagcaaaattgtgtacaagtcatggaaaatggaggtaacttatgtgatgggaaagaagttgatcagttttatcaaccctctggtggtattgaggttgtcgttgctaatgaggatggtctttcgtgcggatcagatctgaaagagattgacaaagtaaaaattatacaagaaagtgatttgtttaggggggatgcttcagaaggtgctctctgggatatttttcggagacaggatgtacctaaattgcaggaatatctgaagaagcacttcagagagtttaggcatattcattgctgtcctttaaagcaggttattcaccccatccatgaccagaccttctatctgactatggagcataagaagaagcttaaggaggagtatggaattgagccctggacttttactcagaagttaggagatgctgttttcattccagctggttgtcctcaccaagtcagaaatctgaagtcatgtattaaggttgctttggattttgtctctcctgaaaatgttggggagtgctttcgtttgacggaggagtttcgcacacttccaataaaccacaggtctactgaggacaaattggagcttgctggatgcttggaatatggcctgatatttttgccgtaa

SEQ ID NO: 10105 - DNA, 279 bp, Glycine max
  Peptide Sequence Number=SeqID_101790
atggatgatttacatggtacactagggtataatgggcagatagtgggttgctcaaggacggagaaaaagaaagaaagcggggaaattctttcaacgcaattggtagaggagaagacgaataacgaagagcacaaatttcttgcttcaagaggtactgacgtcagaggagaccatgatgatctcatgcctacgaagatagaggagtacaaagagttgttgtggcagttagatctttcatctaaggaggatgaggatgatcctttcgaggatccatcttag

SEQ ID NO: 10106 - DNA, 319 bp, Glycine max
  Peptide Sequence Number=SeqID_101791
ggaagatgaaggtcccacagcccaggtacctcagcatgtggaggatgagtcatttgaggccaccatcccagagccatttgttataggagaagaggcagaggagacacaggctacttcagagccttctgcacaaagggatgatataccctcacctcagcctacagcagacccctccactcctcttttagagatgccaaaggacctgactacattagtcctggctatggacacttctcctccagctactccagtattgcatctgacagatgaggaggatgttctgacacaggacacccaggaccagtcacaagaattttga

SEQ ID NO: 10107 - DNA, 192 bp, Glycine max
  Peptide Sequence Number=SeqID_101792
atgttagctatcatcgccaagtaccaagaagagttaggtctagccacggcccacgagcatagaatcgcggatgagtatgctcaagtgtatgcggaaaaagaggctagaggaaggccaaggccaaggcgatggcagacacctactccgcccccgaagagattcatgggcttctcggttattgtcagcatatga

SEQ ID NO: 10108 - DNA, 1122 bp, Glycine max
  Peptide Sequence Number=SeqID_101793
atgggatcaagtcaaaagccttcacttaaaaagaggttctatccagtcaaggtcaagagcctagggatcaccagtctaagagagttagggcagttgatgggtcagctccagcagcaagcttttcgtaaagcttacggtaaaatctgggacctagccatggtagaagtctccacagaggccattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaatagtccaaatctcggcgcaggaattagaccgccaaaagcaagtcgaaaatggggtggttaggaataccgagaaaatgtttggaggcaaaagcaagaatcttgcgatcgacgcttttctcgcctatcataaccacaaggaaagcccggttgtcactatgctagccgacctatatgacaccttcggccgaagatgtgaaaagagcaatacaaggattgtttgctgtactccagctctttatgcatggttagtttcacacctttttcgccaagaggtgaggcatgcttgcccactagaaagccaccgttcatgtacagagaaaggagggacaaattgggaccaactcttagcaagcaaagaaggagcatctgtcaattggttctctcgatggaaggaaggaagaaccggagttcttatttcatgcggagggtttccaaatgttcccttgatggggacgaggggttgtattagctacaatcccgttcttgttataaaacaactgggctaccctatgagaggggcgccactagaggatgagctcgcacctgtcatttctcgaggcttcaagaagaccaacatggagacacttcagaaggtccgcaaggcatgggaggtggtacaaaagaaagacaaagagctcagaggtagggggcccattggtggctaccgtgagtggttgaaagcccacgtgcaaggtttggattggctcccaagtttgagaaccgctaaaagggaggaagttgaggcagcggaggaagaggaagaggtgtag

SEQ ID NO: 10109 - DNA, 693 bp, Glycine max
  Peptide Sequence Number=SeqID_101794
atgtattggtcatcagaattttcattctcgcaaacatggggtcgaactaaagcgccctcctttaaaaagaggttttatcatgtcaaagtcaagaacctagaactagccagcttgcaagagctagggcaacggatggatcaagttcgacgtcaagcctttagtaaggcatataggaaaatatgggatttggccatgatagaagtgtctgttgaagccatcacatccctcgcacaatactatgagcagtcgctcagatgcttcatgtttagggactttcaattggtaccaaccatagaagagttcgaagggatcttgggatgctcgcaggaggaaggaagccatatcttttttctggattctacccttccatggcaaaaggataccaaggaagcgcctggaggagaaggcagaagctttggcagaatgaaagagaatatgttgataatcattgatcaatataaagagaaagtgaacctagctattagtcacaggcagaggctggaggatgagcatgcaaaggtatcagctctgcaaattgaaagggaagcaagagagaggatgatagaatcattgcacgtggaagctatgaaatggatggataggttcgctctcactctgaatggaagtcatgagcttccaaggttgctagccagagccaagacgatggctaacacgtactcagctctcgataaa

SEQ ID NO: 10110 - DNA, 615 bp, Glycine max
  Peptide Sequence Number=SeqID_101795
gaaggagtgtgacaagctaagagatgtcaacatgactacggtcaaagcattagagcgagaaacaaagagggcccgaaaggaagaatggagcaggaacaagttccaaggggctctatggggcagcagcaacaagctcaagcttagaagggccgaaaggaacgagtcaagggtggaaaacatggtgttagaggataaactgaaggcttgtcaaaggtcaaagagaagtttgaccgaacagctgagtagaatggaagagaatatgttgacaattgttgatcagtataagaaggtaaacttagctgctagtcatgggcagagactagaggatgagaatgcgaaggtatcagctctgcaaatggaaagggaagcaagagagagggtgataaaatcattgcacggggaagctatgaaatggatggataggttcgctctcactctgaatgggagtcaagagcttccaaggttgttatccagagccaaggcaatggcggatgtatactcgactcccgatgaagttcatgggcttttcgattactgccaacacatggtgcaagagcagatgaaggccgacatagaggccatgagggacccaatgacctccatgattgagtccat

SEQ ID NO: 10111 - DNA, 225 bp, Glycine max
  Peptide Sequence Number=SeqID_101796
atgactattgaagaatctattcatgtttcctttgatgagtgtaatgctattcctccaagaaaagatattttagatgatattgcagaatctttagaacaaatgcatattcatggacaagattctaaaggaaaaggagaaggaagcaatgaagatcctccaatagaagccaaaacaaatgatgaacttccgagagaatggaaagcttcaagagatcattattggtga

SEQ ID NO: 10112 - DNA, 258 bp, Glycine max
  Peptide Sequence Number=SeqID_101797
atgatttctttgattaactatataagtacccatgatttcattcaagctgctcaccataattattgttggtaccaagaaatggtttatccaagtggtactagacacgaatcccttaagattgtagtaaagggtttgaatcctgacgaatgcatatatggagaaaatcttgttgagagggagatcccacctatgagtgccaacaagtcccttggagtgccaacaattattgttgagaagtcttacagtcattgcgaatag

SEQ ID NO: 10113 - DNA, 135 bp, Glycine max
  Peptide Sequence Number=SeqID_101798
atgtatattgttgtggtacttaaggatgaacgcaagcggggagggggtcacgaccgaccgatcgtcgtttttttttttgggaaacaagcagggaatgtcgctgcaaggcagccccgtatccttttttttttgtag

SEQ ID NO: 10114 - DNA, 273 bp, Glycine max
  Peptide Sequence Number=SeqID_101799
atgataagcaggctcaaacttagcccatgggcccaaaattatcctaaggctcatgagaaccctagggccttctcttgcatcactggctcaatcttcttggagtcttctatccaatgcccttgcggggtagtattacatcattccctcccccttgaaaaaggctggatctttgagcttcaatggggtcatttgatggtgatttttccaccatggagatgcagcggaagacaaaggaaaagaggtgagaggaggcaccatccatttaaggaataa

SEQ ID NO: 10115 - DNA, 357 bp, Glycine max
  Peptide Sequence Number=SeqID_101800
atggggacccgggttgagaaaaacgaggatatgggctacgtgggagtacgtgagctcagttggaggtgggcaacaggggatggtgggtttatgcgtgatttgtggatgtggaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcaatcactgtgaactttgtttgatatatgggatatgggctctggtaatcgattaccaagggtgggtaatcgattacaaggcttaa

SEQ ID NO: 10116 - DNA, 267 bp, Glycine max
  Peptide Sequence Number=SeqID_101801
atgatcctctgcatactcattaagatccaacctggagcagctggtggatcctgtgaaatgagctgctcttgctccaatgctggtgcagatggcagggtatcctcagagatagccacaactaaatcagaagcaaatgaaaagggatcaggagaagcaagctcatcctctgctggtggtgtatgctcctctgtgggctcaggttcttgggctgcggaggtcccaccccctccagaaggagaaggctggactcctggccaagccacctga

SEQ ID NO: 10117 - DNA, 225 bp, Glycine max
  Peptide Sequence Number=SeqID_101802
atggatcaagctggtgaggaaagaaagtcgcaactgagtgagttagatgacatccgcctagaagcctacgagaatgccaagttctacaaagaaaagaccaagaagttccatgatagcatgataattaagaaggacttcatgttgagatctaaagcgactccacaaacaagagcttcaaggtcaatggacaccgacttaagccattcctcacaaacccttctttag

SEQ ID NO: 10118 - DNA, 1253 bp, Glycine max
  Peptide Sequence Number=SeqID_101803
aaaccatcgccgagcaagagcaaaccaaacttgaggtgctggcggccatcgccgcggcggtcaagcccgacacgctgatcgccaccaatacctcctcactgtcgcttaacaagctggcaaccgcggtgacgcacagcgagcggtttatcggtttgcactttttcaatcccgcgccgctgatgaaactgattgaaatcatcccggcctactttaccgcacgcgccaccaccgaacgttgccgtcagctggtggccgcgttggggaaacgcgatgtcgtctgccaggccacgccggggtttatcgtcaaccgcatggcccgcccctactacctggaagggttccgcctgttggaagaacacgtggcgcgcgcgccgcagatcgaccgcgccctcaaggccggcgggcactttcgcatggggccgctcgagctgaccgattttatcggccaggacatcaactatcaggtcagccggcaaatctggcaggacatgcaatacgatccgcgctatacccccggccatctgcagcgttcgctggtcgatgccggtctgttggggaaaaagaacggccgctcctattttgccgccgaagaaaacgccttaccggtaacggccgccaccgatgcagacgtcgagacgctgcgcgtttacggcgaacaccctttttttaccctgttgcaacagcgggccgcgcttcagtggccacggctgcgcgtggagcaacggccggccttaccgggcctggggccggccgtccagatcaatgaggctttcaccgtcagcgtcaccgatggccgcacggcgagccagttggcggagctgacggcggcggatgcctttgtggtcgatgtcgccctgaactacgccgacacggcgtatctggtggcagcgcacaaccgccacgcctctgaggccaataaggcgctgtttttacgcctgctgcacacggcaatcccgcaggttgaatttatcaaggactccccggcgctgatcgtcgcccgcgtcctcagcagcctgatcaacgagtcggtgatcatggtggaaagcggcgtctgcagccgggaagacatcgatgtcgccgccgtcgccggcgttaactacgccgacggcattttcggctggctcgatagcctgggggagaaaaacgtcaggacgacgctgagcaacctggcgcagctgctgcacgcggcacgctatgcgccgcattacacccttctacacgccgcgcaaccggcgctgacgaccacgccttaa

SEQ ID NO: 10119 - DNA, 261 bp, Glycine max
  Peptide Sequence Number=SeqID_101804
atgttgagccctcctggtaattcgagatcacttgaaattagtgaaaaaaattgtttccgtgaagaaaatccaagccgaggcacttccgtaacgtttccgtgggtgatttcgcaaagattttcaaccgttcttcgacgttcttcgttcgttcttcggtcttcaaccgtttttcttaccaagcaaaaatggatcatttttaaggtccaacaccttaaaaagatcacattcccaagtaaaaagaatcgcttgataaaaagataa

SEQ ID NO: 10120 - DNA, 309 bp, Glycine max
  Peptide Sequence Number=SeqID_101805
atggatcccatcacaatactcgtcgcccttaaaaggtcttacaattgtgtgattgcacagttcatagttcacaactcaatgttagacaagtggtatcagagcttcattcttgtacaaagtttagaagcttcaagaaaaagatggcctcagcaaattccttatttccagaagggaattctatcaatagacctccaatctttaatggagagggttaccactactggaaaacccgaatgcaaattttatcgaggcaatagatctaaatatctgggaagccatagaaataggccttatatacccccccagtag

SEQ ID NO: 10121 - DNA, 97 bp, Glycine max
  Peptide Sequence Number=SeqID_101806
atgactcgaggcgtaaaccttaagtttgaacaactttacggaagtgagaagtggagggagaggccctcacagactcttcggagtgtaggccttaggg

SEQ ID NO: 10122 - DNA, 243 bp, Glycine max
  Peptide Sequence Number=SeqID_101807
atgtttcaagctcttcaagtgaaagtagtgatgaagaggaagcaaatctctgcccatggcctaaagaagttgatagcaatcagaagacaaaggagaagaggcgagaggaggtgccatccactaaggaataagccatggaagaaggagcttcaccaccaagatgagccttggataagaagcttggagaggatgcttcaatcgaggaaaagaaagagggagagaaagagagagcggggagcatga

SEQ ID NO: 10123 - DNA, 913 bp, Glycine max
  Peptide Sequence Number=SeqID_101808
aaagtcaccgttcatgcacagagaaaggaggggcaaattagggaccaactcttagcaagcaaagaaggagcatctgtcaactggttccctcgatggaaggaaggaagaactggagttcttatttcatgcggaggatttccaaatgttcccttgatggggacgaggggttgcatcagctacaatcccgttcttgcaataagacaacttggctaccctatgagaagggcgccactagaggatgagctcgcgcctgacaaagagctcagaggcagtgggcccattggtggctaccgtgagtggttgaaagcccacgtgcaaggtttggattggctcccaagtttgagaaccgctaaaagggaggaagttgaggcaccggaggaagacgaagaggtgcaggctcttaggacagaactcgagcaagctcaaacagtcaaagaaaggttcaaatcaatggctcttaggatccgaaaggagaatgccgaactgagggatgtaaatgtagctatcaccaaggcattggaacaagagaccaagagggctcgtagggaagagcacggccggaacaagttccgaggggctctatggggtagtaataacgagtttaaactctggagggaggaaagggaccaatcgcggaccaacatgttagccatcattagcaagtatcaagaagaactaagcctagccacagcccacaagcatagggtggcggatgagtatgcccaagtgtacgcagaaaaggaggctagaggaagggtgatcgactcgttacaccaagaggcaaccatgtggatgaaccgatttgcttttaccttgaacgggagtcaagaacttccccgattgctagccaaggccaaagcaatggcggacacctactccgctcccgaggagatccacagacttctcaactatt

SEQ ID NO: 10124 - DNA, 201 bp, Glycine max
  Peptide Sequence Number=SeqID_101809
atgcttgctcagcctggaggttcaagcgatgcgcttagcgaatttattctcgctgagcacgtcattgacaactcatctacttccaagatcttctacgcgcttagccatgaactgctacgctcagcggacggctcgttaagccagagaattggcttaacgagcggctcaaaatcagcacttccaccaaacttgcctaattag

SEQ ID NO: 10125 - DNA, 283 bp, Glycine max
  Peptide Sequence Number=SeqID_101810
atgactagaggcaatccatctgacttacaaccctttgatcctgagatagataggacatttcatagattagttaggcatagtgtgcatcctgatcattctgtgcattttgagcattttgagtattctgttgctagtgattctgaatattctgattttgagcattccactactaatttttatactgagaacatggctcaacctccacctcgtgagaggactcttagggagatggctgcacctgatttcacttatgaaagcttgtgcattcaatatcctgatgagg

SEQ ID NO: 10126 - DNA, 330 bp, Glycine max
  Peptide Sequence Number=SeqID_101811
atggcggtaggaaatacaatcatacaaaaacctagggatcaatggagtgaggaggaaaagagattagtccaatacaatttaaaagccaaaaatataattacatctactttaggaatggatgattactttagggtatcaaattgtaaaagtgcgaaagatatgtgggataccctacaggtaacacatgaaggaaaaatctttccaaatgaagatcttataaatagagttttgagatgcttaagcaaggaatggaaatccaatgtaatagccattattgagtcacgatatttaactaacatgtctcttgctacattatttggaaagttacag

SEQ ID NO: 10127 - DNA, 249 bp, Glycine max
  Peptide Sequence Number=SeqID_101812
atggcccgcaccaagaaaacagggaagataacgattgaggccgcaaaggaaatcgctgagaagatcgattcctttgaggagcaggcgacactgggatccttcatcccccagggacgtcaggatgttctcaccgctgctattggacgtccagagcaccctggacgtgtccgtgctgctagagccaatgtccccatcaagcaatacttggatcggctgatggaggctgtccccgaatcaaataaacattaa

SEQ ID NO: 10128 - DNA, 303 bp, Glycine max
  Peptide Sequence Number=SeqID_101813
atgtggctccgcatgccaccggactcttgggtcacggtaacaaaaggtggggtggtcgacaaaagcaggggttcctctcggtgtggggtttcaatggagaacaacgatggtttgtggtggctaatggtggctgtgggtgatggagaaagtgcttggaactttagaattggctttggaagaaagaaagaagaagaaatgatgtttttcctaagctacatgaaagcaaaggctgaaaccaaatttcgggaagatccaacgattaacgaaggctgggcagcgtttttaccgaggcaattcatgtag

SEQ ID NO: 10129 - DNA, 472 bp, Glycine max
  Peptide Sequence Number=SeqID_101814
atggctaagtttgaccctgaggtagtcttggagttttacgctaatgcttggcccacagaggaggaagtgcgggacatgcgttcatgggtgaggggtcagtggattccttttgacgcagatgccctcagccaattcctaggtggctcgctagtgttggaggaaggccaggagtgcgagttcattcagaggaggaacagggccgacgggttcgacgaggaggccattgcccagctattgtacacacctgggcaggatttcgcccgaaccgctgccaggagatgggtgcggatcatgcgcaccagcatgaccaccttgacccagatgtggatgacgttgctgctcagcaatgtctcacctagtgatcataacttcgatctccctctgccgaagtgtcagctggtgtatgccatcctgacacatatgagcattcacgtggctcagctgattgctgacgccatctatttgtttgcag

SEQ ID NO: 10130 - DNA, 273 bp, Glycine max
  Peptide Sequence Number=SeqID_101815
gaatcgcacccacaaagacacccagtggacccggagaagtccaacagggccctggggtttctagctctagttacgagcctctgtagtcctacagggtgctcgttccccccggcaaggtcacgtcatcatggcatagggattgcgctcgcaagacacccagtggacccgaagaagtccaacagggtcttgaagtttccaagctctaattacgagcctctatcagttctacggagtgcctgtcgcccccagcaagatcatcaggccccctactaa

SEQ ID NO: 10131 - DNA, 282 bp, Glycine max
  Peptide Sequence Number=SeqID_101816
atgcaaacaaataccaagggtggtggtggtgcaagtgcaatgaacaacaataattttcacaagcctagggcattggatattcatgatagaatttggaaaggagaagaaaacaataataataataagccaatagatcatgacaatgtatccgcaattgcctcggatcctaaatttagagttgctgttgctgcggccataacatctctcatgaataaagagagccacactactcatcctataggaacttcctttggccctaggagtagccaaaatggtagctag

SEQ ID NO: 10132 - DNA, 78 bp, Glycine max
  Peptide Sequence Number=SeqID_101817
atggcgtggatatatggcagaattttggctttccactctgttccaccgtccaccattgataacactatgatgtggtga

SEQ ID NO: 10133 - DNA, 432 bp, Glycine max
  Peptide Sequence Number=SeqID_101818
atggcagcgcagttcatccatgatcgagtggagatgaagtgcctagagggagcttgggagaccctcgaaggcaatgtgaggtgccgattccgaggcacgattcgattcacggctacttcattggtgcatccagaggaacccgcgcgcacgcttcagcgcactgtggagtggatattacccacgcctacaccatatcgtctagtggagccagtccaagtgatcgaggtgacgtcatttgaggaagaccctgaggaagacccagaggagctacctcctgagctcattgtggatgctcttgactttctagagggtgatgaggacccactccctgaggtggactctcccgaggacgtcatgtcggcatctgaggcagactctacggaagatagcggccctggagagatggtgactagtggaggctcttcatcatag

SEQ ID NO: 10134 - DNA, 921 bp, Glycine max
  Peptide Sequence Number=SeqID_101819
atgcgcactggttttattaacgctctcgtggctcccgatcgccttcgcgcagacctctttattgttgctggttatcggcgtgatcatgctggatttcgccgtacagacggtgcatgtcatcaaccagagcatgctgattgctggcaaacccgctatcaccagccggcttatcggtgcctatatgtgtttttatgcggcaggcagcgcgctgggcgctattactgctacccaaatctatgcgcactggggatggtatgccgtgtgcggcggcggggcactggtcagtgcctgcgcacttattctctggtatggaacacgtcaatcatgaaattatcacacctgctactggccataggtattaccgccatctggggcattaatttttcggtgattaaattagggctgcacgccatcgatccgtttattctggcagggctgcgttttacgctgtgtgccatcccggcgctcttctttattaaaaagcctgacgtcccgtggcgctaccttattggttacggactggtattcggcattggcttgtggggcctggtgaatctggggataaaaaccggcctgtcggcggggatcgcctcgctggtgctgcagttcagtgcctttttcactctgctgctcggcagttatgtgttcaaagaacagctcagccgctatcagatcgctggctttgtactggcgtgcagcggattgatgagtattgtgtttattaccgacggctcggtgacgtttgccgggttgctgctggtgctggcaggcgccatagcctggagcattgccaatatcatcatgaaaaaagccggcacgaagcaggtctaccccaatacgttattaggctactggatctggaattcattgcttaagcagtatcctgtctccaccgtcgcgccattatcgttgctggtgccg

SEQ ID NO: 10135 - DNA, 501 bp, Glycine max
  Peptide Sequence Number=SeqID_101820
atgggagtaccgcttccatcccacaaaccaaggagtacggcgttgccccacctccacagccccgttcatctttggccgatagggggtggagttatgatgctggatcttgaaatcctcgcacatttcctacatcattttgttattcagattggtgccattgtcagtaatgattttcctagggagttcgtatcgacaaatcagttccctttttatgaatctgaccaccacactccacgtgacattggtataggaagccactttgacccatttggtgaaataatctatcgccacgagaatgaagcgatgaacgttcaaagccttgggttcgatggcccctatgacatctgtcccccacatggaaaaaggctaaggggcggacatgacattcagaggatgtggcagaatattaacattgtctgcgtacgcttgacatttatggcatttccttacatgggtgcagcaaccactttccatagtgagccagtaataacctggctctaa

SEQ ID NO: 10136 - DNA, 432 bp, Glycine max
  Peptide Sequence Number=SeqID_101821
atggatatgaatcttggatccttcatttcgagtcagattgcacttatagcacatcatgactcctcgaggcttggctttcttgccctaatcactgctttatgtaaagcttggggagtccactctgattccttgacccatgagagcctgagtcctgccattaatttgacttatattaagaagaattgttggaatcttgatgatccaacagtaacttttataggactcaggaaggccagagggaagagatctgaggccccttccacttcagcatcagaggcaccaacaccttcttcttctacacttcctccctcttccaccatagaactcccagtgattccaccagcaccttctcagattccacttccaactcctctctctgcaggaccaacatattttatttttactcctcagatgcttcactccatgctctag

SEQ ID NO: 10137 - DNA, 400 bp, Glycine max
  Peptide Sequence Number=SeqID_101822
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggtttgtctccggatgacgcttgcctgggcgcttgctttgttcaacgcgatggctactactcttaatttagctagcgctggcaatgctcgtggcag

SEQ ID NO: 10138 - DNA, 378 bp, Glycine max
  Peptide Sequence Number=SeqID_101823
atggccaatgattatgctttgattgttgagttgtatactattttggtgcaatttgtgtctatgatgatctcatgcctaatatgggtcttgctcatacaagagtttgatatagtcatcaacgataagcagagattcgagaatgtggtggctgaccacctctcccggttgaagaatgaagaagtgaccaaagaagaaccggagaggaagcatagagcatcctttggcactaccatagttcaccatatagcgatcaccacaacggagataggacaacaacaaatgtgctacaagaaggtttcttttgaccctcaatcttcaaagacgctcatgattatgtgcattgttatgacaaataccaaagagcagggagatttctag

SEQ ID NO: 10139 - DNA, 612 bp, Glycine max
  Peptide Sequence Number=SeqID_101824
atggcctcctctgaacctgttttctccttttccgggactccaaccatcaccactgcaaaacttaactggaagaattatctttcgtggtctgcttccgtggagttgtggtttctcggtcaagggcaccatgaccacttggagaaagcttcagattctgttccagacgataaaagacctgaatgggagaagcttgactatcaactttgcattgtgttatggcaatcagttgagtcagatattttggagatccttcgatcatttaaatcatgttgttctttttggaagaaagcccaagaaatctttgctaatgatatccaaagcttgtttgatgcaatcatgaaggttacaactcccaagcaaaccagccatgacatgatcgctcatgtgggcaaggcctgggctgtcgtagaagagctaagaaagttccttgtagttgattcattggaagaagtgaacaagaaacttgacaagttctacatggtcctcattctgaggagcttacattcagactttgatcgtgtgcgtgatcaagtacttactggggaccaggttccatcaatggattccctcatcactagacttctccgcgtgcctcattttattgaaggatga

SEQ ID NO: 10140 - DNA, 318 bp, Glycine max
  Peptide Sequence Number=SeqID_101825
atgggcctctggccatggaaatcgggcatcgccagaaacttacctgtgcaaggttttaaaaaatggacagaactagctgggattctaaaagattatgttggacgggagagtcctctttattttgctgaaaggttgacggagcattacaagagacctaatgctttgcttgctaagaggttgggcaaaaaatgcattattgctgaaactggagcgggtcagcatggagttgccactgctactgatatggaaaggcaggctctcaatgttttcagaatgcgtcttcttggtgctgaggagataggatccttccatgaataa

SEQ ID NO: 10141 - DNA, 120 bp, Glycine max
  Peptide Sequence Number=SeqID_101826
atgccgaagataccagtagatcatcagagaaaaattcaattgaagaagacattgaaacttaaattgctgaagtgcaaacattttctagcaaaaaatggggaagaagagaaaacacagtga

SEQ ID NO: 10142 - DNA, 237 bp, Glycine max
  Peptide Sequence Number=SeqID_101827
atgacaacaaaagatgatgacaaaggtgatgaacaaaaagctcaaagatcaaagaacaactcaagtgaatcaaagaacatctcaagtgaatcaagaacaagtcaagagttcaaaactcaagaagaaagcctagaatcaagaatcaagattcaagattcaagattcaagatctcaagaatcaagatcaagattcaagactcgagattcaagaatgaagaaaagactcaatcaagataa

SEQ ID NO: 10143 - DNA, 189 bp, Glycine max
  Peptide Sequence Number=SeqID_101828
atgtgggttttccggcagtgtagggggttctgtggcttcgaccgacgacaatatgggtgtcgagggagcggtttccggcagatttcaggcgagaggagaaagaggagtgatttcaggcaggaggatgacaaagagaagagggagggcaaggggcagggacgcgttgtaattgattacagaattttgtaa

SEQ ID NO: 10144 - DNA, 679 bp, Glycine max
  Peptide Sequence Number=SeqID_101829
ctcttcctccctgcctcctgacgaattgcagcaactaacccagaaaatcagggaccagctagaggagtccatcatagagaaagtgacacggcaggtcatagcatccttcagccagatgcaatcccagcttcagtcgcagatgcaatctcagggacttgcagtgcctcctgaccctctggttggtccctctggtcctcgagtgagtgtggaggatgttacagatgcagatgctccagttcctgtacccactgatgaggtttccttagtggggcaggcacttcacaccttccttgcttggccgacacatctggtcaagtctttatcacagcaggtagctgtgtctccggcaaaaccaactccaaagctcgatccagaggtcgatgatccgctttatctgatgacattgaccatcccagagcatttcttgaggccttatcaggttagatgggatgccaccgtgttcggggtctttaatccagatttccccctctacataaagcacgaagacctctccgaaatcgcacacggtggtcaatgtctcaacatatcagtgttacagttgtggattctgcatctcactgaaacatgtatgcgagcagggaattctgatatctatggattcctcgagccacagtccattgagaggtctgggcaatcacagtttgagtctgaaagttag

SEQ ID NO: 10145 - DNA, 507 bp, Glycine max
  Peptide Sequence Number=SeqID_101830
atgggatcatcggcggctatcataaagtggctgagagtccgaacacaaggattggattggctcccaaatctaaagactgtgagggacgatgagggtaaagcttcggaagaaagtgatgaggacgagctaaaggcttaccttaggtcgaaaagaaattcgtcccaacagttaagcgagactgaagggaatatgtgggccgtcatcgatgagtgcaaagagaagctaaatctagcggcgactcacgagcaaaggctagaggatgagtacgccaagatatcagcagaaagcgaagcaagggagagggtaattgattcatggcaccaagaggcaacaatgtggacggaccgatttgctcttactttgaacaggagtcaagaacttccccgattgctagccaaggccaaagcagtggcggacacctactccgcccccgaagagattcatgggcttctcggctattgtcagcatatgatagacttaatggcccacataattagaaatcgttag

SEQ ID NO: 10146 - DNA, 450 bp, Glycine max
  Peptide Sequence Number=SeqID_101831
atgaaagaaatgaaaagagaaaaacatgcctcctatagtagtcatgactcttgtaagagtttaagtgaagaacttagcaactattatagagggcaccatagttcacatactaaacatcattcccaaagaagagaaaaggatagaaggactcaagaggttaacattagcctcccatatttccatggaaaagataattttaaggcctactgtcgcaacatgcccttttgcgggcaagcgaggcgaggctcgcaggtgcgctttccaaagaaggaaagatgcgcggagttgccaccaacgtttatttgtggaaaacgttgggaaaaccaaaggaaaccgatcaaaatgaaaattctaagttcgggagttgtatttacgtttgaggaaggtcgacaaaagcggggctcttgctcctacgtaccctccatcaaagaggaagtcagatctatgtag

SEQ ID NO: 10147 - DNA, 621 bp, Glycine max
  Peptide Sequence Number=SeqID_101832
atggctccgaagaaactctccccaaagaggtctagaagagacgccacaagagaagggtccagtgccgcccccgagtttgatagtcatcgtttcgtgggtgagggggccgacgggttcgatgaggaagccattgcccagctattgtgcacacaggggctggatttcgcccggaccgttgcagggaggcgagtgcggatcatgcgcaccagcatgaccactttgacccagacatggatgacactccagctcagcaatgtcttacctagcgatcataactccgatctccctctgcttaagttccagttggtgtatgccatcctgtcacggatgagtgtccatgtggcccaggtgattgctgacgccatttatttgtttgcaggtatggcgcctaccaggcaccctctggacccagataagtccaacagggccctggggtttctggcgctgatcacgggcctctgccagtccttcggagttcccatcacccccagtaaaggtgatgcacatcaggccacagatgcaccgccaccacctcggcaagccgatcctactggatcactaggcatggagcgctatctacgacatttggttcgccagcaggcggccaaccaccatggacag

SEQ ID NO: 10148 - DNA, 348 bp, Glycine max
  Peptide Sequence Number=SeqID_101833
atggatagctcagaaccctacactggggaaatgaaaggcaccatgcataaacctcaagtgaacctaggggcagatcagaaattctcacccaataggttccttgctacaagatttcctacatctaatgtccaatcttttggatttgggatgatcagccctctcgatgagttaatctcttgctttctcataagggtggacccttgggtactagtacctattgcctttaaagggctacacgccctcgccttcagaggactacatgtcctcgacttcagagggctgcacgtcctcgcctttagaggacttcacgtcctcgcctttaaagggcatgcacatccttgcctttag

SEQ ID NO: 10149 - DNA, 706 bp, Glycine max
  Peptide Sequence Number=SeqID_101834
tgaaggtgtaccttttgagggtgcactgattgatgaattgaaatttgatttctctgtgcatgatgcccgccggttggtttgcaccaaccaagcggacatgaccggaaggcttcttgccggttcattggcttttgaaagccgcatcctccattatcttatagttcgcattttgcttcctagatcttcaaaccttgcccaggtttctgaagaagatctcattgtcatgtgggcctttcataaaggtttacaaattgattgggcacaccttgttagatatcgcatacataaggcattgcgattgaatgccccattgccttatcctcatctagttactcttttccttcaacacttcaacatccctcttgattctgaaccctatgttccaatcaagagatcattccttataggcgcttcagtcatagcatcctttggacatgttaaagagcatgatggatcttggataaagaagggtgctagaaatgttggtgaagaaggacatgagggagaagattcatctcttctttcgaatattttggaaaggtttgatggtcttcaaacctttgttggtgagaggtttgatactttggaactgcaagttgatatgcgtttcaatgaaatggagtcaagaatgactaaggttgaagaagatgtatcttacatccggtcaagctttgatcttccaccaccgccgccaccatcatcttag

SEQ ID NO: 10150 - DNA, 609 bp, Glycine max
  Peptide Sequence Number=SeqID_101835
atgagaggagcgccaatagaagaaagtctctcgtctttccttgtgagggatttaggcgcgcaaagtctcaaggtgatacaaagagtccacaaggcatggagaagtcctttgaggaaagacaaggagcttagaggcatccgtaatggcgtcatcggtggttatcatggatggctaagagttcacacgcgagggttagattggctctctaaattgaaagttatcgatgaggagaacttcgaagctccggaggaagatgaggaagtccaagctctaaaattagagctagggaaggcaagactcgccaaagaaaaattcaagtcagccgctacacacatctggaaggagtgcaccgagttacgagagggaaaacgcggccactgcaaggggcccttgaacaagaaaccaaaagggcccacaaggaggaacatggccaagagaaattccgaggagctttatggggtagaaacaatgagctcaagctccgaagagaggaaagagactggtcacggggtgcatggcatgatcttaaaagaagagttagctgcttgcgcaaggtccaagaggagtttggctcaacacttggaagccacatggagcaaagcatgctag

SEQ ID NO: 10151 - DNA, 1032 bp, Glycine max
  Peptide Sequence Number=SeqID_101836
gagtgtgccgggttacgggaagagaatgcaattaccgcaagagcccttgaacgagagaccaagagggctcgcaaggaagagtatggccggaacaaatttcgcggagctctatggggtagcaatagtgaactcaagttgcgaagggaagaaagggaccagtcgcgagcacatagcatggttctgaaagaggagttgattgcttgttcaatgtccaaaagaagcttgtctcagcgtttatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattatccaaatctagaacgatggggtgatcaagaggagacacaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccgggcacattgcctcaacccaacctcgcagcatcgccaata

SEQ ID NO: 10152 - DNA, 789 bp, Glycine max
  Peptide Sequence Number=SeqID_101837
gatgtgcggaaaaaggcacaggccatccagaaacagaacactgccccccacgttttttctcgtgggggttatgaatatttggagcagaagctcctggctaagaagaccaagaagaagctggaggaagttgcacagtcaagaagcattgatggcgtcatcgaccctccatcccccatcagatgccacgtgaagtggaagatggcccacactaagaaaacaggagagatgacgattaaggccgcaaaggaaatcgctgagaagatcgcatcacagggatccttcatcccccatagacgtcaggatgttctcaccgttgctattggacgtccagagcaccctggacgtgttcgtgctgctagagccggtgtcaccgtcaagcaatactttggatcggctccacgaatgtcccgcagctattcctcgctgcctcctaaagaattgcaacagctgacccaacaaatcagggaccagctagaggagtcgatcacaaaaaaagtgactcggcagctcatggcatcgttcagccagatgcaatcccagtttcagtcccagatgcaatctcagggacttgcactacctccggagcctctggttggtccctcaggtcctcgagtaagcacaaaggagagttgtgttgatccctcaggaaacgatcctgagacgggtgactcaggtaggtgcggcttgtacatcgaagcaaatccttccctgggaagagtttatgagggatccactgttattcataacacttcaaaggtgcctggccaagtaaaggtgggtgtggaagag

SEQ ID NO: 10153 - DNA, 270 bp, Glycine max
  Peptide Sequence Number=SeqID_101838
atgggtatactacgtcggttgaagaccgtcgttgtctgcgacgacgaccgtcgtagtaaggtccacaattcaaacacggttgtcaacagccccgtcgtagaagtaacaacagactacgacgggcatggggacaccaccgtcgtagaagtaacaacagactacgacggttgtcttcccagaaccgtcgtagaagggtcctatcactacaacggtgttttgttgcggacgaccgtcgtaagagacggtgttaatactactacggtcacgtaa

SEQ ID NO: 10154 - DNA, 300 bp, Glycine max
  Peptide Sequence Number=SeqID_101839
gacatcgtatccgacatcttggatcctgcagcttcaatgcttcacttgacttttatcttgcattgtacagcaattccagtattctcgagcaggatgtcaggacattgtatccgacatcgtggatccttcaacttcaattcatcacttgacactttatcttgccttggaatttggaagagcacaagaatcaaggctcttgccaggctcagcacacgactaatgccaagcccaaatccacttactcacgctaagcacgagggtggcgttaagcgcgacgtcgcgattttagagcctatttaa

SEQ ID NO: 10155 - DNA, 261 bp, Glycine max
  Peptide Sequence Number=SeqID_101840
atgaatgagacaagtatacaagcggggaatgtcgatgtgtatggattcctcgagtcacagtccatacagagttatgggcaatcacaatttgaatttgaaagttatattaagaattggatgccaaaatcaaaaagggttgtttacctaggagcctacttgaatgatgcacattggcaaatggtaatcattttgcctaaggaaaatgttgtcatctggttttgttcgttgcatattggccagacaactacctcaacggaataa

SEQ ID NO: 10156 - DNA, 288 bp, Glycine max
  Peptide Sequence Number=SeqID_101841
atgatgactacacaaatgcaacgtatgttgaaccgtaacaatgaagagctctatgaacaaattgaaggattggagaaccaattgaatcagaatgttggaagacattatggtgggtacatagggggcaatgatggacctagacaaaacagaatggaggggcagaacaaaattgagggagaaaaactcaatgtacctcctttcaaaggcagaagtgacccagacgcctaccttgacttggagataaagattgagcatgtattctcctgcaatgattatactgaagagtag

SEQ ID NO: 10157 - DNA, 594 bp, Glycine max
  Peptide Sequence Number=SeqID_101842
atgggggcaccttctgaaactctatctttggaggttccacttcttgtgaaaggtcccttcaatgtttcactaatagatcccaagagatactgctttgagagctctttttatccttcaacttctgcatactacgacatgtttgagtggagcctaccctacgacaagagtgcgggtgaaaagccaaaggagcatcttccaaaaaggaaaatgtgtgggagtcaccaccaatgtttattcgaggaaaacgttagaaaaaccaaaaaagaggcaaagggtcactttggggcagttgcagctcgcctaagcgagctggaacttagtgctgaagaaatgagctcgcttaggcgagttggtttcttcaccatgaagctatttggtggcccatgcgagccagaggctagcctgggcgagctagggtccaggaaaaccaaggaaaagacccttttccccccttttttggtattttttgcattcttgatgaaaacactgaatgatcatctgtttcatattgtaactgacgttcaacatcataagtcgactagcaaggatcaaaagatcaacgaacgatactcctcagatgaaattaggcaatga

SEQ ID NO: 10158 - DNA, 838 bp, Glycine max
  Peptide Sequence Number=SeqID_101843
atggggacaaatcaaaacggcaaaaggttttatcaagtcaaggttaaaagtctagatgtcactagcctcaaggaattaggacgattgatgggacctctccaaaggcaagccttccgcaaagtgtacgggaagattctagatttgaccgcagcggaggtatttacggaagctgtcgtatccctcgcccaatactatgaccagtcgttgaggtgtttcacgtttggggacttccaaatggtaccaactattgaagagtttgaggagatattaggatgccctcttggggggagaaaaccgtatcttttctccggctttcttccttccttgagtaaaattgcagctatgattggagattcagcaaaagagttggatcacatgaaacaaactcgcaatggaatagtgggcctgccacggaaatacttggaaggcaaggcaagggatatggcgagccaagagaagtggggtccgtttgcggatattttagctttgctgagttttggggttgtcctctttccgaacgttgacggtttggtagacttagccgccattgatgctttcctcgcatatcaccataggaaggaaagtccagtggtggctatcttggcagatttgtttgacacctttgaccggaggtgtgagaaaaacagtgcacggattgtctgttgtttacccgctctctgtgtgtggttgatttcacacctattccaacaagacacgagacacccgtgtccgcttcaaagctatcgctcatgcgccgaaaaaggaagagtcgattgggaccaacatttggctgggttaggaggcagcgcgatcaattggtttcctcgttggaaggaag

SEQ ID NO: 10159 - DNA, 159 bp, Glycine max
  Peptide Sequence Number=SeqID_101844
atggcctcctatggtgtggcgtctcctctctctcttcctttattcattccgctgccattcatcttccaagaagcaaaggaatccattgatgaagaagatcctaggcctacaagctccaatggagcttacatcatgtggtatcagagcatcttcatctag

SEQ ID NO: 10160 - DNA, 330 bp, Glycine max
  Peptide Sequence Number=SeqID_101845
atgtaccctttcttgttcttagttacaacaacccaagtagatgtaccctctacttgtaccacaaaggatgtaccttccaatgtgttaaggcaaagttctcaggcagttagtcctttgaaactttgtgatggtgaaacaaaagatatctcaggcgggagacacaaaagaattcaagcggttagtcctttgttcttttggaaaagggagaagagagacacaaaaagaattcaggcgaacaaagtttggaaaccagaaaactcagaaagcttttggcaaaggaagaagaagaagaagttcaagaagatgttcaaggagactcaaaggttgtaa

SEQ ID NO: 10161 - DNA, 447 bp, Glycine max
  Peptide Sequence Number=SeqID_101846
atgttgttgaagtattggcgatcagaattgccattccttggatttatagggttgaaccaaagctcatgcttttacaaaaaggttcatcaagtcaagttgaaatatggaagtaaccgtcttgcaaaattggggcaaaagatgaatcgagtcacatcactgcttcgtctactgccaaacatatttaggattgttgatgtccttgttacttccagtttcaccttgacaaagatgtcatggaccataaaaggacacgctttacggtgcccttaccgaactcgtgccagagctagagtagtgggtgaagcagaggaggtgcaagagaagatgaaggccgacatggaggccatgaaagagcaaatggccacaatgatggaggccataataagcatgaaaaagataagggaagtcgatatggttgcagttgccgctaccaacgttgttgggaag

SEQ ID NO: 10162 - DNA, 153 bp, Glycine max
  Peptide Sequence Number=SeqID_101847
atgtcctgtggccaatccagtataaatcagccgacaaggaaagtgtcgacgacactgtatgccaaaagtatcgacattagccaggagaaatgggcccaattttgccagagtcgcagagacccttcgtgggaggatgtacaaaaaaaagcatag

SEQ ID NO: 10163 - DNA, 115 bp, Glycine max
  Peptide Sequence Number=SeqID_101848
atgggcaccatcaagtgcgatgaccatggacaaattaaagcgcctaagcatccccgcagcgaatgcttagattcattaaccacactagtcccccatgaatgggccatccgacaag

SEQ ID NO: 10164 - DNA, 462 bp, Glycine max
  Peptide Sequence Number=SeqID_101849
atgcaatcacagggacttgcactacttcctgagcctgaggttggtccttcagctgctcgtgtcagcacaaaagagagttgtgttgatcccttagggaacgatctatacacgggtgacttagacaaatgtgggttgtacatcgaagaaaattctccccgcctggttgccctaggaagagtttatgagggatccacaaccgttcacaacatccctttgttgcatgatcaagtgaaggtcggtgttgaggaggttaaagatgcagatgctctcattcctgtacccactgaagaggttaagttagtggggcaggcacttaacaccttccttgcttggccgacacatctcgtcaaacatttatcagaacaagttatgtggaatgctaccgtgttcgaggtgtttaatgaaaatttccccttgtacataaagcatgaagatctgtttgaaatagcacacaatggttaa

SEQ ID NO: 10165 - DNA, 588 bp, Glycine max
  Peptide Sequence Number=SeqID_101850
atggcgcccactaggcaccctttggacccagataagtccaacagggccctgggattccccgcactgatcaccggactctgccagtcgttcggagtccccgttgcacctaccaaggctcagggtgatgctccacaggccgcaggcgcgcccccaccacctcatttccaggcagggcgccaggctggggcatctctgacccccatggattcgatccagtatttacggcatttggttcgccagcaggcagccaaccaccgagcacatgtacggacccatgattggtctggtacgggtcagatgagccttagcatgcagagccagggcttcagctcctttttcatgccctactccagaccagttcagggcagaggttgcatggcccgagattggcccgaggcccaagcaggagaggcacccccagaagctctaatgggttcgatgagaagaagcccatcgagttgctatgaccggaggcaggattcttgggagggagtggagacacgtgcggatcatgcgcaccaacatgaccactctgactcagatatggatgactctgctgctcagcaacatcctgcccaccgatcataa

SEQ ID NO: 10166 - DNA, 147 bp, Glycine max
  Peptide Sequence Number=SeqID_101851
atgtcgctgcatgggcaggatcatcttgagctaccttctggggtggggacaaaacatgaacagcagaaaccaatcaaggtacttaggaacggatgcaagtggggatggggtcacaaccgaccgatcgttgccccttctctgcgctaa

SEQ ID NO: 10167 - DNA, 852 bp, Glycine max
  Peptide Sequence Number=SeqID_101852
atgtatgatcatttgaatgatgcttgtaagagcggcgaccaacagcttgctgattacatcactctattacagtgttggatatatgagcattttccctcagttcctgagtgtttgactgatccagactatgatgagatctcatcacgtgcctgccggtggattgctacgaagacttctttgaagtcattacctgcatcgacgtacaggaaacatctagatggactgatgattcttgatgtttgttggatgccttacggtgagcaccacggagtatgggactttgatttgatttcatgtttttcaagtcatctgcgatggggtcctgttgtggtcaaacaccgaccagagagggtggtgcgacaatttggatacgttcagaccattcctccacaaactacagcttccatgttatcatttgaagatattgacgacatgtggatgcattactcttactatcttgtagcagaggggcggatttgtgttgtgccaggacagtgtgcatccgattacatggagtggttcttcatgatttctcatcctttcatgacaccggcacagcctgctgatccgcccagacatccacttgggtcacaggatgacacatatgtggagccacatatccctgaggtcccagtggcaccagcagcaccaccaccggcacatgccccttctgatgtggagcagcctagacatgcagaggcttgccaagcaatcgcagaaaggttggagcgtctcaacctaaggatagtcactataggcatagaaatacacgaggtcatgaaagactacataaggattactaggggtgtcacaccagatgacaatgtttatgtcaggtcgcaacaaaggtga

SEQ ID NO: 10168 - DNA, 420 bp, Glycine max
  Peptide Sequence Number=SeqID_101853
atgatggcacatcaaaaccccccatacttagccttttgcactcctgggcaaaatgaaacaaagaacaaaatccaaggatatcagagggagacaaacaaaaacattcacatatttctcaatgaacatcaaggaatgaaaggaatggcctttgagaaacaacatttcattcagcatgtccaacatttaaccaatatacaatgtacatcaaggcttgtagtgagcttcaaaacaaggaaagggaaacaaggctcaaaagggctatcaaaggaattaattcaaggtaaatccatttggctagaagcttataagaacaaaattgcctcaatcatttccaaatatgcatgtgaattaggaagcatcaacaagaatcaagccacggctattgtgcaagcaatcaatggggcaaaacacaccaaatga

SEQ ID NO: 10169 - DNA, 399 bp, Glycine max
  Peptide Sequence Number=SeqID_101854
atggatgacactgctgctcacaactccgacctccctctgcctaagtgccagttggtgtgtgccatcctgacacagatgagcattcacgtggcccaggtgattgctgatgccatttatttgtttgcaggaatggcacctactaggcacccattggacccggagaagtccaatagggccctagggtttccgactttgatcacgggcctctgccagttctacggagtgcaggtcgcccccagcaaggccgcgggcgcaccgccaccacctcggcaggccaatccggctgggccactgagcgtggagcggtatctacagcatttggttcgccaacaggcggccaaccatcgaggacaggtgcagatacatgagtgtctctaccggttcaacctcagtcagtag

SEQ ID NO: 10170 - DNA, 294 bp, Glycine max
  Peptide Sequence Number=SeqID_101855
atggcagtgatacaccttggcactctcattggtggaaggatattcgaaaaaaggaacttatttgatcatgaacagggtgcagctgtggcttttatggaaatcattagtaacgttcacattcaacctcaaatgaaggacaccttgagatggacagctgaaccttcgggtttatactcaactaggtcagcttatagattgataatcactgctaacagcaatcatcctcaggccaatatatacaagacaatttgggggaggcttaacatcaagacctcaccaaaatcgcctgggtga

SEQ ID NO: 10171 - DNA, 192 bp, Glycine max
  Peptide Sequence Number=SeqID_101856
atgggtgaagtagaggagctgcaagagaagctgaaggctgacatggaggccatgaaagagaaaatggccacaatgatggaggccatgattgtgacatcctggaaatttctaccggaatttttggaaatgattgtatatgcctatatgttattggtagaagtaggaatagtgggggcaagatatgcgggttag

SEQ ID NO: 10172 - DNA, 378 bp, Glycine max
  Peptide Sequence Number=SeqID_101857
atgacggagagggagatgatttcaatcatggtagatacgttgcctacattctactataaaaagctgataggctacatgccagctaactttgcggacctcgtcttcgccagagaaagaattgaatctagactgagaaaaggcaagttcgaatatgtctccaacacggcccccaatgacaacagaagagccccagtggtgggcgcgaggaaaaaagaaagagatacccacgcagtcaccaccgccccaacatggaagaaagcaccccaaaatatccaaagctcataccagcctaaccccccgaacttttcaattcgagccgggaattccctcctgactcaagtaaaaggaccacccgcagcagaaagagtgccggcctaa

SEQ ID NO: 10173 - DNA, 418 bp, Glycine max
  Peptide Sequence Number=SeqID_101858
atgacaggaaagggagttagagtttgtcaaaaggtaacagttgccaaacttatagatttgaagaagatagacaatgaggctacattgagggtggagaggtcaaaacaatgtgtcattgcctccgcaagaaatcctcattataggaagacatttgtctatgctgccaacaatcagatcagtggttaccaacctccagcattgttagtgatggatggagtgacccgcaaagaagatctcttattaatttcatggctgtcacagagagtgaaacctatgtttttaaaggccatcgattgttcaaatgagatcaaagacaatgatttcattgccaaacttacgagggaggtaattatggaggttggtcactcaaatgttgtgcaaatagtgacggataatgtagtcgtttgtgaagcaacag

SEQ ID NO: 10174 - DNA, 234 bp, Glycine max
  Peptide Sequence Number=SeqID_101859
atggtatttttcctaagctacacgaaagcaaaggctgaaaacgctcaagtgagaaatggtctcggacacggaaatgtcgcgcacactccagacatcttctcgaagatcccaacgggtgttacaacgcgagactcacgggtgcgtcttccaaggaaagaaaacgcacagagtcaccaccaacgtttatttgagaaaaatgttagaaaaaccaaaaagcgagtctacgaatcttaa

SEQ ID NO: 10175 - DNA, 1340 bp, Glycine max
  Peptide Sequence Number=SeqID_101860
atggtgcagatggagaaccagggagcgcaacaagaccttgctacccctgaagccatgacggacgaggctacagctgccatgcgtggagtcgcgaatgacagcgcgattgctactgagggagcgcatcggggcgcgcagcctgagctcactgcgcacggcgctgcaacggaagtggacataaatgccatgcttgaggccgcacccaacagcgcaactgcgtttgggggaaatgcaatgagcgacaccgcgttggacaacgtgacggacctcggaggccatgcggagcaatttgcgcaattacccagtggtcaatatgtaaagcaaggaccactgggtaataccagtaacttgcggataactcggactagctggaaaggaagcatggcagatcccattttgggtgaaggtgcagaacgggaagtccaccaaccaacaagggctgaagtcaacaatgcagagaatggcacctgtgacgatgatcaattgcaggctatcgggaagcgaaatgacaaagtgggaaaggaaatttgctatattagtgaaattgagccagaaattaaaagagatgtcgtgcatgaacaaatattgaggcagaaacagtcacgtgaccatcctagggagcaggataattcaaaaaatatgggcttttctttctgcacccccctcaagggtaatacaccccttgccctcagcccacaatctgaaattgttgccacagccccttcatggcatgtgtattctagaacaaggaggttcaaaaaacaaccacagatgggcagtgcaaatactgaagtccatggaacacaaccacaattaaaggaactcactgaacaccatcagcccgtagaggaagcagggaaagatactaaggggctggggaaagatactaaggggcttaatgacatttctggccaaccggagatattctcatctcgggatgcagtggagaatgtagaccaagaaggaaaattgaagcaagatgcaacagagatgtggagtatagcaaaacaattgggagcaacatcagtagtagaccaagagaggctagaaacaaagaaggagacaattgacaattccttgtgccaggcattatggggagacccgcaggtttcttgggaaatgcaaccagcagttaatactgcaggaaagatcttatgcttgtggagtgataagaccttcatattagagaggaaagttattggaacaggctttatcctgttaattggtcagtggattaaggaggcacaactggggggattatggtgtataatgggggacttcacaacatcagaaatcctcagaaaggttgggagtctgtcagagaaggatggaggacagca

SEQ ID NO: 10176 - DNA, 462 bp, Glycine max
  Peptide Sequence Number=SeqID_101861
atggagaaagatgcatcacacgtaggaccacagaatggaggcttcaatcccttctccttctctctaacgtttggaaaccctaacagagcaaccggaggaggagttctagagagcactaaaaatgccacaattgataacagagaacgcttgagtgactacatcgaggtgcgaattgcgtttcaatttcactatttgcgtttcacttatttctgtgttgcgtttcacttacacactactgattacacaaaaatttttagcactagaggtagagtgcttagttgttacaggagttctcttaccccaaaaattgttgaagctttagtttgtacacaaaattggtgtcgatcttccccattgacaatggaggatgaagagttcgaggatgaattttataatcttgaacaagaaatggaaccaatcccacaattgactgaagataattcagatgttgaatctgattag

SEQ ID NO: 10177 - DNA, 894 bp, Glycine max
  Peptide Sequence Number=SeqID_101862
atgtcttctgcctacggttacgacgactacgatatccatgatgatcagattgagatggagatggactttctgcatgaacggtatcaggaggacaacagaaactatgacgtgtttttgagtttcagaggggaagacacgcgtgcttctttcacttcacatctctataccgctcttcgcaacgcgggaatctttgttttcaaggatgatgagacacttccaaggggaaataaaatttcaccctcgctgcagttagcaatcgaagagtctcgagtttctgttgttgttttctctagaaattatgcagagtcgcggtggtgtttgaaagagttggagaacataatggagtgtcacagaacaacagggcaagtggtagtgccagtgttctatgatgtagatccctctgaagtacgtcatcaaacaggccactttggaaaagcatttcgaaaccttgagaacagacttttaaaagtggaagaggaagaggaagaggaaaagctacaacgatggtggaagacgcttgctgaggccgctggcatctcagggctttctgtagtccgaaattgcaatggtcgaagtgagattttggataagatagatctcctcgcgcagcattggagggaggcacttcgtgaggctgctggcatctcccccggttcagtctcagaattcgggagaggaagcttgattactgaaaagttaacagatctccttgtgaagcattggagggaaacactgtgtgaggctctttgtgaggctgttggtttcgatggtgcagacttatactacagagaaactgtgatggttgataaaatagaactgcttgtggtgaattggagtaaggcactttgcgaggctgttagcatcttggggggtgcacacctaaattccaagtaa

SEQ ID NO: 10178 - DNA, 297 bp, Glycine max
  Peptide Sequence Number=SeqID_101863
atggacaattcgttcaggacacttgtacatgaatgttggacatctcaccaaataaggggttggggaggttacgtgctcaaagaaaaaataaagaggttgaaagcaagcctgaagatatggaacaaggaccattttgtggatacttttaagaaattcaagaagattgaagaagagatgaacaagttggaagagagaacaaccgacagacacctttctcctcaggaagccatgaccatgaaacaactccaggaagagttgtgggtagccgctcaatctcacgaatcattgatgaggtag

SEQ ID NO: 10179 - DNA, 357 bp, Glycine max
  Peptide Sequence Number=SeqID_101864
atgtctcttacaactctttttggaaagcttccggaacacaaaatggaactcattagactaaatcaacatgaagaaaatgacaagaaaaagaaaggaatcacacttaaagcttcatcttcaattaaagaagaaagtgataaagaggacttgaatgaaatagaagaaggacatctgagagttgattgtcctagtttaaagaaaagaatggaaaaattagagaagaaaaccttcaatgctaagaaagcaaagaaagcttacatcacttgggaagatgacaatatggattcatccggagactcagaaaatgaagtcatgaatctaagtctcatggccaaaaattatgaaggcgaagaagag

SEQ ID NO: 10180 - DNA, 495 bp, Glycine max
  Peptide Sequence Number=SeqID_101865
atgtcacaggatgaattacaagaacaagctaaacaaggagctttagtcccacatggtcgtcaagacatcctgaacactgccattggccgtccagagcatcctggacgtgttcgtgttggtggacatggtgtgaccataaccagctactttggacatgcttcctgtgcgtcccacagttcttcgcctgcgatcaccgccgaaagattggttgaaatcatacaaactattaagcaagaagtgaagaaagaggtagaagatgagaacaaagactgtatggacaagatgaaaatggagttggatgcgatcaagactgaattatcccaaattcatacgcaacagtcagctcccccaagaccgtctaaccctgacatatttgttgcacgtgttagcacgaaagagagttgtgctgaagctgctaataatgttgttggtaacgagcggtctacatttgatacattacacagctggtggcagggggaaaggtctttggagtag

SEQ ID NO: 10181 - DNA, 570 bp, Glycine max
  Peptide Sequence Number=SeqID_101866
atggaggagttaaaattatcattggaagccgataaccttgaagacataaagacgaaacttgataatctatttatggtgttggtactacgtgggatgcatccagattttgatcatattcgtgaccaagtcttaactggccaagaagttccttctctagagaatttaattactcggctcattcgagtcccctcaccaaaaataggaggaaattcatttgacagtattgaaacttttgccatggtatctaatcgagggggacaaggtggtcgtggaaaccgaggaggacgagctggaagaggccctcaatgttcttactgtgcttctgatcacattgctgataatagttcattattttcatccctctctcctaaaattcctcatttcattactttagtcgatggttctagagttgcagcaacaggaatcggccatgtatcacccacttcttctttatctttaaacactgtttttctgatacctagttgtcctttcaatataatatctcttagtcagcttactcgttctcataattgttcagtaacatttaatgctaactcctttgtcatatag

SEQ ID NO: 10182 - DNA, 616 bp, Glycine max
  Peptide Sequence Number=SeqID_101867
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaggaaatgtgccgtagatgacgatgctccttcaattgttgggtccaattcatttattgacattaatgaatcacaacaaattaatgagggtcccactgtctcttcttccaataatgtcaacaacaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10183 - DNA, 441 bp, Glycine max
  Peptide Sequence Number=SeqID_101868
atgaagcacttcactgacaccctcatcagtgccaacatacaagggagaagaccaagaggctgcaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10184 - DNA, 805 bp, Glycine max
  Peptide Sequence Number=SeqID_101869
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgccatgaagcacatatctgttcaagaagaattacagattgaatcagctgctgatgaggagtcagttctccctgagggtgcaatggtgcttaatggttcagaatctgaaaatcctgttgattcttttgatagcagcactgctgtagattcacaaaactctattactgaacttaaggagaacccatcctttgttgaaccaaaaaaagtgtccaactttgatcaagcttatcgataccgtcgacctcgagggggggcccggtaccagcttttgttccctttagtgagggttaatttcgagcttggcgtaatcgtggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagataaaaggctgcaccg

SEQ ID NO: 10185 - DNA, 589 bp, Glycine max
  Peptide Sequence Number=SeqID_101870
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagttgccggagtgttcgacgatgctgcagtgggagactgtccttcgatgccggtgactacaatgcagatgattgcgagagagaatgccattgcgatagcgaatgaaatatttatcaggatcaaagggatcaaacgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10186 - DNA, 341 bp, Glycine max
  Peptide Sequence Number=SeqID_101871
atggcatcgaggcggcttgagctgattgcacttccgacagtaccgaacccgtggattgggatcagacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10187 - DNA, 267 bp, Glycine max
  Peptide Sequence Number=SeqID_101872
atgagctatgctactacacctgcacagcctcgactagcgtgcaacgaggttggaggtgcccataggccaactcgtggtgctccaactactactatactgacagctagcggggtcgtatctatatataagcgaatgcaacaccgtagggcgagtactactaccttccactaccagcccaacctgcctctatatactattatatatctggctagcttgacatgcgcacccgatggcttgaccttgaacctatcctataacctctattga

SEQ ID NO: 10188 - DNA, 514 bp, Glycine max
  Peptide Sequence Number=SeqID_101873
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatgaagtatgaactggaaaggaaagctaagaatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10189 - DNA, 288 bp, Glycine max
  Peptide Sequence Number=SeqID_101874
atgaccatgattacgccaagctcgaaattaaccctccctaaagggaacaaaagctggtaccgggccccccctcgagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10190 - DNA, 80 bp, Glycine max
  Peptide Sequence Number=SeqID_101875
gtagcaagataccttggatatgcatgtatatagcaaaaatacctgacaaaaatatacatatgtttaggggatggccttag

SEQ ID NO: 10191 - DNA, 459 bp, Glycine max
  Peptide Sequence Number=SeqID_101876
gagcttaagggaagcagcaatggtgtcatcggcggctatcataaatggtggaaggctcagatgccagggataacttggctcccgaagctaaagagttcaagtggggaagaagctgaagtccctaaggagaacgaagaagtgcaagccttgaaagaagagcttgaaagaacgagagtggtcaaggaaaagctaaagatgacattcaccagggtcaggaaagagtgtgatgagctaagagatgtcaacatgaccacggccgaagccaacaatgaactcaagcttcgaagggccgaaagggatgagtcgagggtggaaagtacgatattagaagacaagttgaaggcttgtaaaaggtcgaagagaagtttgactgaacagctgggtagaatggaaaaggatatgttgacaatcatcgaccagtataaagaaaagctaaacctagctgctagccatgggtag

SEQ ID NO: 10192 - DNA, 208 bp, Glycine max
  Peptide Sequence Number=SeqID_101877
atataatatcaaaattcccaacggtgacaattctcgtaattgggttgcgaacgtggtgctcaaatttcacgacaatccaacggtgaatgagtctgagatcgtcgtttttctgagacaggttaggtggcctgcgggaaaaagagagggttttgggagaagagagaagaaacaacattgtgaggcagaagaggctgaggagtcagtctga

SEQ ID NO: 10193 - DNA, 866 bp, Glycine max
  Peptide Sequence Number=SeqID_101878
atggtgaaagttggaacctcttacgtgccgatcaacgtctcatattcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgattctatcactaagttttccttagcgatatcagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10194 - DNA, 354 bp, Glycine max
  Peptide Sequence Number=SeqID_101879
atgaagcacttcactgacaccctcatcagtgccaacataatatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggggtggtggttacgcgcagcgtga

SEQ ID NO: 10195 - DNA, 117 bp, Glycine max
  Peptide Sequence Number=SeqID_101880
atggatgtcttgtgtcttgctggaacaagtgtgaaaccaaccaaacacagagggcgggcctgctatgccgttccgagtctgttttatgcggtccaaacctctgggctgaatccttga

SEQ ID NO: 10196 - DNA, 695 bp, Glycine max
  Peptide Sequence Number=SeqID_101881
agaaactcaaaacttccttgtcaaaacccatttggcttttaagaagaaaatgcccttgcaatgataaaaagtcagtgcaagtcaaaggaaacacaaacacaaatacaaacaaaaacaaaaccaaaaactccccaaaagccaaaactccacccccacaacctaaaaccctttcacacaaccaaatccacaaagattccttgaattacaaggcaccaccaccaccatcatcatcatccaacaaggaagtgaaggctcaaaggttgttccaattccaaccttccatgaatcaacttagaaaaccctcaagagaaggcttcaatttccctttgttcttggcaacaaacaactccaccaaccccacaaaatcccatcatcatcatcatcatcaagttcttctcaacgtggttaatgaagaggacacaatcccacgtgagtccttgcacgtgttccaacctccaagcccccccaagtcacgtgccatggatgatgatgcagctagtgatgcaagttctgatctttttgagattgaaagtttctccactcaaactactactacacttccataccccattattacaccctccattacccagtgccatgaatccaccgaccacgagttcttcttcgccactgacgccggcggcagcctgtggcggcggcggctgagggatacggaggtgctgccaccactttga

SEQ ID NO: 10197 - DNA, 150 bp, Glycine max
  Peptide Sequence Number=SeqID_101882
atggcgtgtccattgacatgggttgatgcaatcctccctaggaagggaccaatcactagaaccatgagcaagaggctccaagaagattgggctagagctgctgaagaaggccctagggttctcatgaaccttaggggctccatattgtag

SEQ ID NO: 10198 - DNA, 543 bp, Glycine max
  Peptide Sequence Number=SeqID_101883
atgaggctaagtcatgaagtgctaaaagtgacagttgagcttagctcatcagttgggctaagtgcagcttcagtgcacttagcgcgccagaagaatctggcaaagcatcaatatctaggtctcgcgctaagcgcgagatcagatgtaccttatccgttggtaccctctcggaaagataaagagcgacatttggccagattgcttgatatcttcaagaaactggaaattactatgccatttggagaagcacttcagcaaatgcccctctatgccaaatttttgaaggatatgttaaccaagaagaaccggtacatccataatgacagaattgttgtggaaggttattttgatgatgccaaagaatcaagagttaagcaaagtttcaagcaaagattcaagattcaagaatcaagtttcaagtttcaagattcaagattcaagaaaaatcaagatcaagattcaagactcaagattcaagaatcaagagaagactcaatcaagataagtactaaaaagtttttcaaaacattgagtagcacatga

SEQ ID NO: 10199 - DNA, 420 bp, Glycine max
  Peptide Sequence Number=SeqID_101884
atgaagcacttcactgacaccctcatcagtgccaacatagagggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10200 - DNA, 354 bp, Glycine max
  Peptide Sequence Number=SeqID_101885
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgggcgggtgtggtggtttacgcgcagcgtga

SEQ ID NO: 10201 - DNA, 210 bp, Glycine max
  Peptide Sequence Number=SeqID_101886
atgtcaggatttatacgcaattctcctcaaatttcagccagcccgcatcaattagaccttgcaccttacgattcagagccctacaatgctccatggaacgccccggggcttcttcgtgaccagcacacgttgcgttcgagtcgtattctcggagaaatggaggttgatgaaccttggctggggtggtcttcgtcattggaagtgcggtag

SEQ ID NO: 10202 - DNA, 387 bp, Glycine max
  Peptide Sequence Number=SeqID_101887
atggcctccaggaaatgtaagagcattggggcaaggccaactgctcaatataatactagatggttccattcgcttgatgcttggaaccgttatacagataatgtcttggggaggaatattttgctagaaagaaaggttgagatataccacacggagtttgacgacttcaagacagagatcttcttcatcaatggatccctttgcttcttggaagatgaatggcagcggaatggagaaagggagagaaagaggagacgccactttaaggagaagatgagtctagaagaagctcaccaccataggaggccatggataagagcttggaggaagaaggagatgaatgaagggagagggagagaagagcacgaaattttgtgctctaaatga

SEQ ID NO: 10203 - DNA, 615 bp, Glycine max
  Peptide Sequence Number=SeqID_101888
atgcatctctcactatggaaacccatttctcaatgtgctgcactgatcatggacaagaagagcaggaggaaagaagaatccaatgttgaaatgaggagaaacccatcaatgcttcggaagctgcaagagaacaagctcagggaagcacttgaggaagcttctgaagatggctcactctccaaatctcaagacatagaccagcctgactctgctgccaaccaggatgatggccttgggagatcccgatcgctcgcccggctccacgcccagcgcgaattccttcgcgccactgcgcttgcggccgagcgaatcttcgagtccgaggaggaaattcccagcctccaggaagcatttgccaagttccttactatgtacccaaagtaccagtcctccgagaaggttgatcagttgaggtctgatgaatactcacatttgtcaccaaagactattcactattgggagtcttctacgtttagtttgtctgagataactgctaatctgtgtaaccatgcactttatggctgtgccgagagagggaccgttgagtatgatataaaggctaggattatggactatttgaatattcctgagaacgaatatggccttgtgtttact

SEQ ID NO: 10204 - DNA, 174 bp, Glycine max
  Peptide Sequence Number=SeqID_101889
atggatacctcagagccctgcactagggcaatgagaggcaccatgcatgagcctcaagcgaacctaggtgcagatcaaaagttctcacccagtagaaaccctgagtgggaaccaccgccaaaccagcgagaagagcaatgcaaagaacacatgcatgaagttgggcaacaatga

SEQ ID NO: 10205 - DNA, 393 bp, Glycine max
  Peptide Sequence Number=SeqID_101890
atgaaatcaggttttggcactgagggcaacaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10206 - DNA, 204 bp, Glycine max
  Peptide Sequence Number=SeqID_101891
gggcttcccggtatcaacagggacaccaggattttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 10207 - DNA, 417 bp, Glycine max
  misc_feature (328)..(328): n is a, c, g, or t
  Peptide Sequence Number=SeqID_101892
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgngtgtggtggttacgcgcagcgtgaccgctacacttgccagcgctgatgtccggcggtgcttttgccgttacgcaccaccccgtcagtag

SEQ ID NO: 10208 - DNA, 366 bp, Glycine max
  Peptide Sequence Number=SeqID_101893
atggaacaatgtaggcaagggaagtcggcaaaatggatccgtaacctcgggaaaaggattggctctgagggctgggcacgggggtcccagtcccgaacccgtcggctgtcggtggactgcttgagctgcttccgcggcgagagcgggtcgtcgcgtgccggtcgggggacggattgggaacgggcccttcggggcctcttccccgggcgtcgaacagtcaactcagaactgattcccactgtccctgtctactatccagcgaaaccacagccaagggaacgggcttggcggaatcagcggggaaagaagaccctgttgagcttgactctagtccgactttgtgaaatactgagaggtgtaggataa

SEQ ID NO: 10209 - DNA, 321 bp, Glycine max
  misc_feature (275)..(275): n is a, c, g, or t
  Peptide Sequence Number=SeqID_101894
ctgtccctcctgtttcagctactgacggggtggggcgcgtcccattcgccattcaggctgcgcaactgttgggaagggcgatcggtgcgggcctcttcgctattacgccagctggcgaaagggggatgtgctgcaaggcgattaagttggtgcacactccttctatcaagcttatcgataccgtcgacctcgagggggggcccgtcgggaaacctgtcgtgccagctgcattaatgaatcggccaacgcgcggggagaggcggtttgcgtattgngcgctagcggagtgtatactggcttactatgttggcactgatgagg

SEQ ID NO: 10210 - DNA, 224 bp, Glycine max
  Peptide Sequence Number=SeqID_101895
atgaaggcactcacctggcagggcacgcgcaccgtgacggtcgacgaggtacccgatccggtcatccagcatccgaccgacgcgatcgtgcgcatcacctcgtcggcgatctgcggatcggacctgcacctgtacgaactgctcggaccgttcctcgacaggggcgatgtcctcggacacgagcatcaagcttatcgataccgtcgacctcgagggggggcccg

SEQ ID NO: 10211 - DNA, 480 bp, Glycine max
  Peptide Sequence Number=SeqID_101896
atgaagcacttcactgacaccctcatcagtgccaacataggaacaaaagctggtaccgggccccccctcgaggtcgacggtatcgataagcttgatgtagctcttccttacaaactcatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10212 - DNA, 572 bp, Glycine max
  Peptide Sequence Number=SeqID_101897
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgggaaaccaaagatagagtatagatgtcccaacatcctcatattctgcattcatctttctgcatttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10213 - DNA, 645 bp, Glycine max
  Peptide Sequence Number=SeqID_101898
atgccgctcagccagcatggaattgatggattaggagggttgggtgctacggtggtggatgctctcgacacggctatgatcatgggtcttgatgaggttgtggctgaagctggatcctgggttgaagaacacctttctgagagaattagtaaaaagggtcaagtgaatttatttgaaaccacgatacgggttttgggtgggcttttaagtgcgtaccatctaagtggtggggagaaaggaacgaacttaactcatgcaggacctaaaccagcagtttatctagaaactgctaaggatttggctgaccgtctgctatctgcttttacggccagtccaactgctattcctgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10214 - DNA, 583 bp, Glycine max
  Peptide Sequence Number=SeqID_101899
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaacccggatgtgctgcaaggcgattaagttgggtaacgccagggttttcccagaattcgatgacaagatcgtcccagagttctccttccaacttcactttattcctcaagtcatgcagggatacgaactacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10215 - DNA, 228 bp, Glycine max
  Peptide Sequence Number=SeqID_101900
atgatgcccctagggctgcaaactcgtaaatcccgtgggggttgctcgcccaggcgagctcagcttgcccaagcgagcaaacctgccattttttttaggggaaacataaccatggccctctacaggatactaggctaccttgcagcgacgttttccgcttgtccagcgccgggaagagacgacaatctgtcggtcgtgaccctatcctctatttgcatccgtccctaa

SEQ ID NO: 10216 - DNA, 153 bp, Glycine max
  Peptide Sequence Number=SeqID_101901
atgataagcataagttgtgttgggattgtaccaacgagggaaaggagattggtagatcttcccgaggttcaccaaccaccatttgattggaagggttttagacgtgagccgaaaagcttggttggtgtggggaatattggttgtgttgattaa

SEQ ID NO: 10217 - DNA, 492 bp, Glycine max
  Peptide Sequence Number=SeqID_101902
atgaagcacttcactgacaccctcatcagtgccaacatagaaacagctatgaccatgattacgccaagctcgaaattaaccctcactaaagggaacaaaagctggtaccgggccccccctcgaggtcgacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10218 - DNA, 316 bp, Glycine max
  Peptide Sequence Number=SeqID_101903
tgcgtcgggtgatgctgccaaccttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaa

SEQ ID NO: 10219 - DNA, 423 bp, Glycine max
  Peptide Sequence Number=SeqID_101904
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcgggtgcttttgccgttacgcaccacccccgtcagtagctga

SEQ ID NO: 10220 - DNA, 552 bp, Glycine max
  Peptide Sequence Number=SeqID_101905
atggcagctcgtggtagccaccagttgtcgtgtgtggtggaagaggagattctagggttgtttaggggaagttttgagagagggaggaatgaaatcgtgttttttatgcttaagaacggctccataatatcggtaagcttccaagaagcaaaggaatccattgatgaagaagatcctaggcctacaagctccaatggagcttacatcacaagtttaggccggataggcttctcgcaccttgtagaagcaaaacttcatgatgaatcaagattgattcaaaggtgttttgatgataacaaagatgatgacaaaggtgatgacaaaaagctcaaaggtcaatcaaagaatgagttcaagatgttcaagatagaattaagaacacttcaagactcaaaaggaaagttgaagaacacttcaagattcaagaggaaagttaaattcaagaatcaagaatcaagattcaaggatcaagctttcaagactcaagattcaagaatcaagagacgacataatcaagataagtatgaaaaagttttttcaaaaactgagtag

SEQ ID NO: 10221 - DNA, 624 bp, Glycine max
  Peptide Sequence Number=SeqID_101906
atgaacccaaaagatgttggtcttttgtgtccagtgatcaacccagatggaaatcctgcttcttgcgatgaacccaaggaacggaccaaggagagggatgccaacaaggggcttgaagaggagctaacaatgtacatgaaggaggccatggagcagcttgaaaaaaggtttcaaaaggccgtcaggcaagccaagttcttcaccaaagatcccaacttaggtctttttgatcctttcaaagacgtgaagaacgatgttctacttgatgaaaaagaaattgtcgtgaaggaggaggttgttgttgaggagcagggtgctaaaggaaaagtggatgacgcaaagtcatctcaggtcttgtcaactagtctggtgataggtcgtcttggcctatggagctcttctcccttgatgcctagaccttggactagggttattgtagttgctgtgactgagtggaccaaggggggctctccaagggtgaaccttgagtttaacgagctttgggttagggatgtgtttgccctacattttgaaaagcctgtaaagttgcgccgaggcttacctaggacaaaccttgggttttgtgaacctgtgagactcaccaagggtggaccttgggtttga

SEQ ID NO: 10222 - DNA, 444 bp, Glycine max
  Peptide Sequence Number=SeqID_101907
atggcgaaacggaccgaatcgaagatgaagaattccggctccgggccgaagaacgcggtttcggcgatgccggaggacttcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccagcagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10223 - DNA, 294 bp, Glycine max
  Peptide Sequence Number=SeqID_101908
atgggaaaggtgaagaaaaggataatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10224 - DNA, 444 bp, Glycine max
  Peptide Sequence Number=SeqID_101909
atgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgattcaacaaagagtagtggggattgtggtggacgacaccatcgagtttgtgtagaacaattagtgagcaaaggtcaagctatcaggggtaccgagctcgaattcgtaatcatggtcatagctgtttcctgtgtgaaattgttatccgctcacaattccacacaacatacgagccggaagcataaagtgtaa

SEQ ID NO: 10225 - DNA, 487 bp, Glycine max
  Peptide Sequence Number=SeqID_101910
ggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10226 - DNA, 424 bp, Glycine max
  Peptide Sequence Number=SeqID_101911
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccaacacacgcattcagctccaagtgacccccaaaaggggatcctctag

SEQ ID NO: 10227 - DNA, 232 bp, Glycine max
  Peptide Sequence Number=SeqID_101912
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgacagactaacaatgctagagcccagaatcatctcttgaaaaggatatatgggaagattgacaagatttatacctaa

SEQ ID NO: 10228 - DNA, 330 bp, Glycine max
  Peptide Sequence Number=SeqID_101913
gtcgactctagaggatccccctgcacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtcctcgccttgagagggctacacgccctcaccttgggtactag

SEQ ID NO: 10229 - DNA, 510 bp, Glycine max
  Peptide Sequence Number=SeqID_101914
gagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccactgaaaacttctttgtgattacgggagcttgcaagtcgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10230 - DNA, 339 bp, Glycine max
  Peptide Sequence Number=SeqID_101915
atgactaggggcaatccaggtgttttaaaaccctttgatcctaaaatagatagaacctttcatagattagttaggcatagtgtgcatcctggtcattctgtgcattttgagcattctgcgcattctgttgagggtgattctgaatattctgattttgagcattccactaccaattttcatactaagaacatggatcaacctgcacctcgtgagaggactcttagggagatggctgcacctgatttcacttatgaaagcttgtgcattcaatatcctgatgagggtgttccatattgtcgcaacctacccttcggcgggagggcgacgcatggctcgcgg

SEQ ID NO: 10231 - DNA, 147 bp, Glycine max
  Peptide Sequence Number=SeqID_101916
atggcccacaccaagaaaactggtcaaatgacgtttgaggtagcaaagaaaattgccaataagattgattccttgaaggagcagacctcacaaggttcctttgtcacccatggacgtcgggatgtactaactgctgccatagggtga

SEQ ID NO: 10232 - DNA, 339 bp, Glycine max
  Peptide Sequence Number=SeqID_101917
atgaccactcttacacagatatggatgacgttgctacttagcaacattctgcccagtgaccccaatgccgatctccccctacagaagatcgcacccacaagacccccagttgacccggagaagtccaacagggtcctggggtttccagctctgattatgggcctttgtcagttctacggagtgcccgtgcccccaacaaggtcatcaggccccttattaaccggactttcatcaagaagtactgcgccccccaggcaggcgcagggcaagacaccggcagtgggtaatagtcgcaccgccaccacctccagagcccctcagctcatctacaaaggctag

SEQ ID NO: 10233 - DNA, 490 bp, Glycine max
  Peptide Sequence Number=SeqID_101918
gtcgactctagaggatcccctcctgagggaaacttcggagggaaccagctactagacggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacagg

SEQ ID NO: 10234 - DNA, 358 bp, Glycine max
  misc_feature (16)..(16): n is a, c, g, or t
  Peptide Sequence Number=SeqID_101919
gaagcggaagagcgcncaatacgcaaaccgcctctccccgcgcgttggccgattcattaatgcagctggcacgacaggtttcccgactggaaagcgggcagcagaggagatatatacagcaactgcaagagcagtgaaggaggaaactgggatcgatacagatttgattcaagtgatagcattcagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10235 - DNA, 378 bp, Glycine max
  Peptide Sequence Number=SeqID_101920
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacgcataccagaacttggatttggcacggacctcgttagttgcccagagtttcatgcggtagatcttaggatgctcatcggattcggtagggggatcctctag

SEQ ID NO: 10236 - DNA, 291 bp, Glycine max
  Peptide Sequence Number=SeqID_101921
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccgacgcgcaagcaaggcgaagtcctgtggcacaaaaacccggccaggttctgcagtgtggggatcctctag

SEQ ID NO: 10237 - DNA, 460 bp, Glycine max
  Peptide Sequence Number=SeqID_101922
cttgaggccttatcaggttagatgggatgccaccgtgttcggggtcgttaatccagatttccccctgtacataaagctcgaagacctctccgaaatcgcacacggtggtcaatgtctcagcatatcagtgttacagttgtggattctgcatctcactgaaagatgcatgcgagcggggaattctgatatctatggattccttgagcctcagtccattcagaggttacactgtgtcgcaacctacccttcggcgggagggcgacgcgtgactcgtgggatgcgtgttccacgaaaggaatacgcgcggagtcgccaccaacgtttatttgaggaaaacgtcggaaaaaccggaaaagacgcgatctacgaacttttaagtgaaaaggttcgggagttgtatttacgcacggggaaggtattagcaccccacacgtccgtcccaagggacggcagcctttaa

SEQ ID NO: 10238 - DNA, 414 bp, Glycine max
  Peptide Sequence Number=SeqID_101923
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaaatttaagtccaccttgactagcaaatttgtgtttgctaacactaacggccaacaaacgcaagatgttgtcacaaaatatggtctagatcctgaaacttggaaagaatttgcagcaacccgccagacacctaactgggag

SEQ ID NO: 10239 - DNA, 307 bp, Glycine max
  Peptide Sequence Number=SeqID_101924
ctgtccctcctgttcagctactgacggggtggtgcgtaacggcaaaagcaccgcccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 10240 - DNA, 864 bp, Glycine max
  Peptide Sequence Number=SeqID_101925
atggcaccccataccctaaaaacatcaaatcctcatatcttcttcatttcttcaccaaatcgcttcaaacaaagtgcgaaatacttctcttcgaatcctccacaaaaaccactgattgaaattttcagaaacttcaccaaatggcataatcgtcaaagaggcgcaagggctcatcatcctccaccaccactgtcggccaccaccacggtccttttggtgaccctcaggcaccacccaatccatctttttcctcatcgcgctctctcactctattttccactaatgtccaacgtgagagtgggtttcatgactaagaaatttccatattaccctgaattggttcgagtgtcttataacaacttgaaaattcatgaagaagtgatattttctgaaatgaacaaaataacaattgttgttgatcaatccttgttttactccctaaccaaactaagcagtcaaggtgtgccttttgaaggaactttagttgatgattggaaaccaatttattatagtcttgatgctcataaaatgaaggcattacgtgcaaatgcccctctaccatattcccatctggttactctgtttttgaagcacttcaaagtccctcttactaatgaaccatctttcaaggttaagcgttcatttacaataggagccgttgtattgcttcttttggttataagaaagatcttgatggacaatagggatccctcctttgctttactaaatgatgttctcaacgagattcaggatcttcacgcttttgttggagaaaggtttgattccatgcattgtcacatcactcgtcttaaggatgacatgggatttatccaccgttgctttgatccaccaaccgatccttag

SEQ ID NO: 10241 - DNA, 273 bp, Glycine max
  Peptide Sequence Number=SeqID_101926
atggaccccgacaggtgcagagaaatgcgaggaactagaatcagagaggtggcatgcaaaccgaggcaggattttagcatccaaaaaggtccagtttttttctcctttatgactgagtatgaggtcaaatcaaaggaaaagaaacttccagcagccctctttctccctccatgttgctttttcttcctcttcttctcctccattgttgtccctcttgaagctccaaattcctcttcatttctaccccaaattgcaaggaaaagctatttttga

SEQ ID NO: 10242 - DNA, 738 bp, Glycine max
  Peptide Sequence Number=SeqID_101927
atgagggcgagccctggtgcagcggtaaagttgtgccttggtgacttgttggtcatgggttcgaatctggaaacagcctctttgcatatgcaaggaaaccctatcggcctatccttcttcctctcacagtttcgctttgtcgctctatgccgccactctacttgtcaacctctccttccttcctctcatcatggtgtcgtgttgctgccatcccttgttagactcactcagttcatctgcaatgttgtgggaggtgcaaggtgctccatcgttgcaatggttttcataattggtgtggctgaagcaacagattatatcgttggtgaaggcttcggatggagcgttccctccaatgagagcttttatacagactgggctagcaccaagagattcttcgttggtgacaatctcattttcaacatcagcggagagcattcggtgggaattagaacagaggctacttattatgagaattgcaacaccagcttattaactggtttcacgttcataggcgtcaatgggagtaattcgatgtttcgacataatattattcctccaactgggcctcgctatttcctctgcaccgttggaaatcactgtgaaagaggccagaagtttagtatcagcgttgagtctcatcctgattccgctgctcctactacactgtcattcagaatcttatctgcatttctctctagcttggctgtgtatttcttcactgttactacaattctttga

SEQ ID NO: 10243 - DNA, 330 bp, Glycine max
  Peptide Sequence Number=SeqID_101928
atgaaggagagggagctgataacaatgattgtagacacgttaccggtgttctactatgagaagatggtggactacatgccttcaagatttttcgatttagtgtttacaggtgagaggatcaaagttggcctaaaaagagaaggcctggggcaaatggaaggaataagaaggagggagaaaccatgttgtggctgccgttcctacatggtcaaatttcccattagccaaacaatatcaatactcgaccaatatcagtccttctcattaccccctaccctaccagccaagaacacccaatcacccacaaagaccaccccaaatcagccataa

SEQ ID NO: 10244 - DNA, 189 bp, Glycine max
  Peptide Sequence Number=SeqID_101929
atggatacctcagagccctacactggggcaatgaaaggcaccatgcataaacctaaggcgaacctaggggcagatcagaagttctcacccaataggttccctactacaagaaaaaggggggacaaaccctgggatttcaatgggttgattaaacggctacattgccgtcactctaaaattgtcaagtga

SEQ ID NO: 10245 - DNA, 72 bp, Glycine max
  Peptide Sequence Number=SeqID_101930
atgccaagaccagacaaacccaattggcctacgatgcatttctacccacatctgttgactgcttgcccctga

SEQ ID NO: 10246 - DNA, 147 bp, Glycine max
  Peptide Sequence Number=SeqID_101931
atgtcgctgcatgggcaagatcatcttgagctaccttctggggtggggacaaaacgtggacagcagaaaccaatcaaggtacttaggaacggatgcaagtggggatggggtcacgatcgacagatcgttgccctttctctacgctag

SEQ ID NO: 10247 - DNA, 541 bp, Glycine max
  Peptide Sequence Number=SeqID_101932
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctgatacaggtgtggtctgctatggtgtgtttgaaggccaagaagtactcggtttacggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10248 - DNA, 564 bp, Glycine max
  Peptide Sequence Number=SeqID_101933
atgactttgctacatatagcatggaagaaaaagcacaggcgagttatcgctaacctgactttgtttggcaagatgtctcgtatagccacgggtatccttgtggaaccttcactcgacgaagacactgacaaaaacttatcttctccttcttggacaaagtatggcaggctgggggcaaccatcctacgtcttgccttgaatgttaaggagcgtcccaatcacactgtcacaaacatttttctccacatgcataacatcaatacattgtctaacgtcaagattacaccagtatggaagatcaaagaaaatggacctcttcttccatatgcaactctgacttttatccttcttttgggtcttcccaaatacaatattcagttgtatgtgtcataccctaatttcgtccggggacctttgcttgatgacatgcgacctttctttggtccttgtgagaatattcctccagaaggctgttgcttctggaggaagcaacctggctcgcctgggcgagctgagctcgcctgggcgagctgggcggcaaccacctcccctattttgctataa

SEQ ID NO: 10249 - DNA, 450 bp, Glycine max
  Peptide Sequence Number=SeqID_101934
atgaagcacttgggtgacaccctcatcagtgccaacataaatgagctatttattggaatttggaagagttttatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10250 - DNA, 231 bp, Glycine max
  Peptide Sequence Number=SeqID_101935
caacaaggagcagattcttggatttggaagcaacattcgagcggtatctattcgaccaaatactgcttacaagtttctgatggaggaaataaggggggatccagtggatgggagctttgtgtttttgtggaagcttaagataccacctaaggcaaagatttttacctggagactcatcaaagaccgcttaccagctatgttcaaaatatatttgtactcacagtgcctctg

SEQ ID NO: 10251 - DNA, 382 bp, Glycine max
  Peptide Sequence Number=SeqID_101936
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10252 - DNA, 517 bp, Glycine max
  Peptide Sequence Number=SeqID_101937
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataattatgaaaggttcaggagttgtatttacgcacggggaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10253 - DNA, 229 bp, Glycine max
  Peptide Sequence Number=SeqID_101938
gaacgtggtacgggtcggacgaattggtgtaagacatgaatctcatggtctttacaacctcaagcctaatctttcttggcgcagggcattctccatcagtcctcttgtcctcatactcctcaacagaatggcattgccgaaaggaagaataggcaccttgttgagactgctagaacattattgcttcatgccaatgtacctgtccggtattgggatgatgcagttttga

SEQ ID NO: 10254 - DNA, 153 bp, Glycine max
  Peptide Sequence Number=SeqID_101939
atggctgatgccaagtttgcgggggctgcttgggtcggcggtgctgggttatggccccgtgctaagtttcggattggttggccccctcctcccccccgtgatcagttttgttgccaggattttgccaactttggcttgcgccccgttggctaa

SEQ ID NO: 10255 - DNA, 360 bp, Glycine max
  Peptide Sequence Number=SeqID_101940
atgaagcacttcactgacaccctcatcagtgccaacatagtgatcattaaattaagtcttttcacatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 10256 - DNA, 294 bp, Glycine max
  Peptide Sequence Number=SeqID_101941
atggagcattatctacagcacttggttcgccagcaggcggccaaccaccgggggcaggtgcagatacatgagtgtctctaccggttcagcctcattcaacaggggcagggtttcgctccttttgcatgtcctactccagagcaatttggggctgaggtcgcatggcccggagactggctcgaggcccaagcaagggaggagcccgcaggatcccctggtgaggcagaggaggcccacatggatgaagaaatgaatgacttgctcgatttcttgggaggaagcggagccacgtga

SEQ ID NO: 10257 - DNA, 695 bp, Glycine max
  Peptide Sequence Number=SeqID_101942
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgacatttggccatggcaaatacctgaacactatgttttaggttccatgtgtaataaatatggtactcgggcatttgacatgactgagcacctgcatggccgcatacctgctactagtataagagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggggaa

SEQ ID NO: 10258 - DNA, 411 bp, Glycine max
  Peptide Sequence Number=SeqID_101943
gtgctccagtggcttctgttttctatcagctgtcccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 10259 - DNA, 625 bp, Glycine max
  Peptide Sequence Number=SeqID_101944
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttggcgaattggagctccaccgcggtggcggccgctctagaactagtggatcccccgggctgcaggaattcgatcccattagatggcataattctatgcagcaaagtagcagaagatgacataggtccacgcccacgaagggatatcgcacgtccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10260 - DNA, 550 bp, Glycine max
  Peptide Sequence Number=SeqID_101945
ctttgcttctactgattcttccgagtttccaccgattaaacttgctatagaagcaaaaggggaagaatctagtgaagaaatctacccccaagaagaaggacaaccattagtggttaaagagaagtgtaagggggcaagtgtctcctccaagagtttagctaagaaggaaactcattttacaataaaaacacttgctaaaaagacacttgctagcattgccacacctcttgggcttgagtttattcctcaagtaaagaagttgttggatgagggtttggtttgcaaaagcttaaatccttgtgctttgttggggcccagaataggtattattaagcaccaagtccctaaaataggtggtatgatgaatgttttgaatggtgcaaccctcttttgtaaaatcactcgtgcacccaacatcttcatggtgtgtgtacacagggacccattaggtagtgatcaaggggtttccatgaaccctaagagaataaaggtcattcctaagtggcccactccaccaagtataagacaaatttggggcttccatgactaa

SEQ ID NO: 10261 - DNA, 378 bp, Glycine max
  Peptide Sequence Number=SeqID_101946
atgaagcacttcactgacaccctcatcagtgccaacatagggggaaaaaggaaccacttccaaactaacactaaagacaaatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 10262 - DNA, 234 bp, Glycine max
  Peptide Sequence Number=SeqID_101947
atggggggggggggggtgatcgcacatccccctttcgccagctggggtaataacgaaaaggcccccaccgatcgcccttcccaacagttgcgcagcctgaatggggaatgggaagcgccctgtagcggcgcattaagcgcggggggggtgggggttacccgcagcgtgaccgctacacttgccagcgctgatgtccgggggggcttttgccgttacgcaccaccccgtcagtag

SEQ ID NO: 10263 - DNA, 627 bp, Glycine max
  Peptide Sequence Number=SeqID_101948
atgggtctaccctccaactcctacgttggcgtgagtggtgggatgataaatggactggtcatctgtgaagcttttagttgctttctttcttccgaccgtcaggtgtctcccttcgctcagtcattccattcagtgcaggcattcctgctttctaccattggtggcgacttcgcgcgttttccttccttggaagacgcaccatcgagtctcgcgtcacgctcccgcagaagggtaggttgcgataggtaccaaaggatccttcatgcacctccaatagtatctgaatggaaatttgatttctttgtgcatgatgcccgccggttggtttgcaccaaccaagcggatatgaccggaaggcttcttgctggttcattggcttttgaaagccgcatcctccattaccttatagttcgcattttgcttcctagatcttcaaaccttgcccaggtttctgaagaagatctcattttcatgtgggcctttcataaaggtttacaaattgattgggcacatcttgttagatatcgcatgcataaggcattgcgattgaatgccccattgccttatcctcaccttgttaccctcttccttcaacatttcaacatccctcttgattctgaaccttaa

SEQ ID NO: 10264 - DNA, 375 bp, Glycine max
  Peptide Sequence Number=SeqID_101949
atgaccatgattacgccaagctcgaaattaaccctcactaaagggaacaaaagctgggcagtagttgcatcattaggaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 10265 - DNA, 120 bp, Glycine max
  Peptide Sequence Number=SeqID_101950
atgttgaaacaatgattgaaagttttcaacaacaacaagaaatgggtgtcattgaattgtgcgttgaagtagatgttgtcggtgcttctgcatcgaatgtgacaaattcgctattatcat

SEQ ID NO: 10266 - DNA, 312 bp, Glycine max
  Peptide Sequence Number=SeqID_101951
atgtctcctccacctttagaacctcacaatcactcacaaactcatctcaagctctcaggacagcttcctcttcaagctcggttctctgcaggtggctttgttcgtgcttgtgcgcttagcgcaactttggaccgcccagcgcgcattagtggattttgtcttagcacgtacttttctcgctcagtggatggactgaagcggtgcgttttgctggatgacccttcgcttagcacaaatgcacaactcatccttcttccagattcttcctcacgctcatccgaggagtgttgcgctcagcggatgactcgctaa

SEQ ID NO: 10267 - DNA, 411 bp, Glycine max
  Peptide Sequence Number=SeqID_101952
atgttaaggcagataggagttgctcttggaatagaagttgatgacaaaatgtcacagcacgagtgttatgaatattttggtccagattatacccttcatgtttccccaagtaacatggaaaacaagaattcccatcatttacttgaagaaattagatctaaagtacgtgaaaatctttccaagctgcagcatgctcctagtgtccaatttcaggaaaggcctcctgattctgatcttggagaggtctctaaagaggttcttcttaaagggatgttaattccagtgaacttgatgcaatcctaccccgcaagggcattggatagaagactccaagtagattgggctagagatgcaagaaaaggccctaaggttctcatgagccttagggcagatttcggacctatgggctaa

SEQ ID NO: 10268 - DNA, 495 bp, Glycine max
  Peptide Sequence Number=SeqID_101953
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattctagttccagggagtggccgtttaaattttaggtatagatgggttaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 10269 - DNA, 827 bp, Glycine max
  Peptide Sequence Number=SeqID_101954
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaaggttagatacggaatcttaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10270 - DNA, 468 bp, Glycine max
  Peptide Sequence Number=SeqID_101955
atgaccatgattacgccaagctcgaaattaaccctcactaaagggaacaaaagctggtaccgggccccccctcgagatgaatgctcaaaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10271 - DNA, 191 bp, Glycine max
  Peptide Sequence Number=SeqID_101956
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagacgatggacttcttcatactacatgtggcactcctaggggtgttgctcctgag

SEQ ID NO: 10272 - DNA, 149 bp, Glycine max
  Peptide Sequence Number=SeqID_101957
gtgctccagtggcttctgtttctattcagctgtcccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 10273 - DNA, 150 bp, Glycine max
  Peptide Sequence Number=SeqID_101958
atggttgacaacacacgcatgaaggagcttacaggggatgtcaaaaggatcctggagatgatggaaaaccgcaataaagaatatgctgctcggttaggaatgttaagattgattttcccagatttgatggatcatcaggtcttggaataa

SEQ ID NO: 10274 - DNA, 263 bp, Glycine max
  Peptide Sequence Number=SeqID_101959
atggcccaggacaaagcagcaagttcaggcccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10275 - DNA, 330 bp, Glycine max
  Peptide Sequence Number=SeqID_101960
gggacacatgtcccagacattgtctcgacatcagggaaagctgctgcttcaggtgctgtgtccaaggatgctctgattgctgaactcaaggacacatgcaaggtgctggaagcaaccatcaaagccaccacagagaagaagatggagctggaacggctgatcaaaaggctctcagaaagtggcattgatgatggagaagcagctgagcaagaagatgaagcagctgaggaagaggtagaagcagccgaggaagaagaagaagctgctgaggaagaggaaaatgcagcagaggatactgaatcagatgatgattctgaagccaccccatga

SEQ ID NO: 10276 - DNA, 414 bp, Glycine max
  Peptide Sequence Number=SeqID_101961
atggggtggcttcagaatcatcatcatcggattctgtatcctctgctgcatcttcgtcatcggcttcttcttcttcttccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 10277 - DNA, 234 bp, Glycine max
  Peptide Sequence Number=SeqID_101962
atgatgacaaaggtgatgacaaaaagctcaaagatcaatcaaagaacaactcaagtgaatcaaagatcaatcaagaacaattcaagagttcaagataagaatcaagaagaattcaagactcaagaagaaagtctagagacaagaatcaagattcaaggttcaaagatctcaagaatcaagatcaagattcaagactcaagattcaagaataaagagaagattcaatcaagacaa

SEQ ID NO: 10278 - DNA, 498 bp, Glycine max
  Peptide Sequence Number=SeqID_101963
atgaagcacttcactgacaccctcatcagtgccaacataattgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccgggcggtgcttttgccgttacgcaccaccccgtcagtagctgaacaggagggacagctgatagaaacagaagccactggagcacctcaaaaacaccatcatacactaaatcagtaa

SEQ ID NO: 10279 - DNA, 477 bp, Glycine max
  Peptide Sequence Number=SeqID_101964
atgaagcacttcactgacaccctcatcagtgccaacatagagcttgaaggagctcatggcacaagcggtgcaaaccccagagcagcaagtttacctcgctcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10280 - DNA, 480 bp, Glycine max
  Peptide Sequence Number=SeqID_101965
atgaccatgattacgccaagctcgaaattaaccctcactaaagggaacaaaagctggtaccgggccccccctcgaggtcgacgagttaatgttccagcagaaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10281 - DNA, 234 bp, Glycine max
  Peptide Sequence Number=SeqID_101966
atgactcggcaggaggcgtcagaagcgcatctctatgtattaaacaacacagccaaggcaaggaataagggcaaggaacctttagaaggacttggaggacctatgacaagggctagaacaaagaaggccaaggaagctcttcaacaagtattaaccatgctatttgaatttaggcccaagttacaagtggagaagcttcagattgttaattgcaccatgttccaagaagagtag

SEQ ID NO: 10282 - DNA, 450 bp, Glycine max
  Peptide Sequence Number=SeqID_101967
atgaccatgattacgccaagctcgaaattaaccctcactaaagggaacaaaagctggcctgagttcctcatcacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10283 - DNA, 417 bp, Glycine max
  Peptide Sequence Number=SeqID_101968
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttggcgttacgcaccaccccgtcagtag

SEQ ID NO: 10284 - DNA, 700 bp, Glycine max
  Peptide Sequence Number=SeqID_101969
atggcaccagtgactatgggattatgtactgtcattgttcagattcaatgctggttgggtattgtgatgctgattgggctggaagtgcagatgacagaaaaagcacttctggtggatgcttctatctgggcaacaatcttatttcatggttcagcaagaagcagaactatgctcaaggagtacaatgtcgaacaagatgtcatgacattatactcattccccaactcctctcagagattcacgaaaccactccaaaggctctgcttctccatggctacctcaccaaaagaaacttcatctcctggttcaccctctgtaccatcatctccatcatccaccaaagcaccttcaaaccaggaacaacctgaattcaatatccaacccatacaaatgattcctggtcaagcccctattcctgagaaactggtccccaaaagacaacaggaagtgaagatttctgaaaaccctagccttgcaacaagtcctagggaagtagacacggagatggataagaagatccgcagtattgtgagtagcattctgaaaaatgcttctgtccctgatgctgataaagatgttccaacatcttccaccccaaatgctgaagtcctctcttcatccagtaaagaggaatcaacagaggaagaggatcaagccacagaggagacccctgcaccaagggcaccagaacctgctccag

SEQ ID NO: 10285 - DNA, 1587 bp, Glycine max
  Peptide Sequence Number=SeqID_101970
atgagggagtttccttcttgttttggagaaaatggtgttcaggttgctgactcatcctcatcaagcaccacaagagcagcacaaaatgtggtcacgtgtgtctatcagtgcaaattaagaggccattcaagcttgattacagtctcgtggacaaaaactctgattggtcaaggcttgagtgtggaaattgatgacttgggaaagcattgcctctgcaaggttgagataaagccatggctcttctcaaagagaaaagggtcaaagaatttggaggtccaatctggtaaagttgacatcttttgggatttgagtagtgccaagtttggttcagggcctgagccaatggaggggttctacttagcggttgtgttcaacaaggagacggtgttgctcctaggggatctaaaaaaagaggcatgcaagaagattgagagtgattgtgcttgcttttctcactctggtgctattttcattgcaaagagagagcacatttttgggaagaagttttatggtgcaaaggctcagttttgtgacaaggggcaggtgcatgatgtcacaattgagtgtgacacgttaggactcaacgatccttctcttgtgattcgaattgatagcaagacagtgatgaaggtgaagcgtctcaagtggaagttcagagggaatcacaccattttggtggatggtgttcctgttgaagtgttttgggatgtgcatagttggctctttgggaatgctatgggcaataatgcagtgttcatgttccaaacatgcatttcaaatgacaaaatgtgggaagggcaatctgtttctgatccctcatgggcttcttctcagcagtttagggattcccaattgcaaggccttggtggcggcgagaatgagcttgccattgggggagaatttggcgaaggagacagcaggggccttatcttcgatgagggtcttcaagagattgccggtttcggtgtcccaaatcttgcaggagccgtcgtggctggcggagatgatgaggtttccgtcgcggttgtagtggacggaggtgacgggcatggtgtggccctttatggtgtggacgcatttcccggtcttcacatcccaaaccttgatggtctcgtcgaaggaaccggacacgatgtagctcgattgggggttgaagttgacgcagaaaacggcgtcgtcgtggccgcggaggatcttgatgcagccgccgccgacggtggcgtcccagatgcggagggtgcggtcgtcggaggcggagcagatgtagtgggagccgaggctaggagggttccatcgttcgagaacttcacgcacgacaccgcgttttcatggtcgcccgccacacctccgccatctgcctttgacaacgatagccacaccactaccataggtgaaggcaccacaatcactattgttgaagccacttcacagttgaaggcaagtgttttattcacaattgagctttacttcaatgaccttggtggcggcatcgatgaaaaaggagaggtggagagagctaccatagacccaagtgatggaggggcaacaccatggtggagacaagtaaagtgggaatataaaaaataa

SEQ ID NO: 10286 - DNA, 726 bp, Glycine max
  Peptide Sequence Number=SeqID_101971
atggcaagcacaagaaatctgaagcacctcaacctgaacctgaacctgaacatgtgttgttcaaattcagctactcatgaatgcgaatctcctccattgagccccataactagttcctcaaatcacaataacactactcaatgtccttctccttcttcaattatgataaagaacttcaactctatctatgaccctaccttaacctctcatgaccactctttcagctctaccttcttcgagcccgaacccgctgacttcgccaccgccttcgcctcccaacgcttcttcttctcctccccgggcctctccaattccctagttgaatacaacaacaccaacaaaagtactactcgacacccagcattgttgagagaacatggtgagaagatgaaggaggaggaggaggaggaggagaagaagaagaaggtgttgttcaaggggagcgtggcggtggcgacgtactcgccggatccttacgtggatttccggcggtcgatgcaggagatggtggaggcgcggccggagctgatggacgtgaagtccaattggaatgttcttcacgagcttcttctatgctatcttgcgctgaatccaaagagcacacacaagttcattcttggagccttcgctgatcttctcggtggggaacctctatactcatacttgtcccctccatgcattaattcattcgctgtcctctactccatctttcactatcctccttaa

SEQ ID NO: 10287 - DNA, 99 bp, Glycine max
  Peptide Sequence Number=SeqID_101972
atgggtcgcaccttcgacgacaatgcggcggacatcgccgacgtcgtgcgccaaggaatgctagctgctgagttctcagggaaattgaggctgcattga

SEQ ID NO: 10288 - DNA, 588 bp, Glycine max
  Peptide Sequence Number=SeqID_101973
atggtggttgttgttggtgttttcattggtgtcgatctcggttgggaagtcttagtgggggaaggggaggtgagtaccaaaaatagtactacaatttcgcaccacggaagacaaatatgccattgtcgggaagagaagagggtgaaagttaagaaggaatgtgaagaagctgatgattttttggccgagagtcatgagaaggaagtggttaaggcgaagaaagaagggaatggcaggaggaaaatgaaacggaagcgtgggaggcctcccaagatggatttgaaagaggaagatcaattagatgatcagtttccacgtaagcgtggaggagtcaacgaggctcatcgcgtgttccaaattggcgatgagaaacccccagaagagcctgtgttgggtagctatggcctgggaatttcacgtttgggtaatgcgctggttggcagagcaatccatgcccaaattgtgaagcatgatgttggagaagctgatcaagtggtgaacaacgtgtttttggggttgtatgtggaaattgggtgtttcgatgaggtcttaaaggtgttcgaggcaatgcctcaacgaaatgtttaa

SEQ ID NO: 10289 - DNA, 165 bp, Glycine max
  Peptide Sequence Number=SeqID_101974
atggcgactgtttcggatagggaaaatcagggccatgaaatatgcaagaatatatacaattatcttgatgtcactttcctacaaatggcgacgttgctagcagaaagcataacacttggaagaaaatggcatatatatgatattgaattacctattgcattttaa

SEQ ID NO: 10290 - DNA, 1836 bp, Glycine max
  Peptide Sequence Number=SeqID_101975
atggagtctagtgaagcatcaaacctactgtatgaaatagtgattgttatgtctggactgattgaaggacttcctgacgctgttgcaatcaggtgccttgcatgggttcccttctacctccacccaaagttagagcttgtctctcgtgcttggcgagcagttgttcgtggccctgaactatttaaagctcgacaggagcttggttcatcggaggatctgttgtgtgtctgtgcttttgagccagagaacttatggcagctgtatgaccctcagcgagacctctggataactcttcctgttctaccctcaagaatcaggcacctttcacattttggtgccgtctccactgctggaaagttgtttgtgattggtggtggaagtgatgctgttgatcctttgacgggtgaccaagatggttgttttgcaacaaatgaagtctggtcgtatgacccagtagtacggcagtggtccccccgtgcggcaatgctcgtcccccgttctatgtttgcatgctgtgttatgaatggaaaaatagttgtggctgggggcttcactagctgcagaaagtcaatatctcaagcagaaatatatgatcccgagaaagatgtttggattccaatgcctgatcttcatcgcacccataactcagcctgttcgggagtggtgattggaggaaaggtgcatgtcctgcacaaggatatgtcaacagtgcaagttttagacaatgcaggtcagtggacggtagaggaatatgggtggctccatggtcaaatggcagttatcagggatgccctttatgtgataagccatggattaatcatcaagcaagacaaaaaaatgaggaaggtagttggttcagcttctgaatttcgaaggagaattggatttgcaatgattggtttaggtgatgaattatatgtgattggaggtgtcattggccctgacaggtggaattgggacatcaagccactgtctgatgttgatgttcttacacttgcgagcgagagaccgacgtggcgccaggcagctccaatgacaagatcaagagctgtgacgaagccaagtttgatgggtgatcacagctcctcccagccatgtccaaatcagagttacaaaagaaccatcattccttctctattttcaccaaaattccgagacttcactgccaagtgtctctcagctggagctgaggctttgagaagtcccacatcgattcttgacaccagagccttatcatccccatttgggagtcctttgtcacatgaagcagcagcctcagaaaacacaacctcttgggactccaaatgcattggccttgctcttgttggtgcactcaaagatgaaacttttcctcagaattcaactaaaccaagtagtggaacggttctgtttggaactaagcatagagtaaaaatcccacctttgcctctgtcactgccaccaccttcatttgaatccaaaacatgtgcttctgctgctgctgctgattgtgctgccaaaaccaaggattctccattatctgttgcaactggtgttctgagtttgagtgagatggagctttctgaggagtacacgtgtgtgatagcacatggacctaatccaagaacaacacacatattcgacaattgtattgtggaaagctactgttccctgccaaatacacccaattctccttcactcaatttccttagcttctgtcacacttgcaagaagcatcttgagcagactaaggacatttttatttacagaggagagaaagctttctgcagcaaagaatgtcgccaccaagagatggtgctagatggagcaagaaattcagaatttgacagatactaa

SEQ ID NO: 10291 - DNA, 573 bp, Glycine max
  Peptide Sequence Number=SeqID_101976
atgggaggagcagccacggtggtgtgtctgcagcaactaaaatcgattcttggccttgtgcatttcacccatggagctgatatcatatcagtgatgcgctctgttttcacccaaactcatgagtggaggtgggaaagcgctgtgttaggatttgtcttcattttcttcctcctaagcacaagatacttcagcaaaaaacgaccaaggtttttttgggtgtcggcaatggcgccattgacatctgttatactgggaagtctcttggtttatttcactcacgccgagaagcacggtgttgaagtgataggagaattgaagaagggtttgaatccaccatcactgacaaatctggtatttgtgacgccttacatgaccacagctgtcaaaacaggcattgtcgttggcattatatcgcttgcggaaggaatagcagtgggaagaagctttgcaatgtataaaaattacaacattgatggcaacaaagagatgatagctattgggaccatgaacgtagttggttctttcacctcttgctacctcacaactggtaaaggttttacttggcttagttag

SEQ ID NO: 10292 - DNA, 654 bp, Glycine max
  Peptide Sequence Number=SeqID_101977
atggggaaaactaggatgtgtgtatgtaagctgcctaataatggacaagcagatcacgccaatgaaaattatggtcagatgttgaaagggatggatttaaaagagaaaaatcttgaagagaggaacacattgctagaattagaacctgctgcagcccaggtgcttcatgaacttgtgtctttggttcacaacagtgttagttccacccaggatgggcaatcactatcaacttctataaatgattatgagcttgctgggaatgataaacatgagaaaatagtgacttctgacttgaaagatgatccacttgctaaaattctctgggacgttgaaccacaaactctccaatgtgtttttcttgctatggcacataacttcccaagaactttagaggctcttgtactgcatgtgctttcaccagtgggggccgaagtcctcactcggaaattcgatgaaatggatcaacaaactcttgaggaagatcggaatagattctacgaggttttctacagtgcatttgatgaccaatctgcagcaatgaattcaattctaaaagggaaagaggtgttcacagaacagctactgttgcttgttgcgagtttcaacatttctaagatgatttttcattcattagaacttttgccagtaagctag

SEQ ID NO: 10293 - DNA, 1287 bp, Glycine max
  Peptide Sequence Number=SeqID_101978
atgaagtttcgcagaaatgaaaaccttccaaccaatggcaaacatttgccagagagccctcgagtaccaatggagtttctgtctagatcatggagtgcttcttctcttgaggtctctaaagcccttacacctccttcttcaatttcagacataccttccaagcctcctaatgcaccctcttctgtcagtgtcactaactccatttccgaacaagcttcagaggaattctcaaccatgtgtggcaaccagttctcttttgcttcctctgccacctcacagcttgtccttgaccgcattatgtcacagtccgctagagaggaagtgtctccattaacgtcaggtagactgtctcatagcagtgaacctttgaacggtggtgcttctttaaccggaacggatagtccaccaatctctccttctgccgagtttgacgatgttgtcaagttttttcgggcaaacaattccattcaccccttattcaatgttggacgagccatgagtggtgctactacaggcaatgccactccttcctccggacctaaaacagttggaagatggttgaaagacagaagagaaaagaagaaagaagaacacagagcccacaatgctcaactgcatgctgcaatttctgttgctgcggtggcagctgcagttgcagccgtcaccgcggcaacagcagcctcatctgcagctaacaaggatgagaagatggccatggctgtggcttctgcggccacgttagttgctgctcagtgtgttgaggctgctgaagcaatgggagctgagagagatcaccttgcttctgtggttagctctgctgtcaatgtccgttctcatgatgatatcacaacacttacagctgcagctgccacagctttacgaggggctgcaaccttgaaagcaagagcattgaaggaggtgtggaatattactgcagtgaccccaattgagagaggcatagggattggaatatgtggtaaaggcaataacagtaattctagcaccagtgatagtggagagattatcaatggtgaaaattttttgggtgcctgcagccaagagttcctagctaggggcactgcattactcaaacggacacgtaaagcgtggccaggaaggcatctgtttgatgacagtgaagaaagaaggtattttggattgaagacagaagcaagggggattgtggagttcgaatgtagaaatcaaagagaatatgatacttggactcacggggtttctagacttctttccattgttgcacgcagacaaaacataaatggggtttga

SEQ ID NO: 10294 - DNA, 891 bp, Glycine max
  Peptide Sequence Number=SeqID_101979
atgtggaaccaaccattgggaaaaaccgatttggaaagcggttctcgcccgctgtatccgatgatgcttgagagccccgaactgcgctggtctttcatcagaaaagtatactccataatcgccatacagttgctcgtaaccatcgtcgtcggcgccgtcgtcgtcaccgtccgcccaatcagcgtcttcttcgccaccaccggcgccggattggctctctacatcgtcctcatctttgtccccttcatcacattgtgtccactttactactactcccagaagcatcccgtcaattacttgctcctagcagttttcaccgtgtctcttggttttgtcgttggattgagttgcgcctttactagcggtaagattcatcgtctgtgtcctctttttttctttgtgggttctaagtttagatctactgattccttccttccattgagagtgcaatggagggaggagattggattattcccttacatggcagcttctgatgtaactaccgtttctgcaatgggaaataaaaagaaagttattctggaagctgtcatattgactgctgtggtggtgattgctctaacactctacacattttgggctgcaaggagaggccatgatttcaacttccttggacccttcttgtttggtgcagtgctagttcttatggtctttgctctgattcaggttctgtttccactgggtaaattgtccgtgatgatctatggttgcttggcagccattatattttgcggctacatcatctatgacacagacaacctgatcaagagatactcgtacgatgaatacatttgggcttcgatctccttgtatctggacatcattaacctcttcctgtctctgctcactattttcagagccgctgatagttag

SEQ ID NO: 10295 - DNA, 297 bp, Glycine max
  Peptide Sequence Number=SeqID_101980
atgacatggtggtgtaagggagtcgcatgtggagcctcaaaggttgaggttgtgatgaatcttgactggggaaagtgcttggaggagggtgacattgcttggctcgtggggttaggagagttgaaagtcataggggaaggggagaggtcagggggctcctcctttgttgttatggttgatttgctcgaggtgcattgtcacagtggttggttcgcaattcgtggttgtcatcgtggtgggcgttctggtgcaacggtggaggaggtgtttgctacccgtgatgacattttgcattga

SEQ ID NO: 10296 - DNA, 1705 bp, Glycine max
  Peptide Sequence Number=SeqID_101981
agtaaattactccttccccgaggaggtgctggagcacgtgttctccttcatcgagtgcgacaaggaccgaggctcgatctccctcgtctgcaagtcctggtacgagatcgagcgctggtgtcgccggagagtcttcgtcggaaactgctacgccgtctctccggccaccgtcgtcaaccgcttccccaaggttagatccatcgccatcaaggggaagccgcacttcgccgacttcaatttggtccccgagggttggggcgcttatgtgggcccttggatcaaggccatggccgctgcctacccctggcttcaggagatcaggctcaagaggatggttatctccgacgaatgcttggaactcatcgccaaatcgtttaagaacttccaagtcttggttctcacctcttgcgagggtttcaccactgacggacttgctgccattgccgccaattgcaggaatttgagggagttggagttgcgggagagtgaggtggacgacatttgtgggcattggctgagccattttcctgattcatacacatcgttggtttcccttaacatttcttgcttaggcaatgagactctccgcctcaaccgtgctgtgccgctagacaggcttgccaaccttcttcgcggagctcctcaattggttgagttaggcacgggaacctacacgactgagatgcgaccggaggtcttcacaaacctggcggaggcattttctgggtgcaagcaattgaagggcttgtctggattttgggacgttctcccatcctaccttccagctgtctatcccatctgctccaacctgacatcactgaacttgagttatgcaactattcaaagccccgatcttatcaagcttgttggtcaatgtgagagtttgcagcgtttatgggtgctggattacatagaagatgctggtcttgaagtgattgctgcatcgtgtaaggatctgagggagttgagggtgtttccctctgacccgtttgggttagaaccaaatgtagcattgacagaacagggccttgtatccgtgtctgaaggctgcaccaagctccagtcagttctatatttttgtcgtcaaatgactaattctgccttggatacaattgccaggaacaggcctaatatgacacgttttagactatgtattatcgagcctcaagctcctgaccatcttacccatcaacctctggatgctggttttggagctattgtagagcattgcaaggatcttcagcgcctttccctttccgggcttcttactgaccgtgtttttgaatatattgggacttatggcaagaagcttgagatgctttctgtggctttcgcgggagatagcgatctgggactccatcatgtgctgtctgggtgtgacaaccttaggaagctggagatcagggactgcccctttggtgacaaagccctcttggccaatgctgcaaagctggagacaatgcgatccctttggatgtcctcttgcttggtgagttatggagcatgtaaactgctgggtcagaaactgccaagacttaatgtcgaagtcattgatgaaagaggacctccagattcaaggccggagagtagtcctgttgagaagttatacatgcttgagctcgattgccattcattttacactttggctgagctacttgacaccaattctgataaagagatcggaaccttgttgtatgttgcatag

SEQ ID NO: 10297 - DNA, 333 bp, Glycine max
  Peptide Sequence Number=SeqID_101982
atggttaagcaaaccgtcggtgggactggcgggtttgctgctggtgactggactcgccactgtcagtggcgatatgcacatgcctcagggctaggcgtcagtggcacaggccatgcagcaagccatgcagggttgcagctgcagcagggtggattcgccaatgagtatggcgggatgcgcttcaccggaatcgtcaagttggctggcgatttgctttatttcaaacgtgtccattataaaagcaggaactcagctacacctgctacgctttcttcttcttcatattactgcactacattgctgttctttttgttttgtttctggtttagatag

SEQ ID NO: 10298 - DNA, 1110 bp, Glycine max
  Peptide Sequence Number=SeqID_101983
atgggaatgggggctagtttattacagtctacaaaactgggctccaaccaatgggccgaaacccaaccgttctgtccgaaaccgattacaaattttccagttcccttatctatccgcgctgtggaaagaacgaagacacgggaaagaaaaatggtgctagaacaagcagtatcatcatcaagcaccttgaggaacgttttcaccaatcccaaaaccctaatttcaaaaccccaattccaagtcgccgcttccccttcatggaaaccacagcagccgcgctgggaagggtggctggggataaacttgaagtgctccatgacaacaacaacaacgccatcatcataccctaagccctcggagattccgtggcagaaggaactctgcaactccgtcaacctcatcggcaacgtcgccgcccccgtcgaaatcaaatacctcccctccggcaaggtcgtcgcctggacccgcctctacgtcaagaaaagcgccacacaatcatcgcccataaacctcactttctgggacgacctcgcgcatgtcgcttcccagcatctccagaaaggtcaccagattcatgtctctggtcgcctcattaccgacactgttgaaacggaggaaggaaaaagccaaacttactacaaggttgttgttcaacagctgaatttcattgagaggaatttctcttcggtgtcatcatcgcagggtcaagagtttgattttgcgatggctggtagtggtaggaaagtgagcaatgctgcaaacagtactggttctgtggtggaaacatggaatgcgttctttgctaacccaggggagtggtgggacaataggaacaacaagaggaatccaaaagctcctgatttcaaacacaaagatacaggggaagctctgtggatcgaaggcagatacaatccgccatgggtcaagtctcaactggaaatactagactcaagaatggggtcgtttgctagtcaaaatgctaggatgcctgtagtactgataatggttaagtttgcccttgagctatatttagttagtgatcaagtgattgtgttgcattcagcattctctattcctgttgtgcatttactggaatcgataaagcactaa

SEQ ID NO: 10299 - DNA, 1386 bp, Glycine max
  Peptide Sequence Number=SeqID_101984
atggaggatgtggagcttgatcaattatatgtcaagagaagggagcaattgaaagagcttgttgctagcataatcactccaaagattgtacagggaaagactctaaacgggaaggagtttgtctcctttctggagcagatacttgaagccttgaacaaaggagagattccatcaacaggctctcttgtggaggttttcaacaagaatattcttgagaaatgtctgaagttatacagtgaaaagatggcaaaattagttctacctcttcctgaggaatctctgcaaggggcccatgataggtctagagatgaagtcacaaaagtctttgatcagcagcattttggtcgtcaccatgctaagaaatcatttatgcagctggatgaagaaatacaacaggtgtataagaatgttgttttgcaaaacgagtatcaatcttcaaggctctgtgaggcgctgtacaccagatgtgaggacaaaatggatcagcttcaagttctcaaacttccttccttggcaaaatttaatgcagatgatggggaagtctcggtctctgtttataaaggagtacaatcacaggctcttcaattggttggtggccttctccctggttatgagtcactttactataacccagtttggcattttatagttgcaacttgggaaactgttgtttacagcccaatcctggatcttgacaggacttcaagaagacagtgggcaatgctgggcttttcatatggagaaatatttctgttgcttggagctactgctgctctgatagggccaaaggatttaccaatcatatgcagaacagcaggaaggctagctggtcgagctattggatatgtacaattggctcgtggtcagtttgacactgttatgcagcaatctcaagctcgccaggaactgcaagacacaatggctcagctagatgccattcgccatgaaattcgaagtatatcaatcataaatcctggccctttgacgcggaggcttgtggatgatcctgaccagacatctatctcaaatgaaagtaggaaaccagaagaatctggacaagagaatagctcgatacccactgttatgaaggattcaacttcaatgtcatccaattcatgccatatgcaaaatcaagcaaccatttattccagattggtaaactcccctgccataaaaaatgagttgtcagcaagtagtaccgaagttgagaagatagaagataaactacagcttactgtcttaccaatttctgctgaaaatgctggactattaccaattcgtggggctgatgtgaaaggatctgacatagttcttgaagcaattgtggaggcagaggtcgctcataatgcaaaggaattcttttcacagccccaaaatcaaatatga

SEQ ID NO: 10300 - DNA, 1272 bp, Glycine max
  Peptide Sequence Number=SeqID_101985
atggaggaaagtggtaaaggaacatggaagcacgctgctttccatgttgccaccactattgccacccctgctgcttatgcccctttgcccttcgctcttgcttctctcggttggcctcttggtgtgactagtctggtgagtgcaacactagtcacctggtactctagctttttgatcgcttcgctgtggaaatggaacggggagaagcaccttacctatagacatcttgcacatagtattttcggattctgggggtactggtctattgccttttttcagcaggtagcttctttgggaaataacattgccatccaaattgcagctggcagcagccttaaggcagtttacaagcactatcatgagaatggaacattgaccctgcaacactttattattttctttggaatctttgaactacttctctctcagcttccggatattcactcactgagatgggtaaatgccttgtgtactttcagcacaattggttttgctggtacaaccattggtgttaccatttacaatgggaagaagattgataggtcatcagtaacttatagcttgcagggtagttctgcttctaagtccttcaaagcatttaatgcccttgggaccattgccttttcatttggtgatgcaatgcttccagaaatacagaatacgttgagagaacctgcaaagaggaatatgtacaaaagcatatcagcagcatatactgtcattgttttgacctactggcaattggccttctctggatactgggctttcggatcagaagtccaaccttatattttagcttcattgtctatcccagaatggactgttgttatggctaatttatttgcagcgattcaaatatcaggatgctttcagatatactgcaggccaacatatgcctattttcaggaaactgggtcccagtccaacaaatctagtagccaattttcccttagaaatcgcctggcacgacttatttttacttccatatacatggttcttgttactcttattgctgcagctatgcccttttttggagattttgtgtccatctgtggggcaatcgggttcactcctttggactttgtgttccccgctttagcataccttaaggctggaagaacgaccaataactccaaacatagccttttgatgcgaccattaaatattttaatagctacctggttttcaattgttgctgtcttgggttgcattggtgcagtcagattcatagtggtagatatcaagaactacaagttcttccatgatatgtga

SEQ ID NO: 10301 - DNA, 864 bp, Glycine max
  Peptide Sequence Number=SeqID_101986
atgaagcatgctacaaaaattgaagtgacacaatttgaagtaacggccatcgcagctgcaatagccgacaaaatcacagctggcacggttattactaaagtggctcacataaatcccattttaaccgagaagcggcctaaagcagcatcgcctaggaatgttttagaggatcgatttgggattctgacacctttgaatcagaaccgaaccctaatttcccattcactcatccttccctgcaaaattttcttgccagctgtgacagtcaatcttcggaggcatttcctggccaaccgtgacacgattgctgctttgctttgttctgtccctgcgttgttctgttttgtgatctcttcaacacagaacagcaaccatcctccaaccttcgataacattttcaaggttggtcgctccatgccactgtttgggattgacaactatgacacagaaattaaagctaaagaacaggctcttaaacagaatattgagctccatgtgcaaaaagctagcaatctatcagataaccatcatgcttctgctgtcaccaaggggcagcctctacgggatgaccatccacaagtacttgcacctcttggcaccctacgtcacattctggctttcatcactcgttcggcctgtgctgaccgactagtgtcacaagccctcgtccacatggttgccttctatgcaactgttgatcaaatggatcgaacattacccctacatctgggccaacaaaccgagtgtaacattggacagcaagaaatgtgccccctaacaatagaaaccttaaagctcttcgagacccatcaacatacgaatgcatggccaccacaagagacgcaccaccttctgacatgttag

SEQ ID NO: 10302 - DNA, 1146 bp, Glycine max
  Peptide Sequence Number=SeqID_101987
atggaggaggttgagcaagctaatagagtagctgttgaaagctgccatagggttctgagtttgttgtctcaaccaagggatcaggttcagcataggaatttaatggtggaaaccggtgaaactgtggtgaggttcaagaaggttgtttccatgcttcacaatggtttgggtcatgcaagagtgaggaaacttaaaaaccctcaaatcccctcttcccaccaaagcatcttcttagacaaccccaattgcaaaaccttaaccaacaacagcaacaacaaccatcactccaaaaaaaatctatactttccccaaaccagctaccctgacaattcagttcaggaacatggttcaaccattaagaattctctctctcttggacaaccctctttggaattgagctccaatgggaaaagtcctcttcacctcacacagcagggttcatcaaatcactatcacttctttcagcagcagcaacagcaaaggttgttgcagcagcagcagcaacaacaacaaatgaagcatcaagctgaaatgttgttccgaaggaacaatagtggcataaacctgaattttgacagcactagctgcacaccaacaatgtcatccactaagtcttttatttcttccttgagcatagatggaagtgtggctaacttggatggaagtgccttccatttaataggagctccacactcttctgatcagaattcgcaacagcctaagagaaaatgttctgccagaggcgatgagggaagcttgaaatgtgggagcagtgctagatgtcattgctctaagaagaggaaacatagagtgaagagggcaattaaggtgcctgctatcagcaacaaacttgcagatatccctcctgatgattattcgtggaggaagtatggacagaagccaatcaagggctctcctcaccctaggggatattacaagtgcagcagcatgagagggtgtcctgcaaggaagcatgttgagaggtgcttggaagagcctaccatgctaattgtcacctatgaagcctgggccaattcaaggaaaaaacatggtatggcacctgctagtgataatggatggcaacaaagtttggtaactaccgatattccttttcatctactacttcgtaggttgaagctgttttag

SEQ ID NO: 10303 - DNA, 636 bp, Glycine max
  Peptide Sequence Number=SeqID_101988
ctctctcctggtgcaatactctcagccatggaatatgctgttgaagttggcacctcaatcttctttgatcctggaccacgtggaaagagtctctccactgggaccccagatgaacaaagagctcttaatcagttactgagaatgagtgatgttcttcttctaacttctgacgaggctgaggaattaactggcatagaagatccaatattagcagggcaggagtttctcaaaagagggatccgcacaaaatgggtgaatgttattgactctgtcggatgtggagacagttttgtagctgctattgtctatggttttatacataatatgccactggttaatacattggcaattgcaaatgcagtgggtgctgcaacagccatgggctgtggtgctggtaggaatgtagcaacactggagaatgtagtaaatatattaagatcatcaaacctcaacgaagatgatgaattttggattgaaatatttgaaaagaatgtggttgctcaggaaataacatatctgtcaaatgttatgaatggaaacaaaaatcgtctcaaccttgtctcatttgacaaggttgcctctgagctcttgcccaagcttgaacttccacaaacagtggggaatgtgccaacttga

SEQ ID NO: 10304 - DNA, 615 bp, Glycine max
  Peptide Sequence Number=SeqID_101989
agaattacaggaatattcagattattatctttcaagttggtatcagagctcccgatccagggggctttgcttctgcattcttctaggcagccttcattgctgcagttgatactgtttcagtgcccagttactgcatataccactggttgccgtccgtcgctgtcctccgccgtcagcttccttccgccgtcgtcagccaccgtctgccaccgcgaaactgatccgagaacccaccaggagaagcgccttctccagattggcctatccctgaagtttcactgccaaccgctgccggacgtgccgccactcgccgttttgtctccggcgtgtgtaagccacgcgccaccgtacaggccgtctttttcgacggtgcctccacagaacaggtcgccggcccaccccggttctgttccaggagttattttgccccaaaacagcctcagaaaccctaactcgagaaggttacggttaccgttctacgttttttctctatcttgtttctgcgattttcctcttcccattatgtctacagacaaggcagtccctcttctcagtcccaatgaccttcaggcattgcaaggctcatatcgagttgatgggcacaactacctctag

SEQ ID NO: 10305 - DNA, 231 bp, Glycine max
  Peptide Sequence Number=SeqID_101990
atggaggaactgtgtgaaagtggtatttcccttttgcctgatcctggaaagctctggcatatggcagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10306 - DNA, 630 bp, Glycine max
  Peptide Sequence Number=SeqID_101991
atggcagtagcaggcggttgggtgggagcatggtggtgggtttggtgtggtgtggaggtggcgttgggtggaggtagggtgtggtggttatggaggtttggaagagagagagaactagtgtttactcggaagaagaaggccaaaaccctaaatacaagcatctacggtggaaggtttattagctccacattacattttcgatatctctccaacgggagggaaaagaagcatgacgaagttgcacgaatagcaaaaatattgtcatacaccactcctgtggatgcatgcagactctctcgtttccaaggcctttgttctgccgctgaattcgacattatggacagcaaagctgttactctattagaagataagcttagccatataaggccagatgcaaaaggaaacagaacgcaggggaaaaccaagcatgataaaattaggagccataaccaagtaagtgggcttcttcctgatcctcttgggcctactattggcttgctccacattgttgctgttgtcctgcactgtattgctatcaacaccctccctggaaaaacaaccttgtccgcaaggttgtgtagggtggtcaaggtgtcccaacgttcacagattgtctcctcgggtgcctag

SEQ ID NO: 10307 - DNA, 225 bp, Glycine max
  Peptide Sequence Number=SeqID_101992
atgtcagatatggaaaattcttataggtcatgcttttttagtcagattatgaaaattgctgtctggtctgatttgcactctgcaggaagaaagggagatggagatggacatgattgttgtttgggaaaagagttgctggaaatgattctaacaagtgtcttagtaagaccggtcatgccaacactgagggttcaatatggggccactgcacgtgcacgtttatga

SEQ ID NO: 10308 - DNA, 482 bp, Glycine max
  Peptide Sequence Number=SeqID_101993
atgtggattctggtggcaattgggcctcttgttgggccgtttaagttatggaaagtggatcactgggatatgctaggtgcacccagcaatattgctggtgcacccagcaattcaatgaaagcattctctctttttctcactgtggctcttccgcaaaaagcttcttctcttctctcttccccgacaagcttcttctccgcgagcttctccgacagcccttggacccatttgcttcgagaccccttaggggttcttccggaagttccggaagaacgttttccggaaagtttccggaagaagtgttcttccggaagtaaccaaacgtcttccggaagaacacttcttccgcaagacttccggaaaacgtcttccgtgaactttccggaagaagtggttcatccggaagaattccggaagactcgcacttccggaagaagtttcaaacttccggaagaactttacggaagaacccttcttccgga

SEQ ID NO: 10309 - DNA, 381 bp, Glycine max
  Peptide Sequence Number=SeqID_101994
atggaaggatgggaagttgaggatgcagagaaacagagtttgggggaaaaggcagcgaaagctgaagaatttgaaaggacgaggcaagttgtgcaacgaggaaacgaaataaaagagactagactgatcaaacacagtaatgaaacacccctagcatcctcaacaacaagagcttggatcaaggaagtgaatctccattgcaaggttgaggagcgtcccgccggtgaagctagcgatttcgagcctgctacgaacgtagggtgcagaggcacagaagccacagaagccatttccgaggctctgaacgaagctacaggtgcagggagtcgccaacaggaccggcgacttggtgagttcccgaaaccgccaataggaactgcg

SEQ ID NO: 10310 - DNA, 1848 bp, Glycine max
  Peptide Sequence Number=SeqID_101995
atgagaaaactctggaattcgctgtctctcgtcggtcgtcggagatcaatctcttacttctccaaatcgtacacttccgatgcacctttcaactgctgcaccaaaacccacggtttacttatcagacccaacaacaaatttgcgaccaccccatttcgaaacatggacaccctcgttcagaaaccctctccaatcccctcgaggcagcgaaaaatcatgggaaaatcgcagcttgaagaagctttcgagtccgcagaaaccaccgaggaaatgctcaaagccttcagcaacatggaaggggtttttgaggagagagagcttggattagcttctttgaaaattggccttaaacttgaccatgaaggtgaggaccctgagaaagctctttcctttgccaagagagctttgaaagccttggaaaaagataacaacaacaacaccccttcttctttgcctgttgccatgtgtttgcagctgttggggtctgttagttttagcttgaaaaggtttagtgatagtttagggtaccttaatagggctaacagggtgttggctaggttgcaggatgtgggtgttgttagtgtttatgatgttaggcctgtgttgcatgctgtgcagcttgagttggccaatgttaagaatgccatgggaaggagggaggaggctcttgagaatcttaggaagtgtttggagattaaggaggtgacttttgaggaggatagtggggagttgggcaaggggaaccgtgacttggccgaggcttatgtcgcagttttgaacttcaaggaggcgctgccatattgcttgaaggcgctggagattcatataaaggggttggggatgaattcggtggaggttgcgcacgacaggaagcttctcgggattgtgtatagcgggttggaggagcacgagaaggcgctggagcagaatgttttggcgcagaggattttgaagaactggaatctgaacgcggatttgttgcgtgctgagattgacgctgcgaatatgatgattgctctggggaggtatgatgaggctgtttgtactttgaagggtgttgtgcagcagacagagaaggatagcgagactcgggcacttgtgcttgtgtcgatggcgaaagcattgtgtaatcaggagaagtttgtggactgcaaaagctgcttggaggtttctcttgggattcttgacaaaagggaacgaatttccccggtggaagttgctgaggcgtactcggagatatcgatgcagtatgaaaccatgaatgagtttgaaactgcgatttcgttgctgaagaggacactagctttgcttgagatgcagccacaagagcagcactcggagggaagtatttctgcgagaataggttggttactgttgttgactggtaaggtgcagcaggctattccttatttggaaagtgctgctgaaagattgaaagatagctttggtcccaagcatttcggagtgggttatatctacaacaatttgggggctgcgtatttggagttggatagaccccagtcagcagcgcaaatgtttgcagtagcaaaggatatcatggatacatctcttggtccacatcatgcagatacaattgaatcatgtcaaaacctttcaaaggcttatggcgagatgggaagctatgtccttgcaattgaatttcaacagcaagttgttgatgcttgggaaagccatggagcaagtgcagaagatgagtttagagaagctcaacgacttctagaacaattaaagaaaaaagcccgtgacgcctctgcaaacgagcttcatatgaaggctttgccaaatgagcttcctatcaaggctttgcccttaccacataaatcctga

SEQ ID NO: 10311 - DNA, 1149 bp, Glycine max
  Peptide Sequence Number=SeqID_101996
atggtggagaacagctcattagctcaatctaatgtgtttattttaatgaaacaagttatgccctatacatgcattttgcatccaatgattgaagagatggatgaaattatagttgcgcaagccagggcacatgccgggaattcaagtgagagtgaagtaaaagggttgaaaattttgaatatgaagatcagtattttgctatgtgtggtgcttttgggtttccttggggtttgtcaaggaggcagcctaaggaaaaagttctaccgggattcctgccctcaagccgaggacattattaagaccaaaacccagcagcatgtgtctgctaatcccgatttgccagccaagttgcttagaatgcattttcatgattgttttgtcaggggttgtgatgcctcagttttgttgaactctactgccagtaacactgctgagagggatgcaattccaaatttatccttggctggctttgatgtcatagatgacataaaaagtgcggttgaggcaaaatgttccaaaactgtatcttgtgctgacatactggcattggcagctagggacgctgtttcagtccaatttaataaaccaatgtgggaagtgctgacgggtagaagagatggcacagtatcgaacagtaacgaagccttggccaatatcccagcacctttcttcaacttcacccaactcaaagaaagctttgctggcaaaggtctcactttgcacgatctggttgtattatcaggggcacacacaattggaatagggcattgcaacttgttcagtaacaggctttacaatttcaccgggaaaggtgatcaagacccttctttgaacaccacttatgctgaattcttgaagacaaagtgccagagcctgagtgacacaaccacaacggtagaaatggatcctggaagctctaccaagttcgatagtgactattatccaaaccttctccagaataagggcctattccaatcagacgcagcccttctaacacaagagcaatcagaagatatagctaaagaattggttgatcaaaacaagttcttcacagaatttgcacagtcaatgaagagaatgggagccattgaggtcctcactggttctgctggagaaatacggaacaagtgttcagttgtcaactcataa

SEQ ID NO: 10312 - DNA, 1593 bp, Glycine max
  Peptide Sequence Number=SeqID_101997
atggaggaagcaagagttctgaagaatttcccggtgaagccaaagctgaaatcgaaagccagaacccctaagcaaacccctgaatccaagtactggtcctccttcaagacccaacaaattcccaatctcatctccgttccttccatcacgttctctccgacaccccctcactctttcgccgccgcacattccgcctccctcactctcttcagctcccaaacgctctcccccgccgccaccatctcctccttctccgacgccgtcacctgcgcctccttccgctccgacgcccgcctcctcgccgcctccgacctctccggcctcgtccaggtcttcgacgtcaagtcccgcaccgccctccgccgcctcaagtcccactcccgccccgtccgcttcgtccacttcccccgcctcgacaagctccacctcatctccgccggcgacgacgccctcatcaagctatgggacgtcgccgaggcgaccccggtcgccgagttcctcggccacaaggactacgtcaggtgcggagactcctcccctgtgaattctgaaatcttcgttacaggctcctatgaccatgtcgtcaagctctgggattctagggttagggattcgaaatggtcggtgcaggtgaaccatggcgcgcccgtggaggatgttgtgttcttgccgtccggagggatggttgcgacggctggtgggaattcggttaagctgtgggacttgattggtggagggaagcttgtgtattccatggagagtcacaacaagacggttacatcgatttgtgtcgggaaaattgggaaggatgatggagaagaatcatcgaatcagtttaggatcatgagtgttgggttggatgggtacttgaaggtgtttgattatggatcattgaaggttacacattccatgaggttccccgcgcctcttttgtcagtcgcttactcgccggattgttccaccagggcaattgggacttccaatggagtgatctatgctagcaagaagaagataagggaaaaggaaaaggagagggagagtgaggctagcttgttttggaaaatagcacctgtggagaacactgagaagaaagcgatgaggccttcgcatttcaggtatttccatagagggcagggaacgaagccgtccgagggggatttcttggttatgaagcccaagaagaagaagtgggctgagcacgacatgctgttgaacaagtttgagcatggggaggctctggtatctgtgttgcaaactatgaaccccgggcatgtggtggctgtgctggaggaattggtggctaggaagaaattgcttaagtgtgtctccaacttggatgtgaagaatttggaactcctcttggaattcttgcataagtattgtaccttgcctagatattctagtttgttgatgggatttgccaagaaggttcttgaaatgagggtggatgatattagagcttctgattctgaagccatcaagagtcatatcataaatctcaagcgggctgttgtgcaggagattcggattcaacagtcattgcaagagatacagggtataatctctcctttgttgaggattgctggaagatga

SEQ ID NO: 10313 - DNA, 1176 bp, Glycine max
  Peptide Sequence Number=SeqID_101998
atggcggttgcactaacgagttgcatttcctcatcctctgttctattctccacagttaaattccgctactcactcagacacagacccatcgtcgcctctttctataacaataataattacccactccgactttcctcttcttcttcttcttcttccaaatccaatcgacaaaaggaaggtgttgggcagaagaagcagtcaaaagatgaaagacctgcaagagggaatgtgctcgaaccccaacaaacttcttcttctaaaccttttggcattcaaaggaaaaataaggaccttatcttcgactccaaggaccagcaggttgaaccgagtgctttacaagattcggctttccttaatgctgttgtgaaggtcaaagtcaagaaaagaggggatgactcaaaatatgtggctaaggttttggccagaggtgttgactgcgatatagccttgctttcagtagaaagtgaggagttttggagagatgtggaacccctcagattaggacgtttgccacatcttcaggattctgtaactgttgtgggatatcctcttggaggagacacaatttcagtgacaaagggagttgtatctcgtatagaggtcacatcatatgctcatggatcatctgatttgttgggcattcaaattgatgcagcaataaatcctggtaatagcggaggcccggcattcaatgaccaaggggagtgcattggagtagcatttcagaagctagagaatcctgcactacgtgcatggttgaaagtacagtctaatgagggtgtattggtacgtagagttgaaccaacttctgatgcaaataatgtattaaaggagggtgatgtgattgtcagctttgatgatgttcgtgttggtagtgaaggaacagtcccattcagatcaaatgagcgaattgccttccacttcctcattagtcaaaagtatctgcgtttcgaatttgaagatagctatgtagctgttttagagaaagaatctgttaccgctgcttcaccctccgtactgagtgattatggaatcccatctgaaagatcgtctgatcttttgaaaccatatgtggatgcactagaagtagaaggtgaccaaccagcagacgaggaatttggtgatagcccggtttcaaattatgaatttggccctgatggactactctgggcataa

SEQ ID NO: 10314 - DNA, 336 bp, Glycine max
  Peptide Sequence Number=SeqID_101999
atgaaaaagtcattacatgaagcaaatgtggctcaagcctcaatgttaataaatgtcccccctccatatcttttatgcgtttgttgcacaatgcccttagtctcgggagttgctacgtgcacccagcattattgctggggcacccagcaaacagtgaagtggcgaaactgcccttcagcaattattcttccggaagaaagttcttccggaaaacaacttccggaagaacgtcatccggaatgtttccggaagaagcttcttccggaagaattccagtgtcttccggaagaagcttcttccggaagacttccggaagaagcttcttccggaagttag

SEQ ID NO: 10315 - DNA, 4830 bp, Glycine max
  Peptide Sequence Number=SeqID_102000
atgagacaggctttgattctcctatgcgagattcatttttcactattgtatgttcttcaaattaatttgatctcaactgcactggagaaaaaaggctctttaagcatggaaattgtaatgcaattaggtctccgtaacgaagatagtgcctgggatttcttggaagtagctttacttgcttgcttctgtgcaattcataaccatggttttgagatgttattttcattttcagcgatcatacagcatgcccctagccctcctattggatttggcatcttgaaagctggtcttaacaaatctgttctattgtctgtatattcttcctcctctgtgagaaacagtgatgaaagtttgtcttatgaaagaagaatagcatcatacctgagtgccattgggcagaaattcctatctatataccgatcatgtggctcccacgttgcttttgtgactattcttctcactgtatacatggtgagacctaattacatatcatttggttacatattccttctccttctttggattattggaagacaacttgttgagagaacaaaaagacagctttggcttccattgaaagtgtatgcaattttggtgtttatcttcatatatagcttgagcagcttctcaagcctagagatgtggttgtccaaattaatagatctctacctttatctggggtatgactcaaaagcatcttcttttgacaatgtttgggaatctctggcagtcttaattgttatgcaactttatagctatgagaggaggaagaacaagcagaacaggcaggatcacttggatcagttagaaccaggggctcttgggtttatcaggcgatttattatctggcacagccagaagatcttgttcattgctctgttttatgcatctttaaactcaattagtgcatttggtttcttgtatcttataggcctcatcttctgctccattttaccaaaaacttctagtatcccatccaaatcattcttagcatacacaggttttttggtgacagccgagtatctttttcagatgtggggtaagcaggctaaaatgtttcccgggcaaaagtattctgatatctctctctttttgggtttccacgtattccagcctggcttttggggtctagaatctgggttgaggggaaaagtgctagtgattgtagcttgtactcttcaatacaatgtcttccattggctggagaggatgccaaatacggttctaagcaaaggacagtgggaagaaccttgtcctttgtttgttcccacagaagatgcattcattgatgatgctaagtgtaatgaggaaagtaaatcatcatataattcacagctgccgtctgcaataaaagaaggggtgtcaggcaattcactgcaaattattacctctggtctttcccaagcacctgatactccatcctctaaaacagaaggttcttctgacagtagcagtaaaaagtactcattcgggtttatttggggaagttccaaggagagtcacaagtggaacaaaaagcggattgttgctttgagaaaggagcgatttgaaacgcagaaaactgtcttaaaagtatatttgaaattttggatggagaatacatttaatttatttggacttgagataaacatgatatcattactactggtaagctttgccttgttgaatgcattatccatgctgtatattgcactgcttgctgcttgtgttcttctgaatcggcatattatacgcaaagtctggcctatatttgtctttttgtttgcttccattctcatcctggaatacttagccatctggaaggatatgttacctttgaattctcatgcttcaagtgagattcgttgccgtgactgctggaaaacttcaactctgcatttcagttattgcaaaaagtgttggctcggacttattgttgatgatcccaggatgttgattagctactttgtggtatttatgctggcttgcttcaaacttcgtgcagatcgcctgcctagcttttcaggatcatcgacatatcgtcagattatgtctcaacgtaggaacacatttgtttggcgagatctatcttttgaaactaaaagcatgtggacctttgttgactatttgaggctttactgttattgccatctgctagatcttgtgctgatattaatattgattactggaacacttgagtatgatattttgcatcttggttatctagcctttgctctgatattctttcgcatgagacttgaaatactgaagaagaagaacaaaatattcaagttcttgcgcatatacaactttgctgttattattacttctcttgcttatcagtctccttttattgggggacttagtgctgggaagtgtgagacagtaaatgacatttatgaaatgattggtttttataaatatgattatggttttcggattacagcaagatctgcaattgtagagatcatcatttttgtgctcgtatcacttcagtcatatatgttttcctcgcaagagtttgattatgtatgtcgctacctggaagccgagcaaattggtgctattgtgcgtgagcaagagaaaaaggctgcatggaaaactgcacaattgcaacaaattcgtgaaagtgaggagaaaaaacaacagcgtaatatgcaggtggagaagatgaaatctgaaatgcttaacctgcaaatacaactccttggcatgaacacatccactaattgtattgatggattttcccacagcaatgagggtctgagaaggagaaggagtgtttctctcgcatcaaataatgacattggaatccctgataaagaagatcaggttctggggagactagatcatacaataagagaggattctgtttatcctattaatcttcatgaaccatctgcttgtacaaatgtggaaagtccactaacagaggattatatgaagcattcagtggattctcctttttgtgaaattactgaaatagatattgatacttcttctagtgattcaggaaaaaaggaaaaatttaaagggcaagcaaaagaaaaccctctcaagtctgctgtacaattaatcggcgatggtgtttcccaggtacagttcattggaaatcaggcagtcaataacctagtgagcttcctgaatatttcacaagaagattctgattcaaatgaacacacaaacattgaggataggatatatgacgagatggagagtcagaaaactcggcatatatatatggatcgttcttcatctgtgcagtcagataagagttctgatgctgcaagtctgcagttgggaaggatctttcgttatatatggcaccagatgcgttccaataatgatgttgtatgttacttttgctttgttcttgtgttcttatggaatttcagtttgctatcaatggtgtatcttggggctctcttcttgtatgctttatgtgtaaatactggtccaagttacatcttctggattatcatgctgatctatacagaactttatattttacttcagtacctgtaccaaattgtcatccagcactgtgggttgagtatcaatcctcacctattacgagaattaggttttccaacacacaaaatcacatcttcatttgttgtcagttcattacctctctttcttgtctatttatttaccctcattcaaagctccataacacccaaagatggtgaatggatgtcttctactgacttcaagtttaagaggaatgatctccatgcaaaagatgatcacactagttataactggcaaggtagagcacgggatctgctaaatcagatgattatcatggtaaaactgataatcataagcttttttaggtattggaaatcactcacacaaggagcagaatctcctccttattttgttcaggtgtctatggatgtcaacttctggccagaggatgggattcaacctgagagaattgaatctggaattaatcaggtgctcagaattgttcataatgataagtgcaaggcaaagaacccaaatctttgctcttttgctagcagggttaatgttcaaagcattgaaagaagtcaagagaaacccaatgttgccttggttgttttcgaggttgtgtatgcttcacctgtaattgactgctcttccacagaatggaataagtctttaactccagcatctgatgtggccaaggaaatcctcaaagctcagcgtgctggatttgtggaagaaatgggattcccttatcgtattctttctgtaattggtggaggcaagagagaaatcgatctgtatgcctacatattttgtgcagatctgattgtattctttcttgttgccatcttctaccagtctgtcataaaaaataaaagtgagtttcttgaagtgtatcagcttgaagaccagtttccaaaagaatatgtctttatgttgatggctatcttcttcttgattgtgcttgatcgaatactatacctctgctcatttgccacgtggaaagtggttttctatattttcaacctcgttctcttcacatattcagttacagagtatgattggcaattggagccatcccaacaacatacagctcagtttgctctccgtgccatatttcttgctaaggcagtttctctaggactgcaggctatacaaatccaatatggcattcctcacaagagcacattgtatcggcaatttttgacaagtgaagtttcaagaatcaattatttaggatatagactttatcgtgctctgccattcctttatgaattaagatgtgttcttgactggtcatgtacaactacatccctcaccatgtatgactggctaaagtactaccctattattgtgaatactgtattccaatag

SEQ ID NO: 10316 - DNA, 84 bp, Glycine max
  Peptide Sequence Number=SeqID_102001
atgaaggaggtggtgggggggccagtgagaggctctattgttggatggaacttattagcagaggaggaagggaagtatttttag

SEQ ID NO: 10317 - DNA, 1437 bp, Glycine max
  Peptide Sequence Number=SeqID_102002
atggcggctggccctacatcactctccgatcgatccacgatggtccctcccccaatgctcgtctccgactccttcgccaaggacgcaatcctcgcctggttccgcggcgagttcgccgccgccaacgccatcatcgacgccctctgcgcccacctctcctccgccgctgcatcctccgcccacgactacgacgccgtcttcgccgccatccaccgccgcaggctcaactggatccccgtcctccagatgcagaagtaccactccatcgccgacgtcacgctcgagctcgccagactcgccgatagaaaccactacgctgccgccgaagacgacgacgccaaacacgaaaccgacgagaaaacgacgccgtcggagagtgtcggagatggtggtggcggtgatgaacacgaggagtatgagtcacccgagagcgagattactgattcaggctacgggaccacccaaggcgagtgcatgatggtgtcgttgacgtcactcgtgttcggattcggattcggattcgggtccgggtttttgggtcttggcatcttgggtccctatcacccctctgagttagtgacctgccccagtttacgggagaatgtagtaaaaggattgaagttatatgaggacattttcactgattcagaactgtgcaagctgacagattttgtcaatgagatccatgctgctggccaaaatggggaactgtcaggcaatatagaaccaattccagcacttctccaaggtgtcattgatcatcttattcagtggcaattacttcccgagtacaaaagaccaaatggttgtatcatcaacttctttgaagagccatttctgaaaccaccacatttggatcaacctgtgtcgactcttcttctctctgaatcaactatggcttttgggcgtatacttatgagtgaaaatgatgggaactacaaggggccactcacgctctcattgaagcaggggtctcttttagtgatgagaggaaacagtgccgacatggcgaggcacgtaatgtgtccatcccctaacagaagggtcagcatcaccttcttcagagtgaggccagactccaaccaatgccaatctccaactcctactacgatgacaagtgcgatgactgtgtggcaacctggcattgccgctagtccatatgctttgccaaatggtgctctaactagctatgagggtatggacatgaacatgatgcccaaatggggaatgcttcgcgccccaatggtgatgcttactcctatgcgtcctgtggcgctgaaccctcacaaactttctggtggtgggactggagtgttcttgccctggaatgtgccatctagaaaacctgctaagcatcttcccccacgtgcacaaaaaggaaggcttctcacattaccttcccctgttgaacctcaaatgggagagtccacttcttaa

SEQ ID NO: 10318 - DNA, 90 bp, Glycine max
  Peptide Sequence Number=SeqID_102003
atggctggagattacctctactggatttggaagcaattcatgcaaggctttgaggttatcagcgatacgttgcctgcgttgctatattaa

SEQ ID NO: 10319 - DNA, 1122 bp, Glycine max
  Peptide Sequence Number=SeqID_102004
atggcagtcgtacctgttgagagtattgcctcattgaatagtgatctcctctatgacatattacgacgccttgatggccctacgttggctagtgcagcttgcacttgtgcatcattttcttccatctcaaaagaagagagtttatgggaaaatgtatgttcttctgtgtggccttcaaccaatagggaagatgtcaaaagtttaatatcttctaccggtggattcagaaaattctatgcagattgttttcctcttattataaacaaggaggtaggagagtatcaattgagcagctatcttgagtaccctgatgattggactgaggccaaatattatggggacatgattgaatttgaaagcatctctccatcagattttgtttccattgtggatatcaggtttaaggagaaaccaatctgctccaaagttctatgcggaattccaaacgcaaatggctatgatgagtggttctacaactgtccttttcggattgatcttctgagttgtgcggatagagatgataacaatgatggtgtggttaccctttctgtatctgatggattgccaccaataacatccatggaaagggaaaagaaagatgggaaactatggcaggagcttcgtgatggtctcttgcttagttggatcatagtaaacaagaaaataaagcaatctgctaatcttgcaagttggatctccttagatggacaaagacattggccaacagataaggatttcgtctttcgtttcggatctgttctctctgccaaggacatttttccttctcaagtagtgcagtgcatccttattatgaagtttagagtggttcacactgaagaagagggggttcaaacaactcttaaaacaacagagttgagtatgcagttggaagacatggaaggtgctcatgttaatgggaggaacagtttgcttattcttaaggaagcacttagctgccgaaggagcaaaaactatagtgaagtacttgaatcctgtcttattttctcaaaagtgcaaaataagttgaaagaggagaagattaaaaacgaaagtaggttggacacactttgtatattaagtggcattgttgctgtaatgacattctggtactatgttttctga

SEQ ID NO: 10320 - DNA, 1230 bp, Glycine max
  Peptide Sequence Number=SeqID_102005
atgccaacagcaagggaagtttctgaacacaggacgagacagtgtctccgtcgtcctcattcgcgaacatatacatttttcccagtatgcttggtggtgctggtggctgtgcggctagttgaagttgaagctttaagcctgaaagtagtgtggcgcaaggacccagaactcgaccgagccatagagttggacaagcgatacaagcaatgcgcccgcgtcgtcaaagaagtcctcaacgaaccaggccaggtcatccctctccgctacctcgaaaagcgccgcgaaaggatgcgcctcaagctcaaagccgaaacctttctcaaccaaaaccccggcctcttcgacgtctactacgaccgcatcaaacccaaaaccgaaccggtccgcttcctccgccccaccgaccgcctccgccgattcctccaccaggagcgacgcgttttcctcgacaacgagcccttcatcgtgtccaagttgtgtaaactgttaatgatgtcgaagaacaaggttgtcagtgctgacaagctacttcacgtgaagagggagttcggcttccccaacgatttcttggttgatttggttcctaggtatccggaatattttaggttaaccggttctcctggggaggggaaatcgtttctggagttggttaattggaaccccgagtttgcaaaatctgtaattgagggaagggctgaagaggagagtgagcgtttggggattagggttaggcccagtttcaatgtgcagcttccacgagggtttgtgttgaagaaggagatgagggagtggattagggattggatggagcttgattacgtgtccccttatgaggatgtgtctcatttggatcaggcttctagagagatggagaagaggtccgttggagtgttccatgaactgctctcactttccttgcacaagaggattcctgtgccgattctcggaaagttttgcgacgagtataggttttcgaatgcgttttccaccacttttactaggcattcggggatattctatctgtctttgaaaggagggattgagacggcgatgttgagagaagcgtacagaggcgatgagttgattgaccgcgatcctctgctccggataaaggatatgtttgttgagttgttggaggatgggtggcggcaaagagcagagcagttgaggttgaagcaagagaaggttaaggaagatatggagttattggctactaaagttagtgaatga

SEQ ID NO: 10321 - DNA, 207 bp, Glycine max
  Peptide Sequence Number=SeqID_102006
atggcacaacgaatcagaaacgataaccataacttcaaccttaaaaccgaacacaagattggattcttttccactaccaaactttcatggcatcaaaaccccaccggcaacagttttcttcttgagaagtttggtggtgaccctggctttggtcattcccgtgtccctcatcatcaccaggggatgaaggagagggtggtggtgtga

SEQ ID NO: 10322 - DNA, 150 bp, Glycine max
  Peptide Sequence Number=SeqID_102007
atggcatggaaattttggatttttctatccatgggaggagtacctaaagattggagaggttcttcgagaacttgctgcaattattcttgctctgggaggttgcctccaagcctcaactacgaaaataaggttttaacatcggttatttaa

SEQ ID NO: 10323 - DNA, 1059 bp, Glycine max
  Peptide Sequence Number=SeqID_102008
atgggcatgttggggtgtcttttgtgcattgttggatcaactgttattgtgctgcatgcacctgaagagaaatctcttagttctgtacaagaaatatgggaattggccattcaacctgcattcctctcatacactgcctcaacaattgccgtgacattgttcttggttttgtattgtgctccccgttatggccagactaatattttggtttatactggaatatgctcgatagttgggtccttgacagtatgtggtcccagtggtcgctggtatctggcagacagtgggtctgtgcctggagatcttttacttataataggaaaggcacttacccatgctactgttggcctatgtcctgctgcatcatatagagcttctcctgattattttttgagtcctaatggtggaggaaggtactttcttgagctttgtgactgtaggacttctcttgcatatagactcatgccacagggcaatgctatattagattgttccctaattgcagcagctggccatgttattccccaaagttatgttcgaatatctgtaagccaatttatggatgaccttgttgtcgaagaactgataggcaatagatgggtttataaaaacaatggataccttatggtctcgtgcaatggaggactcaaccaaatgagagttgcgatatgtgacatggtggctattgccagatatttcaatgtcacacttatagttcctgaactggataaaacatccttttgggctgatcccagtgactttcaagacatatttgatgtggatcattttatcgcgtcctttagagatgaagtgcggatattgaaagagttgcctcccagactcaacatgaaagtggagcgcgggtttctttacaccatgccacctattagttgtctgatatcttactataaggaccagttatttccttggaccctcggagtgtggactttccagagactattccatgtcttcaactatactccttcttggaattgtgtatgctgtggtggcttcaagatttctaggattttggaagtctcaaatatttctaaaccatag

SEQ ID NO: 10324 - DNA, 246 bp, Glycine max
  Peptide Sequence Number=SeqID_102009
atgacaattttttggctgatgcatctggcacaggcatgccatccattcgcacagtacttcttccttctcttttacattttcattgggattgctcatgactatgtattgaactgtagaagcaagcttcatgatgaatcaagattgattcaaagaagttttgatgatgacaaaggtgatgacaaaaagctcaaagatcaagaacaattcatgataacaaagatgatgatctcaagaatcaaagaatga

SEQ ID NO: 10325 - DNA, 417 bp, Glycine max
  Peptide Sequence Number=SeqID_102010
atggacaaaggcctgattgaggtttgtggcgcgagaaaagagggaggaaatgtgtgcatgcaatcggctgataagagctcgagcaaacccaagccattggtgatccacttcactagggatgttgacacgcacaagccccgaggcttccagcctatcccaattaagaaacctgcatcattcccctacaaaagtgacaaggcgttgccatggaggtacgccacacaagggcccgacagaaagaaggacgcgtccgtcgtacatgctaagtgtcataccctaatttcgtccggggacctttgcttgatgacatgcgacttttctttggtccttgtgaggtgcttggcacccatcattaggcaatttgtgaaattccaggacatgccggaaaaccaaaaaatattgatgcacaatccgtaa

SEQ ID NO: 10326 - DNA, 423 bp, Glycine max
  Peptide Sequence Number=SeqID_102011
atggacagagccaggttggtttatgacttagtcacagacatggacatggacatcggagccctgatctcagccttgatcactgccctatgcagagctagaggagttacctctaatagtttgacctatgagagcctaagcctggccattaactcagcctacattaagaaaaactgttggaataaggattatctgacagttcaaatccttcctaagaatcttcccaggatggccctcagtgttcaagatgaaccctcggcctggcaactgcaatatctagagtatgcgggtaaagtctcaccttctgctaataccacaggtgtctctaggaatgtgttgagactttcaacatcaatcttcactaaatggcctctgactctggactactttggtgaagggccctcagagctatataagtttgcatag

SEQ ID NO: 10327 - DNA, 553 bp, Glycine max
  Peptide Sequence Number=SeqID_102012
atgaccgactttcgtctctgctcgacttgtcagtctcgcagtcaggctagcttatgccattgcactcgacgaccgatttccgaccggtctgagctaaccatcgcgcgcctccgttactctttcggaggcgaccgccccagtcaaactacccaccatacactgtcccggatccggataacggaccgcggatggctccacagaaactggcgtccctgcttcaaagcctaccacctatcctacacatgccttggcgaatgccagtgtaaagctatagtaaaggaaccccgcatcttcacggggaattcaatttcactgagtctatgttggagacagcggggaagtcgttacgccattcgtgcaggtcggaacttacccgacaaggaatttcgctaccttaggaccgttatagttacggccgccgtttactggggcttcagttcagagcttgcacccctccctttaaccttccagcaccgggcaggcgtcagaccctatacgtcgtattgctacttcgcagagccctgtgtttttgataaacagtcgctaccccctg

SEQ ID NO: 10328 - DNA, 633 bp, Glycine max
  Peptide Sequence Number=SeqID_102013
gctgcgcaaggcgaaggcaaccgtgaccagctggtattgcgcggcaaccaaaccactggcgacctgtttgtcgatggcctgcgtgatgatatccagacttaccgggacttgtataacaccgacaggatagaagtgctcaaaggtccgaatggcatgatttttggtcgtggtggcgcgggcggtgtagtcaaccgtgtcagcaaaaaagctggctgggatccggtgcgtgatatcagtgtcagctatggtagttttgatcaccgccgtatcagtgctgattatgggcagggtttaaccgacgaagtcgccttcagattgaatgccgtttatgaaaactccaactcataccgtgacggggttgagttgaagcgctacggcgcaacaccgacttttaccatcaagccagatgacaaaaccgagattgtattaagcgcagagtacttcaaggatgagaggactgcagaccgcggcgtgccttcctttattggtggcgacaatagcaaccttaacaaccgcccctaccgcatcggtgattacgacaagttttttggtaacgcacgcttgagtcctacagcaactgaaactgtcgccttcaatgccgccatcagccacgcttttgataatggcatacag

SEQ ID NO: 10329 - DNA, 433 bp, Glycine max
  Peptide Sequence Number=SeqID_102014
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccatcttctttgtttgtaccaaaaagagtgttcgtgtgtatgatttactgaagaccaagatcataaaaaagcttgatactgggcttcgtgaagcttcatccattgcagttcatcctggaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10330 - DNA, 378 bp, Glycine max
  Peptide Sequence Number=SeqID_102015
gtagctgtgtctccggcaaaaccacctccaaagcccgatctggaggtcgatgatccgctttatctgatgacattgaccaccccagagcttttcttaaggccttatcagcatctcactgaaacatgtatgcgagcagggaattttgatatctatggattcctcgagccacagtccattcagaggtctgggcaatcgcagtttgagtctgaaagttacataaagacttggatgcagagttcaaaacgcgatgtctatcttggagcctacctaaatgggccagacaactaccttaaggggattattaatagtgctttaaaaggtcttgatgatgctccacagcctaaatcaaagactcctgctaggtggattgtcgtcaag

SEQ ID NO: 10331 - DNA, 483 bp, Glycine max
  Peptide Sequence Number=SeqID_102016
atggcttcaaacaaaagaaaatcatctgctccttcatcttcccaaattagatttgacagatcaagattccattcacaggaagcttgggatagatataatgacattgttgtacctaggaagctgcttctggaaagaaatgtggtagtatactacacaaaatttgatgagttcaaggatgagctgatgagaaggaaatgggatgaggaattaaccagttttcctgaaggcaacatcattgttgccattgtaaagggattttatgcaaaccactacgacccagaagataagtcacctaagcaggtgcgggtcagaggtcacttgactgagtttgatgaggagacgctaaatacattcttgaagacccctgtaatcatcgaggagggggagacattatcagcttactctagattttcactcttgaggcctaatcctcaagagtatgctgctaagctctgcatcccagggaggaggggatcctctaga

SEQ ID NO: 10332 - DNA, 413 bp, Glycine max
  Peptide Sequence Number=SeqID_102017
atgaccacattggcctctgcttgtcaatcgaacttggggtctccgaatgacgcggtgtggataaccggaaggtgtttccgcatgctaccagactcttgggtcatgatagaaaaaggtggggtggtcgacaaaagcgaggtttttgctcctatgtatcctccatttgtgatgaggaactcaggcctacgtagttctttcaaaagtgagactatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10333 - DNA, 745 bp, Glycine max
  Peptide Sequence Number=SeqID_102018
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccactctccggtgcttcaacaaaatggcctacctcctctagttagtgcattgaaagcttcggctgagcaaaatgttgccagtggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcgccccgacacccgccaacacccgctgacgcgccctgacgggcttgtctgctcccggcatccgcttacagacaagctgtga

SEQ ID NO: 10334 - DNA, 792 bp, Glycine max
  Peptide Sequence Number=SeqID_102019
atggctccgagaaagctttccgcaaagagatctaggaaggatgccgcggctgaagggactagtgccgctcccgagttcgacagccatcgtttcaggagcgctgagcaccagcagcgtttcgaggccatcaagggatgggacgatgagtacacagatttccaggaagagatagcccaccggcgttggacgtcgctggtcactcctatggccaagtttgacccagatgtagtcctagagttttatgccaatgcttggcccatggaggagggcgtatgggacatgcgatcatgggtaagggaccaatggattccctttgatgcagacgccctcagccagttcctgggagacccgctagtgttagaggagggccaggagtgcgagtatagccatcgcccaactgttatgcataccgggtcaggattttgcccggactgctgccgggagacgggtgcggatcatgcgcaccaacatgactaccttgacccagacatggatggcgttgctgctcagcaacatcctgcccagcgatcacaacttcgacctccctctgccgaagtgtcagctggtgtatgccatcctgacatggatgagcgtccatgtatgccacctaccaggcaccctttagacccagataagtctaacagggccctgggttttccagcattgatcacgggtctctaccagtcgttcggggttcccgtcacacctagtaaggtgattcgaccgccgatcacccgggccttcatagagaagtattgcacgcctagacaggcgcagggtggcgcaccgtag

SEQ ID NO: 10335 - DNA, 264 bp, Glycine max
  Peptide Sequence Number=SeqID_102020
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtatagccccacgaagctcaagcacaggaagagtggcaagggtgaacaccacaacccaatcaggccaacccaatttcctcaacgaattggcaatgttgaagccggtaccgagctcgaattcgtaa

SEQ ID NO: 10336 - DNA, 114 bp, Glycine max
  Peptide Sequence Number=SeqID_102021
atgtcaaagtatgaaagtacccagcttgcgaaagttggggcagaagatggatccggaactgctgatgtgcctgtgttttacttccagttgcactttgactctgacgggatgtaa

SEQ ID NO: 10337 - DNA, 207 bp, Glycine max
  Peptide Sequence Number=SeqID_102022
atggcatccaaaaggggaatattgacttccaccctcctgaaagtctcaagaacatcagaatcaagcttcactttctttgcaggaatgaatctagaaagaaaaggtagaggaatctatttcggcactatcatcaattttggaaccaacatttgttggctttggaagctttcttccactcctcaaggaccatacctcaagtttggatga

SEQ ID NO: 10338 - DNA, 393 bp, Glycine max
  Peptide Sequence Number=SeqID_102023
ttgaagacccctgaagaagccatggatcttattgaaaatatggttgcaagtgacattgctattctcaatgcaggtggaacaacgaagaccaaggtatctatgtcaaaccataagagcacagagtcagccattctggaagtccaagtgggacagctagcaaaacagttggaggataggtcgtcaagcagctttagtgctaacactaagaagaatccaaaggaaaaatgtaaagttgtaatgacaaggagtagaatggcaattcaggctgatgaaggtagagctgaagataaggtggagggatataaacaacagtcagcagttgagccagcactggaactagtttctgactttgttgaacttgaggaagttgtggaagatgaagataaccaatag

SEQ ID NO: 10339 - DNA, 282 bp, Glycine max
  Peptide Sequence Number=SeqID_102024
atgggctcaaaaatctaccctaaggttcatgagaaccctagggccttctttagtagctctagcccaagcctcttggagtcttctatccaatacccttggggggtaggattgcatcaaccactggttactgcagaggatctttcacaaaccaacgatcataaccctaacagagcaaccgaaggaggagctctagagagcaccagaaacgccacaattgctaatggagaacgtttgagtgactacaacgaggtaagggatgagttattcacacttggggattag

SEQ ID NO: 10340 - DNA, 237 bp, Glycine max
  Peptide Sequence Number=SeqID_102025
atgaaagtcaaacacaagcgttatgcgacaaatacactagactcaagcctacatgcaatgtggtaccatttttcagtgaaaaacctcgttgggcgcctaggagtacatgacaggacatgcctcacaatgggcttaaaggagcactcaaacccgatgaccccgaaggcctacactccgaagagtccatcagagcctctccctcctgattccggtccaacccaaaaagaaaacatttga

SEQ ID NO: 10341 - DNA, 216 bp, Glycine max
  Peptide Sequence Number=SeqID_102026
atgaatttcataacaagttttttacacattggagagtacatcctttctggtacaagtagagggtacatctacttgggttattgtactgagaacaagaaaaggtacatcccttgtgaatcagttcaagtggagggtacatccacttggttgttcaaagagaacaaaggaaggtacatcccttgtggatctttggctgtaaaggattttacaagttga

SEQ ID NO: 10342 - DNA, 502 bp, Glycine max
  Peptide Sequence Number=SeqID_102027
gcagctcatggcatcattcagccagatgcagtcccatattcagtcccagatgcaatctcagggacatgcactgcctcccgaccctttggttggtccctcaggtgctcgagtaagcacaaaggggagttgtgttgatccctcaagaaatgatcccgagacgggtgactcaaataggtgcggcttgtacatcgaagtagatcttgcccgcctggttgccctggggaaagtttatgagggatccactgttgttcataacactcctttgttgtctggccaagtaaaggtgagtgtggaggaggttatagttgcagatgctccagttcttgtacccactgatgaggtttccttagtggggcaggcacttcaaaccttccttgcttggccgacacatctagtagctgtgtctccggcaaaaccacctccgaagcccgatccggaggtcgatgatccgctttatctgatgacattgaccatcccaaagcttttcttgaggccttataag

SEQ ID NO: 10343 - DNA, 936 bp, Glycine max
  Peptide Sequence Number=SeqID_102028
gtgacattgctgaaatagtggtccacaaccagttaaaagaaaatacttcactgcactggcacggagtctttttacccaataaggaagatggtgtgccttttctcacccaaaatccaataaaaccaggtgaaacctacacttatcgctttccagtgattcaaaacggtactcactggtaccattctcattcaggaatgcaggagcaaattggtatgtacgggagcctcatcctgaaaaagcgtgaagaggataaaaaatttagaaaaggaatcgacgatttgccaaccgttcctgttattttaagtgaatggacaaaccttaatccggacaatattcacagaatgcttcataacgccaatgattgggcaggaataaaaaagaatgcaacacaatcttatgtcgaagctatcaaggaaggttattttaaaaccaaaatcgccaatgaatggaagcgtatgacagcaatggatgtaagtgatgtgtattacgataaaatattaatgaacgggaataacgctacagatttaaaaaccgttgatggtaaaacattaaaagccggcgataaagtaaggttacgaatatcaaacggtggtgcatcatcttacttttggcttcgttatgcaggaggaaaaataacggttgtcgccaacgatggaaatgacgttgaaccggtagaagtcgaccgtttgatcattgccgtttccgagacttatgatgtagttgtaacaattcctgaagatggggtttcttacgagtttttagctactactgaagacagaacccagtcagccagttattacattggaaatgggataaaacagcttatttcaccacttccaaaattaaaatattttgaaggaatgaaaatgatgaacgggatgatgaaaatgaacggagacctgaatgatatgggcatgaaaatgagcttaaaccggg

SEQ ID NO: 10344 - DNA, 257 bp, Glycine max
  Peptide Sequence Number=SeqID_102029
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccaggtcggactatattttatcatcctacttacactcctaagtatgtgtag

SEQ ID NO: 10345 - DNA, 414 bp, Glycine max
  Peptide Sequence Number=SeqID_102030
atggagacgtgtttggaagtagaggaattgttacaacggatgatagaccaaggtcgactagaagtcggcattgaaggaaaagaagagcagcatatatgcatgcaatctacggaggggagtggtgttgcgaggcctaaacccttggtgatatacttcactaaaagtgcagcctcgcaaaagcccgggcactccttaatggccaaacctgttcctttcccgtaccaagatagtcacgcggtcccatggagatatacacctccggagaagaaggaagaagaagtcactgacgtcagctcgctgtcggctaaagtaacaaatatcacgggactgagtggtgtgacccgtagtggtcgtgtgttcgcacctccggacctaccggtccaacccgccgacgtcaagggaaaaggaaaagtg

SEQ ID NO: 10346 - DNA, 154 bp, Glycine max
  Peptide Sequence Number=SeqID_102031
atggctttcaaattaagttccgaattagtggatgctgccaaaggtagtggcgatgccatacgcaaaaaggaagagactcatagaatggcagaggcaaatagagcttttgcacatatcaagcttatcgataccgtcgacctcgagggggggcccg

SEQ ID NO: 10347 - DNA, 174 bp, Glycine max
  Peptide Sequence Number=SeqID_102032
atgcggcatccagaagcagattgtactgagagtgcaccatatgcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 10348 - DNA, 351 bp, Glycine max
  Peptide Sequence Number=SeqID_102033
atgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggagatgagctgtacgggtttgctaagcgcaccgcttcatctctctatgcaagaaaggcgcgctaagccaaaaatcactaacgtgcactaa

SEQ ID NO: 10349 - DNA, 606 bp, Glycine max
  Peptide Sequence Number=SeqID_102034
atggcttctcgtaaaaggaaggcaccagaattttatgctaacctctatgaccctgaagacaaatcgcctaagcaggtgagggtgcgagggcacctaattaaatttgatgttgacgccctcaaccccttcttgaagacactagtggttatagaggaaagggagagcttgctcgcctactccagagcccgtctatgtctccctgggagaggatttgagttgaatgcagatggcctacctctgaagatcttgaggaagaatctgactactctggcacaaacctggattgttttatccttttcaaacttagccctgacatcccacactcctgacattactttggataaggctaagttgatatacgggctcatcatgaagatggatatgaacttggagtccctcatctcggggactcagaaatccagggctaggagatctgaggccccatctacatcagctacccctgctccccatacatcagcttcttctacatctcctctccctccaccaccaacagctccagttcttccaggtccttccgctcagagctcagagccttccttgtctatgctgcagagcctgcatcagggccaactcttgatcatgtag

SEQ ID NO: 10350 - DNA, 403 bp, Glycine max
  Peptide Sequence Number=SeqID_102035
gaagcggaagagcgcccaatacgcaaaccgcctctccccgcgcgttggccgattcattaatgcagctggcacgacaggtttcccgactggaaagcgggcaggacataatagaaccccattgaaagcaaactccaggccttctactcctgatggtcacggaagcatttctgttttctccaatggacgtggaagaagtagttcacctatacctagtagtgcaggctcagatcttaggcaatcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10351 - DNA, 447 bp, Glycine max
  Peptide Sequence Number=SeqID_102036
atgggcggtgatgcctcccgggtggctgtggaaacgctcaaacagctgcatcgtctctgcggcggcgcattccagccgctgttgcgccaggccggccggcatatcgtgcgcagcgccgccgacgccgtccagcaggctgtcgcggcgcaccaaacggcgcggaaggccgcgggcgaacaggcccagcagctgacgggggagttttttcagtttcatggttcgcacctcgtcgcccggtgcctcacggcagcgggtaaacggggatcgtcatcggccgggcggatggcgggtgcgccaaaaagcctctgccaacgcagatccttattcttttttcagcagcaggtgcgaacgacgaagcgcgcgccaccggttaccgtgatgtacttcaccggtaaaacagcagcgccaggcggaaaggttttaccggtgaaccgagtgagtgtctaa

SEQ ID NO: 10352 - DNA, 373 bp, Glycine max
  misc_feature (367)..(367): n is a, c, g, or t
  Peptide Sequence Number=SeqID_102037
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcnaaggcg

SEQ ID NO: 10353 - DNA, 323 bp, Glycine max
  Peptide Sequence Number=SeqID_102038
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 10354 - DNA, 647 bp, Glycine max
  Peptide Sequence Number=SeqID_102039
atgcggcttttgtctttgctggctttttcattttccgcagccgtcgcctttgcgccttcggctgaggcgaaagacaagctcaccgtctatacctatgacagcttcgtttccgaatggggtccggggccgaaggtcaaggaaaacttcgaaaaggaatgcgattgcgaagtcgactggattgcttccgccgacggcgttgccctgctcaatcgcctcaagcttgagggcagcaataccaaagccgacatcgtgcttggtctcgataccaacctgacgaccgaagcgcgagccaccggtttttttgctccaagcggcatcgaccagagcaatgtaaacgttccgggcggcttcaaggacgatatcttcgttccctatgattatggctatttcgccgtggtctacgattccgaaaagctgcccaatcctcccaagagcctgaaggaattggtcgaaggcgatccttcccagaagatcgtgctgcaggacccgcgcacctcgacgccggggcttggcatgctgctttggatgaaatcggtctatggagatgaagcggaagcagcctggcagaaactgcaaaagcgcattctcaccgtcacgcccggctggtcggaggcctatggtctcttcaccagggcgaagccccgatg

SEQ ID NO: 10355 - DNA, 543 bp, Glycine max
  misc_feature (14)..(14): n is a, c, g, or t
  Peptide Sequence Number=SeqID_102040
atgacggtgaaacnctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccctgctgcgatacagatccgacgatgagtcctgtgaaggtactgataccaaggacccgaccgtcgattttgggcgagaggcagatctggcggagtaggaagaagatgaggcagggttgtccccgaagatggaaaggatggtcgcccaagaggactaggcgttga

SEQ ID NO: 10356 - DNA, 345 bp, Glycine max
  Peptide Sequence Number=SeqID_102041
atgtgtcgtccaggtatgtcaacattgactgctttggatgagcttctggacacaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 10357 - DNA, 246 bp, Glycine max
  Peptide Sequence Number=SeqID_102042
atgacgagaatggtgctgacgtggctgggtgccgccagcaccaacagcgatacacaccatgccgccaataccaatggcaggacatgtgccaacatggacagtcccgccattggctcctgtgagaccaacgagacagctcatcccgccaataccaatggcgggacatgtgccaatgtggacagtcccgccattggctcatgcgtgaccaacgtggacgtgaatttgcaagtcccatcagactactag

SEQ ID NO: 10358 - DNA, 108 bp, Glycine max
  Peptide Sequence Number=SeqID_102043
atggcggctgagcagcctcagggtggttttccgatggtggagatgcaccacggggctctgcaacgcgccgcactggatggcgtggagtatcgcacccttctcctttga

SEQ ID NO: 10359 - DNA, 502 bp, Glycine max
  Peptide Sequence Number=SeqID_102044
atgactatgcaaaacatgcagttgcaacaagagaccggagccttcattcagagcttaactaatcagatgggacagttggctatacagttaaatcaacaacagtcccagaattctgatagattatcttctcaatctgtccagaatcccaaaaatgtgagtgccattacattgaggtcaggaaaacagtgtcaaggacctcaaccagtagcatcttcctcatccgccaatgaacctgcccaacctcactctactccagaaaaagatgatgacaaaaatttaaagaagaagcagcatatccctcttccattccctccaagagcaatttccaacaaaaaaatggaagaggcagagaaggagatcttggaaacttttagaaaagtagaggagttgtgcactaataagcggaagcttaaaggaagtgaaagaattagtatgggcagaaatgtcaccgcattgattggtaaatctgttccccaaatccctgaaaaatgtaaagatccag

SEQ ID NO: 10360 - DNA, 318 bp, Glycine max
  Peptide Sequence Number=SeqID_102045
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctaaacttcaaagttcagacttctttagaggcactaaatttcatgttcactttctccttctccctccattcttcttctcctacctcggggatcctctag

SEQ ID NO: 10361 - DNA, 453 bp, Glycine max
  Peptide Sequence Number=SeqID_102046
atgaccatgattacgccaagctcgaaattaaccctcactaaagggaacaaaagctggtaccgggccccccctcgagcatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10362 - DNA, 286 bp, Glycine max
  Peptide Sequence Number=SeqID_102047
atggctggcgctgatcgccgcgctggtcaatgccggcttcaccccggactactggctgctgcatcacctggaaggcgccgagctgccctacccgaccagcaccgtcatcgtgttcgcactgaaacgactgtggctgcgcctgttgatcgccttcgttctgctgctggcgtggtcgataccgtggatgctgtcggcgatgcaccagccgccggtgcatggcatgcacctgctgtggttgctgctgctggacgtgggcctgctactggcgctgtgcgcggtgtcggcg

SEQ ID NO: 10363 - DNA, 141 bp, Glycine max
  Peptide Sequence Number=SeqID_102048
atgacaaaagggtgcggaataaccataagaatgaccaaacttggtctctgcttgtcatcgggcccgccgcctctggatgacaaaagggtgcgaataaccataagtcaatttggagtgcttcttagtccaaatagctcttaa

SEQ ID NO: 10364 - DNA, 489 bp, Glycine max
  Peptide Sequence Number=SeqID_102049
atggcgttgaaatcgcacaagatcgagaaattcgaccccccgcacgcgccctcggcggatatgttcatcaacaagaccggctcgaccaaaggttttggcgcctatgcggcctttgtccccgcgaagaagaccggcattctcctgaaaacgcttcatccagcgcttgagcttggagcggttgcgctcccacttgccttcaaaacgcagcgacagatagccaagcgctgcggcaacggcgatatgccccacatgcagcttgcccgcaagacgcggcggcgcctcgttcagaaggtcgagcgcccgctcggccttgcgccattgcaggtcgagccagggctggtggaccttctcttcgggccgcatccgccgttcatagacatgggccagcagcacgtcgcaaagaccatcggcgatggcttcatagcgctcggcatcggtacgcttttccgcattgcgcgggaaaagcttgttgcccgaaacccggttcag

SEQ ID NO: 10365 - DNA, 467 bp, Glycine max
  Peptide Sequence Number=SeqID_102050
cagcgcatcggtcacgctgcgcatcaggcggctttccggcgcgaaacggtgccagtacagcatccggcgctgatacagacccggcgtcaaatcaaccagctctccctgcgccagctcgcgctcaatctgcaggtgcggaatcatacagcacaccgatccctgtcgcgccagctgcacaaaagcctctgacgagttcacgatgtggcacggcacgctgcccggcgataaatcaaagttctgctgcaaaaaggcctgatgcatatcgtcgaggtgatcaaacgccaccgccggggctttcagcagcgccgagcgcattcaggcgcaccggcgagtcggccagcacatctttcagcgccggcagcagccaggtagcaagactgtcggcgttcaccgccagcgacagcagtagcggcgtggtgccaccgttatcatcacccagccactcctcttccagcagctccacctga

SEQ ID NO: 10366 - DNA, 351 bp, Glycine max
  Peptide Sequence Number=SeqID_102051
atggattacgaacctccatttctagagttctacaagcccctccttctacaaggctcgcaccgcgttgatgttgccatcagtggcggtgccataagaaatgacaagtccgagtggtgtgaacttcctctgattgatcttggccgattaagtctcggcggcggcggcgagaaggaggagtgcatgagagaaatcagtgaagccgccagaacgtggggttttttccaggttgtgaatcatggtgtttcacaagagcttctgcaaagtttacggcatcagcaagttgggggatcctctagagtcgacctgcaggcatgcaagcttggcactggccgtcgttttacaacgtcgtga

SEQ ID NO: 10367 - DNA, 639 bp, Glycine max
  Peptide Sequence Number=SeqID_102052
atgaaaaacgccagcaacgcggcctttttaccgttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgtggagtggtatatactagagacgtgatgcgattctcttgcatacgtgtcacttatggagtgggttgtattagagacatggtggcgtgctcttacatacatgtcacttgtggaatgacatgtaccggagacatggtggcatgctcttgtatacgtgtcacttgtggagtggcacatactggagacatagtgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10368 - DNA, 207 bp, Glycine max
  Peptide Sequence Number=SeqID_102053
atgcagctcccggagaccggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 10369 - DNA, 927 bp, Glycine max
  Peptide Sequence Number=SeqID_102054
atgataattgaggagggggaagagcttcctgcctactctagatttgcactcttgaggcctgatcctcaaaagttggctgctaagctctgcatcccagggaggggatttgagcttaatgtcgacagcttgccactgaagatccttaggaagaacattaccacactcgctcagacttggagtgttctttcttactccaacttggtccctacctcccacgcttctgacatcacactggatcgggccaagttgattgatggcattatcatgaagatggacatgaatctaggctacctcatctcccaccagatttatatcatttcccagcatgactcctctaggcttggatttccagccttaatcacaactttgtgtaaagctagaggagtcacatcagattctagatctttggagagccttagccctgccattaacttggcatatataaagaagagctgttggaatctagatgatccaatagtgacattcagagggccaaggaaggccaagggtaagagatctgaggctccccctacttcagtagcaccaggtgcttcttctccttcttcatctactttaccagatccttcagcaccatccacttcgactccacatcttccacagttaccagcttcagctctcactcccttaccagctccagttcctgctccagcttctcctataggaccctcctcatttacctctgagacattatttgccatgctgcagagcctgcacagaggagtccagccttctccttttggatggggtgaggcctccacagcccaagagcctgtgatagcagagaagcctgtgccagaagcagaggatgagcttccgctcaggaggaagcagcagctcaggagcctacttctccagttcctatcactccagcacccatatctaagggcaccatgccatcagcactag

SEQ ID NO: 10370 - DNA, 177 bp, Glycine max
  Peptide Sequence Number=SeqID_102055
atggatgaaaggttatggtcaagcggcggcggcggcggcggcggcgacgggtgtgagtttgaggtcgagcgaggttgcgatcatgacttgacggtgttgctcttaccatcattctttgggagtttggtagggactcatggtgcaccggtggaccgcttaaatgatggtccacggtag

SEQ ID NO: 10371 - DNA, 561 bp, Glycine max
  Peptide Sequence Number=SeqID_102056
atgactagaggcaatccaggtgacttacaaccctttgaccctgaaatagataggacatttcatagattagttaggcatagtgtgcatcctgattaccctgaacattttgtaccttttgagcatggggagaagcttcttctccgatatttttatgaaggacttggtaacatggggagaagtatgatagatgctgccagtggtggagcccttggagacatgacccctgctgaagccaggaatttaattgagaagatggcttccaactcccaacagtttagcgccagaaatgatgctatagtcattagaggagtgcatgaggtagccacaaaatcatctgcatcatctgaaactaagaagcttgaaggtaaactagacgccttgtttaacatggtaaccgaactggccatgaataaaaaatctgtacctatcgcaagactctatggtttatgctcctcttccgaccaccatatagacctttgcccttctgtgcagcaatctggagcaattgaacagcttgaagcttatgctgcaagcatctacaatagacctcctcaaccttag

SEQ ID NO: 10372 - DNA, 801 bp, Glycine max
  Peptide Sequence Number=SeqID_102057
atgacccgtgcctacatccagtcctcaagcaacctcttgagatttcctttccttgtaaaaatcctttacatgaaaagagccacaaaggatgtaccctcccttgttctctttgaacaaccaagtagatgtaccctctacttgaagcgaaccacaaaggatgtatccttctttgtgttcactataacaaccaagaagctacctgcttcttacacaaaattctcagatgaattttcctttcttcaaagaaagattgaacaaaatcttagaatgaatttggcaaaggttttgaaagagaaaagcattggaaagttttgtgtaatcaaatgtgtttttctgtgtgtcgcaacctacccttttgcgggcgagcgaggcgaggctcacgggtcgacaaaagcggggctcttgctcctacgtaccctccatcgaagaggaaatcagacctacatagttctttcaaaaagggcgaatcaagcgattcttttttacatggaaggtggtccttttaaggcattggaccttaaaatgacccatttttacttggtgagaaaaactgaggaaaataggggaggagcttgccacccagctcgcccaggcgagccaggttacttccttcagaagcaaccgccttctggaggaacatcctggaaggcccaagtgggcctggaccttacgggtcacgtaattactccttttttggctttcagaatgttacggaacctcacggattgcgtaacaatgcttccttttgatttccggcatgttacggaaactcacggattgtgtaacaatgcttccttttga

SEQ ID NO: 10373 - DNA, 207 bp, Glycine max
  Peptide Sequence Number=SeqID_102058
atgttagaaaaaccaaaaagacgaaggtcttcaaattttgaaaaaaagggtttgggagttgtttacgcatggggaagagaacttgcggcactagtgatcggtagtgcctcaacctcatttttctcttctttcttcttcctctctctgatttctctcaatgctggaccttggaaccctttactcaccctccctcatgcctatttatag

SEQ ID NO: 10374 - DNA, 450 bp, Glycine max
  Peptide Sequence Number=SeqID_102059
atgggctcagaaatctaccctgaggttcatgagaaccttagggccttcttcagcagctctagcccaatcctcttggagcctcttgctcatggctctagtgactggtcccttcctatggaggattgcatcactctgcatgataatgacctggcctccatgaggctctgcagcatggcaaataaagtctctgaagtaaaagaagatggtcctgtaggaggagttgaagcaggaactggagctggaatagatggagttgcagtagaagaatatggaacagtagtggagggagctgtagaaggaggaatgtcagaagatggaggagcctcaaaactcttcccctttgccttacgtggccctctgaaagtaactgaggggtcatcgaggttccagcagtttttcttcacatatgccacattaatggctggactgaggctcttaaaaactaagtga

SEQ ID NO: 10375 - DNA, 318 bp, Glycine max
  Peptide Sequence Number=SeqID_102060
atgtgtggagggtttaccattaatggtccaacaaatcttaattgggctgatttatgtgaggaattattgggagtcagaccacaagaaggtgaaattaaaggtagtgtggttaaattaagttggctggctcaccattttgcacaaataaataaccatgacgacaaagaacaagtacaaagatattgtagcacatatgcatggggacctgtcgtacttgcttttttatacaaagagatgtgcagtgccaccaattatacaactaaatcaatcggaggtggctgcgatgtggaaatcaacatatcgacaatgatgatgtga

SEQ ID NO: 10376 - DNA, 414 bp, Glycine max
  Peptide Sequence Number=SeqID_102061
atgaagatatcaatagtattaggtggcccggttctgcatggagacgcctcaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10377 - DNA, 260 bp, Glycine max
  Peptide Sequence Number=SeqID_102062
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgctaacattcaatttttcatatggcaagtgtttcatcttgctctcccaatcaagggtgtaatctctcaccgagggattgaggtccctaattctattgaagcttgcctctcctag

SEQ ID NO: 10378 - DNA, 287 bp, Glycine max
  Peptide Sequence Number=SeqID_102063
tcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactggactcgctacgctcggtcgttcgaactggcggcgagcgggaaatggcttacgaacggggcggagattttccctggaaagatgccaggaagatactaa

SEQ ID NO: 10379 - DNA, 417 bp, Glycine max
  Peptide Sequence Number=SeqID_102064
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcggggtgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10380 - DNA, 357 bp, Glycine max
  Peptide Sequence Number=SeqID_102065
atgtccgacatcacccgtcgctcaatgctccttggaagcctcggtgttgctgccatcggcgtcctgtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcgggcgcattaagcggcggcgg

SEQ ID NO: 10381 - DNA, 508 bp, Glycine max
  Peptide Sequence Number=SeqID_102066
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatcgagacgagaagtgatgaaggtcatcaaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10382 - DNA, 237 bp, Glycine max
  Peptide Sequence Number=SeqID_102067
atgccacttaggattggagccaagttctataaatatggaaaagttcttcttggtgggccttgggtttgcggaaagttaggggctgcaggttgttggttggattcggggctaggtgtggttgtgctgatcttgacgacgcggtggtgctgcattaatgaatcggccaacgcgcggggagaggcggtttgcgtattgggcgctagcggagtgtatactggcttactatgttggcactga

SEQ ID NO: 10383 - DNA, 381 bp, Glycine max
  Peptide Sequence Number=SeqID_102068
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 10384 - DNA, 307 bp, Glycine max
  Peptide Sequence Number=SeqID_102069
ctgtccctcctgttcagctactgacggggtggtgcgtaacggcaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 10385 - DNA, 432 bp, Glycine max
  Peptide Sequence Number=SeqID_102070
atggccaagtttgatccagaaatagtccttgagttttatgccaatgcttggccaacagaggagggtgtgcgtgacatgagatcctgggttaggggtcagtggatcccgttcgatgccgacgctatcggccagctcctgggatatccgttggtgttagaagagggccaggagtgcgagtatggccagaggaggaaccggtctgatgggttcgatgaggaggccatcgcccagttgctatgtataccggggcaggattttgcccggactgctgccagaagacgggtgcggatcatgcgcaccaacatgaccaccctgactcagatatggatgactctgctgctcagcaacatcctgcccaccgatcataattccgacctccccatgccgaagtgccagctggtatggcgcccactaggcaccctttggacctag

SEQ ID NO: 10386 - DNA, 231 bp, Glycine max
  Peptide Sequence Number=SeqID_102071
atggatgaatgcattgaattgatgaaagaacataatttggaaacgttgggatgcttgagtgcccacctggctgtagccatgactaattttgcacgtagtttccaaatcatcattgtcgcgcgtgccttatggaataatgtggaagttcagcccgagaccgacacctcgtcgcccaaatttgtttttccccagatatcaagattgggttcccacgataaaagaccccattga

SEQ ID NO: 10387 - DNA, 803 bp, Glycine max
  Peptide Sequence Number=SeqID_102072
ggcttccccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattacaacaatccgtgcctggctcataaattttgtaggtgacggtgagatcgaagaagaaacgcagcgtgtgagtcgcaatgttggtgtatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10388 - DNA, 348 bp, Glycine max
  Peptide Sequence Number=SeqID_102073
atgatcccccatgttgtgcaaaaagcggttagctcttcggtctccgatcgtgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 10389 - DNA, 616 bp, Glycine max
  Peptide Sequence Number=SeqID_102074
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcacgatcgccgtcgctagccgagctgttgccagtgaaagccaaatggggtttatcgctgggagccttgctcaggcatctgcacaccgccgagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10390 - DNA, 224 bp, Glycine max
  Peptide Sequence Number=SeqID_102075
atgttggaaaacctgcgaaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10391 - DNA, 555 bp, Glycine max
  Peptide Sequence Number=SeqID_102076
atgaaagaaaaagaaataccccagtttcaggtagaaatatgtgctccagccaatccatatagaatagagttcgttgatgataagatcataaccctcgaaggcattcctgccagcttgccttatggcggaacatcaggtgaatgggggacatccggaaaaggatggaccgagcagcatggaactccgattggagctgatattacttactatgcagggtatgaagatactttttaccatctgaaagcggactttccggaagataaaattaaagactatatggaacgggcttatgcccaaagtgaagctcctctttacaccgaagaacttcaggaatataaaaacctgggacgaaatgaaacttttggaagtgcacagaatccttacaatagcttttcaactttggtttttggttttgctcccaagggaatggtagttgtatggcttcgttttcgtgctgttcaaatagaattaggcaggtttcaggccgatgtagtaaaaaatgataaagagcttgagaaaaagctgtttgcgaaatggagcatgaccagagaagag

SEQ ID NO: 10392 - DNA, 221 bp, Glycine max
  Peptide Sequence Number=SeqID_102077
ttggcccagggcttcccggtatcaacagggacaccaggatttatttattctgcgaagtgatcttccgtcacaggtattttattcggccgcaaagtgcgtcggctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 10393 - DNA, 357 bp, Glycine max
  Peptide Sequence Number=SeqID_102078
atgacaagcagagaccaagtttggtcattctgcacccttgtatcatctagaggcggcgggcccgatgatacgcggagataccttatggttattcgcacccttttgtcatccagaggcggcgggcccgatgacaagcagagaccaaaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggaatacccgagtggttatccgtataaacattcttttgctatctgtaagacagaacgcttga

SEQ ID NO: 10394 - DNA, 318 bp, Glycine max
  Peptide Sequence Number=SeqID_102079
atggctatttataggaaaaggccatttggtgcaggggaagctcacccaggcaagctggatgaaggcattccatggcctatgcaagccagattcctatggcaacataaaggcgaggactttgagtcctatggaaacataaagaaacataaaggcaaggactttgagtcctatgtaaacgtaaaggcgaggactttgagtcctatggaagataaaggcgaggactttgagtcctatggaaacataaaggataaaggcgaggactttgagtcctatggaagcataaagatagaggacgttgagccctacaaaaaaagatag

SEQ ID NO: 10395 - DNA, 93 bp, Glycine max
  Peptide Sequence Number=SeqID_102080
atggcagcccaaggaattaatgaagcattgggcttgaatccagaattaggattggacttgaagagggcagactattttattctacaaaattag

SEQ ID NO: 10396 - DNA, 481 bp, Glycine max
  Peptide Sequence Number=SeqID_102081
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccgctactgagcaacgtgccatggatattcactcacaagtaattaaagaagggtttcaggaagatactgttctctgtaatgccttgatacatgcttatgcgtgtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 10397 - DNA, 210 bp, Glycine max
  Peptide Sequence Number=SeqID_102082
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggctacagtaacaacagcggctttggcaaagaagttgtcggagaaattaagaggaagatag

SEQ ID NO: 10398 - DNA, 66 bp, Glycine max
  Peptide Sequence Number=SeqID_102083
ctgccttgggattcgtggaaggctattcagttatgctattttcattattcagagctttggttttag

SEQ ID NO: 10399 - DNA, 576 bp, Glycine max
  Peptide Sequence Number=SeqID_102084
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtctctggatgacaaaggtgcagatgacaatgttagtttctgcgtgtcaacgggctcgcttgccactggttggccaaagggtgcagaagacgatgtagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 10400 - DNA, 737 bp, Glycine max
  Peptide Sequence Number=SeqID_102085
atgcgccgctacagggccgcgtcccattcgccattccaggctgcgcaaactgtttgggaaagggcgatcggtgcgggcctcttcgctattacgcccagctggcgaaaagggggatgtgctgcaaggcgattaagttgggtaacgccagggttttcccagtcacgacgttggcgaattggagctccaccgcggtggcggccgctctagaactagtggatcccccgggctgcaggaattcgatcgcctggttcttctgcttctcactgctggaaaaacacatttatgactggtacgccatcgtcggcgttgtcgcgctgatgccgcccgtcgcggcgggtcttgcgacgttcattgcgcccaaactgtttacccgacaggaaaaagaggctgccagtagtgccattgtggtcggtgccacagtcgcaaccgaaccggctattccttacgctctggcagctccgttgccgatgattaccgccaatacgctggcgggcggcattaccggcgtgctggtgatcgctttcggaatcaaacgtctggcacctggtttgggtatctttgacccgctgatcggcctgatgtcgccggtgggttcgttttatctggtgctggcgattggcctcgcgctgaacatttcattcattatcgtcctgaaaggattgtggttacgccgcatcaagcttatcgataccgtcgacctcgagggggggcccggtaccagcttttgttccctttag

SEQ ID NO: 10401 - DNA, 684 bp, Glycine max
  Peptide Sequence Number=SeqID_102086
aagcggtgataaccgttatcgatagtcagaattttagcgttgactatgatgatcaaactgcaaccggccgcgtcggtcagccattaaacaaggcaggactctcactgttagttgaacagattaatgcccagccgggggaacgctttatcgtaaaggagtacacccgactggctgcggtggatagattgcagtcaattctgacggtggctgatcagggtaaagataccgggatgctcgagcttgagctgacaggtgatgataaagagaagattagcaggattctcgataacctgagctaccactatctggcgcaaaatattgatcgtgaagccgctcaggatgcgaagagtctccagtttttaaatcagcagttaccgcaggtgcgtagcgaactcgatcatgctgaagataagttaaatgcttaccgccagcagaaagactcggtggatctatcgttagaagcgaagtcagttctcgatcaggtggtcaatgtcgataatcagctaaacgaattgaccttccgtgaggctgaagtctcgcaactctatacaaaagagcaccccacctataaagcgttgctggaaaaaagaagcaccctggagcagcagaaagcgaaattaactaaacaagtatcgttaatgccatcaactcagcaggaagtgctgcgtctcagccgcgatggga

SEQ ID NO: 10402 - DNA, 265 bp, Glycine max
  Peptide Sequence Number=SeqID_102087
tgatcaagggattcccacggaccctaagagaataaaggacattcctgagtggtccactccaccaacactactcattgagttggagaggaaccatgttccctcatgggaagatgcccaagaaaagggttttcagaccttaccctactctaacatacccaacaccactaagggggaggtgagcatttacatgttacaccccatagccacatcatatagttacactttgtgcatgtccttcatgctttacatgcctcatgactcctaa

SEQ ID NO: 10403 - DNA, 288 bp, Glycine max
  Peptide Sequence Number=SeqID_102088
atgtacatcaagtatggcccaaaatacatcatgaagcatagccaacaaaacatgttatccaacagaagcccccccacacttattcccaaaacaattccaaagctccaaaattccttaaggttaaggaagcatcaacaagattcaagccaaggctattgtgcaagcaatcaatggggcaaaacacaccaaatgattatgatgatggatggctcaaattctcacaaaggcttttcaaggattaacattcaagacaatacttccagattacaagtcacaacatcaagatga

SEQ ID NO: 10404 - DNA, 846 bp, Glycine max
  Peptide Sequence Number=SeqID_102089
cgtctgtcaactggttccctcgatggaaagaaggaagaaccggagttcttgtctcgtgcggaggatttccgaatgttcccttgatggggacaaggggttgcatcagttacaatcccgttcttactataagacaacttggctaccctatgagaggggcaccactagaggaagagctcgcacctgacaaagaattcagaggcagtaacaacgggcccattggtggctaccgtaagtggttgaaagcccacgtgcaaggtttggattggctcccaactctgaggaccgctaaaagggaaaaagttgaggcaccgaaggaagacgaagaggagaatgctgaactgagagatataaatatagctaccaccaaggccttggaacaagagaccaaaagggctcatagggaagaacacgaccgaaacaaattccgaggggctctgtggggcagtaatagtgagctcaagcttcgaagggaagagaaagaccaatcacgagcacatagcatggtcttgaaagaggagttagctgcttgctcaaggtccagaagaaacctgtctcagcggttatgcgagacagagaccaacatgttagccatcatcggcaagtaccaagaagaactaaatctagccacggcccatgagcatagagtggcggacgagtatgcccaagtgtacgcggaaaaggaggcttgggtgatcgactcgttacatcaagaggcaacgatgtggatggaccggtttgctcttaccttgaacgggagtcaagaacttccccgattgctagccaaggccaaagcaatggcggacatctactccgccctcgaggagatccacggacttctcagctatt

SEQ ID NO: 10405 - DNA, 225 bp, Glycine max
  Peptide Sequence Number=SeqID_102090
atgcatgatttcattgaaaacattatcaatgtcaaacctgatggtaattatggatatcgtgcaattgctgccgtattaggtatgggtgaagattcatggcctttggttcgtaaccattttcttaaagaactagaaaaatggtctgatgagtatatcgacctgcttggtggcatagacagacttgaggagttaaagcagtcgctacttgttgatggattatccatg

SEQ ID NO: 10406 - DNA, 285 bp, Glycine max
  misc_feature (108)..(108): n is a, c, g, or t
  Peptide Sequence Number=SeqID_102091
atgacggtgaaacctctgacacatgcagctcccggagacggtcacagcttgtctgtaagcggatgccgggagcagacaagcccgtcagggcgcgtcagcgggtgttgncggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 10407 - DNA, 438 bp, Glycine max
  Peptide Sequence Number=SeqID_102092
atgaccatgattacgccaagctcgaaattaaccctcactaaagggaacaaaagctggtcgagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10408 - DNA, 336 bp, Glycine max
  Peptide Sequence Number=SeqID_102093
gtgctccagtggcttctgtttctatcagctgtccctcctgttcagctactgacgggggtggtgcgtaacggcaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 10409 - DNA, 186 bp, Glycine max
  Peptide Sequence Number=SeqID_102094
atgggttgtgaagtgaaggaggagggttgggaaagagagaagagggagtggggtgccaggaaaggagggaagagggaggggacgctctcaccgtgcaagctgcgtcatcccgaggcaaggcccatatgccatgttcaggtcgaattgccctcatctcccacagcagaaaaccagaccaaaaattaa

SEQ ID NO: 10410 - DNA, 263 bp, Glycine max
  Peptide Sequence Number=SeqID_102095
ggctaacatatcatgtgggagaaaagcttggtgtgccaaaagatggtttaggaggagtggtttgtccaggcattgagtatggaacaaaaatgctcttcattgataggaaggagaagtttgttccaacattgaaaacattttatgaaatgactgcattaacaacatttgatgaagtggccgcatgtgaaatggacatggagttcagtgacttcgtaaaagaaaatgttaagctcgatgtgttggaccaggcgtggctagagtga

SEQ ID NO: 10411 - DNA, 588 bp, Glycine max
  Peptide Sequence Number=SeqID_102096
atggatcaggattactacaacaccaattatcatattggtatgaaattttgggcattatatgcagaacatagttctgaccaggctgagttcttgaagctctccaagagaatagattatgaccgggctgagttcttgaagctctccaagagaatagagtacacaattcgagcttggtaccttctacagtttgagggtttgatgatacatctatttcttaatttttcggacataatcatagttacctgtaggttgttggggaccttgattcatttaagctttcaacaactttactccctctttgatcctgtacacggggcacaaaagttggaacaacagaagttatcttccgaagaaattgatgtgcttgaacataatttcttgacatacctatttcaggtttgctttattccacagttttacgaatcagtatcaaaagacgattactttacgaaatggtttcattgcagcaagagcaatttgagaattctgcagcaagtcgagttgctcctgcatagcagcaagcaatggcaaagcaatctacaaacaccaacaaaggcgatcattttaacatccatcgttgctctatga

SEQ ID NO: 10412 - DNA, 756 bp, Glycine max
  Peptide Sequence Number=SeqID_102097
atgactttcatcagtgggaaggctcaaggagcgtcacaatgtcattgtttgtttgacacaaaggttgtttgtctattgttctttgaagggctaacacatcatgttggagaaaagtttggtgtgccaaaagatggctttggaggagtggtttggctaggcatagaatgttggaaaatccattctggagtgttatcacgagtactagagagcttcgtatcaaacattgttgcacatattgatgttatgctctatgttgatgacttgacaaaacattttgacccaatctcatctctccccaaagttagtgtaatttctcataagagcatttttgtttcatactcaatgtttgcccaaatcactcatcttaaacaatctttttgcacaccaagcttttctccatcacgatgtattagccctacaaatgaagctaaatcaccgttcatcaatagaaataaccttcctttgagaggggtaggagtcaatagagttttgacttattttggtagtattgagaggaaagagaactttgttccaacattggaaacatttgaggaagttccaacatcaacaacatttgatgaagtggtagcatgtgaagtgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 10413 - DNA, 402 bp, Glycine max
  Peptide Sequence Number=SeqID_102098
atgtgggccgtttgcaaagaatctcggcgaactctcggagacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10414 - DNA, 430 bp, Glycine max
  Peptide Sequence Number=SeqID_102099
atgtcttcgctgaagcacttcctacttcagcttttaatggttgtacatgcaagttgggtctcattaacatttactctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtcgggcgtgcttttgccc

SEQ ID NO: 10415 - DNA, 348 bp, Glycine max
  Peptide Sequence Number=SeqID_102100
atggttcttggagcgagtagtccccttgtacttgccaaagtccggcaccttgaacttgggaatgaccatgtttgggtattaggaacaactcttctaggagtataccaccaactgcttgcccttccgtggcatatccgaggcaaggctcgaagtcggctagattgtggtggggaatttcatgtgtcccccccacggagtggagttattgacattcttattgggagtgtacgccactttgggtggcgtatagttgagaggcaagccatatggcgggaaggcgtgcttgttttgaatttgtacattatgggggctgcccgcacttcccaaatctttgcctaccatatctga

SEQ ID NO: 10416 - DNA, 178 bp, Glycine max
  Peptide Sequence Number=SeqID_102101
gctggctttgaggaagaaagctgctgtcaactccaaaacctctgggtcggatcctgccccacgtggtcctcacttcagccctatctctccttcggggttcaacctccttaagcggtcagcgggcataattgaaaaaagaaaggcactctatgttctcgttctcggtgctccggtcaag

SEQ ID NO: 10417 - DNA, 195 bp, Glycine max
  Peptide Sequence Number=SeqID_102102
atgcgacagaaactccatgggttatcccaaggaagtttgactgttgaggacaaggagatggagatggcactagaatttaaagatgtctttcccaaggagattcctcatggactaccaccttcaagaagcataaaacatcaagttgatctccttctagaagcttcaattcctaacaagccaacttacaacagctag

SEQ ID NO: 10418 - DNA, 453 bp, Glycine max
  Peptide Sequence Number=SeqID_102103
atggggctggagtttaacataaaccatttgtccaacctcgtattgaacatctcgtctctttttgtcaacgaagtactatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10419 - DNA, 153 bp, Glycine max
  Peptide Sequence Number=SeqID_102104
atgggagaaagtaaaaaggaaggaaagaaagctcctgatcaaggatcgaaagaaaacagaagaaatgtgcagaaaggaaataatttgcaaagtcaagtcatgacatatctatggttcggaattaggatgaaacacttacctgtgcgagattga

SEQ ID NO: 10420 - DNA, 294 bp, Glycine max
  Peptide Sequence Number=SeqID_102105
atggaggccatgatgagcatgaagaagataatggaggtgaatgcggctgcaatcaccgctaccagtgtcgtcgctaagagcaagcatgccttcctgccatatggcttgccccctaactttgcaccacctagtgtaatgcgccctcccgatgagaatgtcaataactccactcttgtactcatcaagaaccaacaacctctatccaatcatgcatatgtccctcaactcatgggggagacatgtgaaataccccaccacaatctagccgacttcgagcctcgcctcggatatgcc

SEQ ID NO: 10421 - DNA, 302 bp, Glycine max
  Peptide Sequence Number=SeqID_102106
gtattattgggcaccaaatccctaaaataggtggtatgatgaatgttttgagtggtgcaaccctcttttgtgaaatcactcgtgcacccaacaacttcatgatttgtgtacatagggactcattaggtagtgatcaagggcttcccatggaccctaagagaataaaggtcattcctgagtggcctactccaccaagtgttgaggaaagaattaatgagtttcaagaacctcaggatttgagttcaaatccttttcaagggggagggaatgatgcaatcctaccccgcaagggtattggatag

SEQ ID NO: 10422 - DNA, 420 bp, Glycine max
  Peptide Sequence Number=SeqID_102107
atggaactcagcctcaggtgggaggcgttaaatggaaacttctccaacatgctcttgggcatcatgttcaggattaagccgttgtcgatgagtaccttggccatgacatgttccatgcatttgaccgacacatgtaaagccctattctgtcctctcccctcagtggggatttcctctttgtcgcaacctacccttttgagggcgagcgaggcgaggctcacgggtgcgtcttccaaaggaggaaaatgcgcggagtcaccaccaacgtttatttgtggaaaatgtcggaaaaaccgaaggacaccagtcatgaagaatattccagattcgggagttgtatttacatttgaggaaggtcgacaaaagtggggctcttgctcctacgtaccccccatcgaagaggaaatcagacctacgtag

SEQ ID NO: 10423 - DNA, 495 bp, Glycine max
  Peptide Sequence Number=SeqID_102108
gacgggcagctcaccaagatgtcttcctcgcccgatacgataaccaaatgcccctctactacgaatttcaatttttggtggagtgtagagggaacgactcccaccgagtggatccacgggcgccccaaaaggcagctgtaagcagggttaatgtccattatttgaaaggtaacctgacaggtatgggggcctatctgtacagggaggtcgatctctcccctaacctctcggcagggatttcttcttcggtgactgcgggtcacaccgctcagccccgtgatattggttaccatggccgacaacgagttgatgtcgatggcttcttctttcctttcactcggaggtgtatacctccacgggactgcgtgattgttttagtatgggatcaagcttatcgataccgtcgacctcgagggggggcccggtaccagcttttgttccctttagtgagggttaatttcgagcttggcgtaatcatggtcatagctgtttcct

SEQ ID NO: 10424 - DNA, 117 bp, Glycine max
  Peptide Sequence Number=SeqID_102109
gaatccattgatgaagaagatcctaggcctacaagctccaatggagcttgcatcataatcccttttcagaatgaagaagaagagaagaagaaatctctcttgaaagagatagattga

SEQ ID NO: 10425 - DNA, 476 bp, Glycine max
  Peptide Sequence Number=SeqID_102110
caagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggttgcttatcctcattgtgcaacttgttttgggcgttgctatccgggtggagcaactcttgttatggatgcaaagaatgtatatgatggaatcagccgcctattagagacctcctcttcaagagaactcccgaaaccagtgaacaatgaagaatccaagagcgtagctgagaatggcgaactgccaaaaatggaaaatggagaaacacctgatgccaaagaatcatcaagcttatcgataccgtcgacctcgagggggggcccggtaccagcttttgttccctttagtgagggttaa

SEQ ID NO: 10426 - DNA, 172 bp, Glycine max
  Peptide Sequence Number=SeqID_102111
atgaaacaatacacctttcacctgccatggggtgagtgcaccatcacactcgaagatgtttcactgcatctaggcattaaagtcgatggtcgtgttgtggctggacctagcttcttacattgggatgagttatgcaatgagttattaggggaagtccctcccgaaaatgcaa

SEQ ID NO: 10427 - DNA, 547 bp, Glycine max
  Peptide Sequence Number=SeqID_102112
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatatgtacttccaaggtatatttgctacctatatcatatgtacttccaaggaagtgcatgtgatgtagaatgtcttgtgcaagtgaacgttcgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10428 - DNA, 351 bp, Glycine max
  Peptide Sequence Number=SeqID_102113
atggctgtcatccaggccaaccaagtcctcgaggaccagagccagattgagtccgtcacctttggcattgagatggctttggacaaaattagatttgagagtttaatggacaagagcaagctcgatgctcagccaaagttgttcattcatattattcctgacaagaataacaatatgctgaccattgttaacagtggtattggcatgaccaaagctggtaggtttggggaagcaatgttttccaagattattttgatgatgccaaagactcaagtcaacaatcaagagtcaagcaagtttcaagaatcaaagagtcgttcaatcaaagcaagtttcaagaatcaagattaa

SEQ ID NO: 10429 - DNA, 291 bp, Glycine max
  Peptide Sequence Number=SeqID_102114
atggaagggggggagggagctggatatgctaggagaataacgtttgaaaagattaggtttgttcgagccaatagccccattgtcattgaccaattttatttccctcttagatcggactgccaaaaccaggatacaaaaactcaaatacttatggataagatttatgtgtccagtattttcgggcaggatgtcctggacattgtatccgacatcgtggatcctgcagcttcaattcttcatttgacattttatcttgccttgtgcactgtgcagcccgatctgattccttga

SEQ ID NO: 10430 - DNA, 1681 bp, Glycine max
  Peptide Sequence Number=SeqID_102115
atgtgtaatgatgagactggagtgtacaagaaccttgtacaggaaattgcgcaaagggtaggagctccattgcctcattacataacgtacaggtcaggcttaggacatttacctatttttatcaggatagtagaactgactggaatcacgtttactggtgaacctgccaagaataagaaacaagctgagaaaaatgcagctatggcagcttggtccgctttaaaacgatcatgcagtgggagcaggaggggcgggggagagggggatctgacaacggaaatgggtttcctcgggcaggtgttaaccgaagagaagtttcattggcttctctctaatgaaatggttatttcaattttttgttggcctactctttacgcaacactagattttggtatggtttcaagtagccagcagcttgtgtctctggtgaagtggataaatgcggtgcttcctagttttaatctgcctttagatacttcagagaaggaattgagggcatggttgagggatggatttttgaagcaaggattgcttgtagatttttctgatgctaaacttaatgaagtattgaaatcaaacaatttggatagtgtctcaactcaattgctttttaatataggaaataggatcctaagtgatatctttgaaaggaaaaatggagatgtacctcaggaacaactatcccaaaagctgaagcttttagatggaggcaaaactcttgaggaacttgaagctatacgtaaagatgtcactattgcaaaggtgttatcaaggaagttagaaggggtactcaatacattgatgagaggtaaggggcttttattaggaggaaggagcatgcttgatggtgttgttgtggaaaacgagggggtggaggaggctaaaagggtgttgctgaaaaatgatcttggattatgcttgttttgtggcaaagatgtggagtcagaggaacatttattgctaacttgctgtgtaacagagaggatctggaagcactggtgtagctgtattggttctcatgtggttatgcctaatgatctgagaacacactactggcagcacccctcgatggtgagagggaaattgggaggtatggcttggacgatgtcttgggtatggctgtatcctaaagtggatgggtttaattacttgtttgctgaatgggtgatctcaccagtgactttctccaagagaagcaaagggtttttcaagaaggctctggaattgtcagccctttgtgatgcacacatagctctcattgttttttctacaactagcaagctctttgagtatgccagttcaagaacacatgaagaacatgtttcagagttagaattgcaagctactgaatctgaagctgaatatgaaaaaagaatagagggacttaagcttcatcttgtagatgcaagaatgcaagtgaaggaactagaggcattttccgaatccagatttttgaaatggaagaataaagaggatacctatcaaactattgtaaatttccaagaactgagagctgccatgaagtctgtcaaagatgatgtgataaaaacaaaaagaaactacttagaggaattcaagtactttggaatcaagttgaaaggtctagctaaggctgttgaaaattatcatgtagttatagctgaaaataggaaattgtataatgaagttcaagatttgaaag

SEQ ID NO: 10431 - DNA, 309 bp, Glycine max
  Peptide Sequence Number=SeqID_102116
atgcccttgggaggtaggattgcatcacttccacaatttcaatcaatcatgctcagaaatagcctaagcatctccatgagacactctcacttaggaaaactaggcagcaaatgtcgatgtcatcctatcatgcataggcaacttccctcccatggtgatcaacatgagtctcaaggaagttcaaaaccgagtgacatgcctccaagtacaagtattttccctcataagaaactacaagtacttactgagaaagtaatactatttccatgcaatatgaagtatgaaacatgggcaccatcaatgcactga

SEQ ID NO: 10432 - DNA, 501 bp, Glycine max
  Peptide Sequence Number=SeqID_102117
atgaagcacttcactgacaccctcatcagtgccaacatacaagtagttgttcaagttgctttcgaccactactcccagccagctgcaactccaatactaatactaccatttcgaccccaccaccaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10433 - DNA, 314 bp, Glycine max
  Peptide Sequence Number=SeqID_102118
gtatgccacctaccaggcaccctctagacccagataagtctaacagggccctggggtttccagtgttgatcacgggtctctgccagtcattcggggttcccgtcacaccaaacgcaccgccaccacctcatcaggctgatccagctgggtcattttggcatggaagcagggctaaggttgcatggcccagagattggcctgaggcccaggaaggggaggcgcccgcagaggctcccagcgatgcggaggaggcccacatggttgaggagatgacagatttactcggtttcttgggagggagtggagccacatga

SEQ ID NO: 10434 - DNA, 156 bp, Glycine max
  Peptide Sequence Number=SeqID_102119
atgaggtctggctgtcccagttcaaccatccgccaagtgaaaagaaaggcttgctctagcttagccacaagcgcgcgagtcgagtcgttgcctaatgccggaggtgaagtagtatccggagagtgtggctcactcactagtttcggtatgctatag

SEQ ID NO: 10435 - DNA, 294 bp, Glycine max
  Peptide Sequence Number=SeqID_102120
atgacgagttcgggaagagagagcatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10436 - DNA, 447 bp, Glycine max
  Peptide Sequence Number=SeqID_102121
atgagagacagactgcccactaaattgaacttgactcgaagaaatatcgacatcaatgatacactctgcccattctgtacagaaaaggaggaggatgcagggcatttgtttttcagctgtcacagaattaggcagatatggtgggaatccttgtcttggatcaacatggtgggatctttttcgcaacacccaaggcagaatttcatgcagcactcattctgcaatgcacatcttggtatcaagtcacaaagatggttaatttggtgggtggcactaacttggagtatatggaaccatagaaacagaatcgtattttcaaatgatagccccaacaccagtaagatactggatgatgccattttcttttgctgggttaaggaacctagaaaaaggattcgacaatcctttccatcaatggtcaagtcatatcagagaagggttttgtaa

SEQ ID NO: 10437 - DNA, 421 bp, Glycine max
  Peptide Sequence Number=SeqID_102122
atactcaatgctatggaagccactactagttgctcgccccatactactactagcaatcgaacagttggtgttggcccagcctatctactgcccgagccgtccactaccagactcttggcctccggtctactactatcgtatgacacacctagccctccgcttctactatacgactatgaaacaacatgactcgtggttgggactgccagcatcatttccactactgcaactactagctgaacaacttggtctcagaacatccggggttgtcctcgctactactgtcttccgatctactactcccctcggactggtggtactactagagggactattgggttgggggagccagctcgagcaaccgctttggtggaactggggctatggtctcaaggaccttctgcaactccaactactatga

SEQ ID NO: 10438 - DNA, 510 bp, Glycine max
  Peptide Sequence Number=SeqID_102123
atgtacagtcccaagccaacgggacgcccatgtgggggactgggtcagcgatccagggcgctcgcagcgctggcgctcgctcctagtatccgggctgccaaggccgtccccaccgcgtggccggcctggcgggtgtcccagagctggttgggggactttcgtcgagcgattggacctgacatctgccgatggatattatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtggtgggtggttacgcgcagcgtga

SEQ ID NO: 10439 - DNA, 616 bp, Glycine max
  Peptide Sequence Number=SeqID_102124
atgtctgcaggagaagtcttgactccacaggagtatatcggtcaccacctgacgcagcttcaggtcgggactgggttttggtcgattaacctcgactcgatgtttttctccgtcgtcctcggggcgctcttcctggtgatcttccgcaaagtggccaaaaacgccaccagcggtgtgccgggtaaactgcaaactgccgtggagctggtggtcggtttcgtcgacagcagcgtgcgcgacatgtaccatggcaagagcaaggtcatcgcgccgctggcgcttaccgtgttcgtctgggtattcctgatgaacctgatggacctgctgccaatcgacctgattccttatatcggcgaacacattttcggcctgcctgcactgcgcgtggttccgtctgctgacgtgaacatcaccctgtcaatggcgcttggcgtgttcatcctgattattttctacagcatcaaaatgaaaggcgttggtgggttcgttaaagaactgaccatgcagccgttcaatcactgggcgttcattcctgtcaacttaatccttgaaggggtaagcctgctgtccaaaccggtttctctcggtctgcgactgttcggcaacatgtatgccg

SEQ ID NO: 10440 - DNA, 435 bp, Glycine max
  Peptide Sequence Number=SeqID_102125
atgaccatgattacgccaagctcgaaattaaccctcactaaagggaacaaaagctggtaccgggccccccctcgagatactgattttcagtctctaattgcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggggggtacgcgcagcgggaccgctacacttgccagcgctgat

SEQ ID NO: 10441 - DNA, 427 bp, Glycine max
  Peptide Sequence Number=SeqID_102126
agggtcgcacgtcctcgccttcagagggctacacgcccttgccttcagagggctacacgtcctcgccttcagagggctacacgtcctcgcctttagagggcggcacgtcctcgcctttggaggactgcatgccctcgcctttagaggggcgtacgccctcgccttcaaaaggctacatgccttcgctttcagagggctacaccccctcgccttcagagggctacacgtccttgccttcagaggactgcatgccctcgccttcagagggctgcacgccctcgccttcaaaaggccacacgccctcacctttagaggggcgcacaccctcgtcttgagagggctacatgtgatgagaattctgaaactggccaaatacaggctaaaggcccaagtggagaaggatgaaggcccaagtggagaaggataa

SEQ ID NO: 10442 - DNA, 237 bp, Glycine max
  Peptide Sequence Number=SeqID_102127
atgtcgaggtcaccctgtcgtgcacagacaatttccctcccttcccccatggtgatcaacttgagtctcaagggagttccaaaccaagtgacatgccctcaagtacaaggatatccatcatggtcactgcacccccaatgtacatacacaacatacatcatcacaatgacattttcaacatcaacaacatctcatctcaatgtcattatcaacaacaacatcatctcatctcaatga

SEQ ID NO: 10443 - DNA, 522 bp, Glycine max
  Peptide Sequence Number=SeqID_102128
atggtgaaagttggaacctcttacgtgccgatcaacgtctcattttcgcaaaagttggccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaacacgagatggaactattgagattgcaccaaaatgaagaaaatgacaagaaaaagaaaggaattgctcttaaagcatcatcctcaattcaagaagaaagtgatcaggataatgatccagatgatgatgatgatctaagtctcttt

SEQ ID NO: 10444 - DNA, 203 bp, Glycine max
  Peptide Sequence Number=SeqID_102129
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatactcacccaggcgagctgttgcttcctttagaagattcttggtgggcccagggctaa

SEQ ID NO: 10445 - DNA, 276 bp, Glycine max
  Peptide Sequence Number=SeqID_102130
atggttactttcatgcttcaacttgactcgatgaaccttttcgtaaaagcccgagcttggttcaaccccataacccagggaatggcaattttgatcgccaatacttcaacaacatttcatagggatgaaagactcgagaatacgcatgccaaatggggttatgatcccaacatggaaaatacaaggatcatgtatgagcaaacatgtagaacaaaaagtatgttgaacgcatatgatgatgcaatgactcatgccaaatgtgatgctggaatatga

SEQ ID NO: 10446 - DNA, 320 bp, Glycine max
  Peptide Sequence Number=SeqID_102131
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcccactacatattatgcctatcaaacagcaagatccaactgatgctattagcggcttgtgcagccactga

SEQ ID NO: 10447 - DNA, 393 bp, Glycine max
  Peptide Sequence Number=SeqID_102132
atgaggggagcgccaaccgaagaaagtctctcgcctttccttatgaggaatctaggcgcacaaagtctcaaggcgatacaaagagtccacaatgcatggagaagtccgttgaggaaagacaaagagcttaggggcatccgtaatggcgtcatcggaggttatcatggatggctaagaattcacacgcgggggttagattggatctccaagttgaaagttatcgatgaggaggacttcgaagctccggaggaagatgaagaagttcgagctctaaaattagagttagggaaggaaagactcgccaaggagaagttcaagtcagctgctacacacatccggaagggagtgcaccgagttacaagaggaaaacacggccactgcaagagcccttga

SEQ ID NO: 10448 - DNA, 438 bp, Glycine max
  Peptide Sequence Number=SeqID_102133
atgaagcacttcactgacaccctcatcagtgcccaacatagtaagccagtatacactccgctagcgccccaatacgcaaaccgcctctccccgcgcgttggccgattcattaatgcagctggcacgacaggtttcccgactggaaagcgggcagtgagcgcaacgcaattaatggaacaaaagctggtaccgggccccccctcgaggtcgacggtatcgataagcttgatacaaagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 10449 - DNA, 316 bp, Glycine max
  Peptide Sequence Number=SeqID_102134
atgatgcaatcctacaccccatgggcattggatagaagacttcaagaagattgggctagagatgcaagagaaggccctagggttctcatgagccttagggtagatttcgggcccatggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 10450 - DNA, 423 bp, Glycine max
  Peptide Sequence Number=SeqID_102135
atgaagcacttcactgacaccctcatcagtgccaacatactttcttcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10451 - DNA, 165 bp, Glycine max
  Peptide Sequence Number=SeqID_102136
atgagtgctctccctattccgacttccccagagcctccggtagcacagccgagacagcgatgggttctctgccccagcggggatggagcgaaagaagttttgagaattcaagagaagctgaggcatcctaacagaccggtagacttgaaccttgttcctacatga

SEQ ID NO: 10452 - DNA, 231 bp, Glycine max
  Peptide Sequence Number=SeqID_102137
atgcatctacgtgatcaaggaagccttcttaacaacaaagagaagaacaagatgaaagattgcaaaaatacaagtggtgaggatgtctccttcacctctaggatctcacaatcattcacaaactcatctcaagctctcaaaccggctccttcttcaagctctggtctctgcagatcttcacacagcaaaatctctcaaaactctctggaacttggacctttctctctctag

SEQ ID NO: 10453 - DNA, 399 bp, Glycine max
  Peptide Sequence Number=SeqID_102138
atgcccttgcggggtaggattgcatcatccatgactatctctgagtcatatttagccatgggccctttggacccatctctctttgaggaaagaccaaccgttgattgcttcgtagtggcgccgatgctcctcacttcagaaacggtgcccgccgaattcaatgtctacttgtggggccgcactacatcattctcccgcagcgtccttccatgccctcttactaaaagtagcagttgggctaagcgcgcatccaccgctatgcgcagcttcaacgtgcttagcacgaaggagaatctggcaaagcatcagcatcaaggccgtgcgctaagcgcaataggtgtcttcagcaaggctcagcgcaagactggcactaagcccaaacccacttactcgcgctaa

SEQ ID NO: 10454 - DNA, 681 bp, Glycine max
  Peptide Sequence Number=SeqID_102139
atgggtaaggactggggtcctggcgctgctggtgcagggtatactggtagaagctctcattcaactgcacctgacccctatggttggccacctgttggtcagccaaatgctacatgtagagttccatcctctgcatgtgagctgagatggactctagagatggtggctattccagaggtggtggtggtgcatctactactggctactattgttggtcctacaaggactgtacctctcaatgaaagacctgttaatgggatgccagatgagctttgtgggcataaccggcaccccatagaactggcaaacacctgtgatcaaagccggaaatcccagtgctctgttggacttttctgggtccattggaccaactggcattttggcaatgggaaatcagaattacgatcagatatgtgtcaaggtggttatgctagtgcgcatgatccgcaactgccatcccatcacgcttcgtataaagaccaacggatgccccaggaactggttgatggtatcttcatcataggggatccactggccccacacctaggagcgcttatccatgactccttcttcggcctaggatcttcttcatcaatggattcctttgcttcttggaagatgaatggtagcgaaatggagaaaggaagagagagaggagatgccacttcaaggagaagatga

SEQ ID NO: 10455 - DNA, 417 bp, Glycine max
  Peptide Sequence Number=SeqID_102140
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggggcttttgccgttacgcaccaccccgtcagtag

SEQ ID NO: 10456 - DNA, 658 bp, Glycine max
  Peptide Sequence Number=SeqID_102141
tggcctctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattccccattaccatcattggcacatcttgcttcatcgattctccttccagcttcggaactcacgatcctggaaaaccccctccacgtgatggtttctctcagtttctttctaagatctctgctcttgggaagttgaacaaattcacaagtccaaaggggttgatggaaaaagagaaaatagtagaacaccgtcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 10457 - DNA, 141 bp, Glycine max
  Peptide Sequence Number=SeqID_102142
atggattcactcggttggggtagtcccttcgacgctccatcaaagctgaagttcgtggtggaggggcacttggtcatcgtttcgaggcaagaggatattctaaagaagctttggagatggctttctagtcctttgaggtag

SEQ ID NO: 10458 - DNA, 420 bp, Glycine max
  Peptide Sequence Number=SeqID_102143
atgtcgggggtaattaactccgcgatgagcgggctgagcgccgcacaggccgcattaagcaccaccagtaacaacatcagtaattacaccgtggccggttattcgcgccagacgattttgctgtcgcaggccaacagtacgctgcagggcagcaactattatggcaacggcgtcaatgtgaccggcgtgcagcgtgaatacgatgagtttattaccgcccagctgcgcggtaacagcgccaactacagcgcggtcaattcacagtacaaccagatttcgaatattgatgatctgttgtcgacgtcgaccaccagcctgtctgactcgattcagagctttttcactaacgtgcagaacgtggtgagtaacgccgacgatccttctgcgcgtcagtctatgctgaactatgcgcagggactg

SEQ ID NO: 10459 - DNA, 291 bp, Glycine max
  Peptide Sequence Number=SeqID_102144
gatggtgtggacgacactatctgtgagaaatacagtataagcaaggaaaaatgggcccagttttgccagactcacagagacccttcttgggaggattcctttgaggagcagccgacacagggatccttcgtcccccatggacgtcaggatgttctcaccgctgctattggacgtctagagcaccctggacgtgtccgtgctgctagagccggtgtcaccatcaagcaatacttcagatctgctccatggacatcccgcaactcttcctccctgcctcctgaagaattgtaa

SEQ ID NO: 10460 - DNA, 264 bp, Glycine max
  Peptide Sequence Number=SeqID_102145
tggcttctgtttctatcagctgtccctcctgttcagctactgacggggtggtgcgtaacggcaaaagcaccgccggacatcagcgctggcaagtgtagcggtcccgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 10461 - DNA, 49 bp, Glycine max
  Peptide Sequence Number=SeqID_102146
aagccggtggttatgctggaaaaggctattctcgtcacgttcaacgcgg

SEQ ID NO: 10462 - DNA, 547 bp, Glycine max
  Peptide Sequence Number=SeqID_102147
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgaaggagaaggaatcgaagccttcattccatggtcctacgtgtgatgcatctttctccctcgacagacataattttgcaaatcccgatgacagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10463 - DNA, 381 bp, Glycine max
  Peptide Sequence Number=SeqID_102148
atgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcgacgggcccgatgacaagcagagaccaagtttggtcattctgcacccttgtatcatccagaggcggcgggcccgatggcaagcagagaccaagtttggtcattctgcacccttgtatcatccagaggcggcgggcccgatgatacgcggagataccttacggttatccaacccttttgtcatccagaggcggcgggcctga

SEQ ID NO: 10464 - DNA, 271 bp, Glycine max
  Peptide Sequence Number=SeqID_102149
atgtgagggtcgattctttgaggaacctaacaacgagggtttgacaatcagtttcgatcgtgatataagccaaacggtaaacgaggaagaggaagaggacgtcctgtcgccagagttggagaggttggtcgctcaggaagaacgtgaaatgaagcctcaccaagaagaaaccgaattggtaaacttggggaccacggaggaaaagaaagaagtaaaaggtaggaatcggtatgaccgcgcctatccgccaaggcttgataacccttcttga

SEQ ID NO: 10465 - DNA, 1968 bp, Glycine max
  Peptide Sequence Number=SeqID_102150
atggatggcacctgcggcgaacacgtccgaatagcagcccagcatgatcgaggtcatcgcgccgcccgccgaaatgccggtgacgtacacgcgatgcggatcaacgctgtaagccgccttcaccttttccacgatgccggccaggagcgagggctcgccactgtcgcgtgcctggttgatcggcagctgccagttccagcagcgggccggattggaggtgacgttctgccgcgggtagaccacgatgaagccttcggtgtcggccacatcgttgaagcccgaggcctcgcccatcaggggcagcggttgtgtgtcgtcgtagccggcgggcacccacacctggtattcgcgggcgccgaacagattgccgtacaggccaatgtcccaatgcccggccgggcctgcggcaacggcgctgcccgccatcgccagccaactgcacagtatcagcagtacaaccttgatcgaatcgattccggatttcatggccagatcctcatgcgtgagtcgtggatgaaggggtaccgggatgcgcttccggctgggggcgcgcccagtatccgcatccggcggccgctgccgactggacctaggtccagtcgccgctgcccgatgacaccgctagccttggctgcaggggaagcaccccaggccacgccgacggtgagcaggactgcatcacccaccaacctgggcagcatcaaggtcaccgcacgcaagcgcgaggaaaccctgcaggaggtgccggttgccgtcactgcgtttacctccgaggcgctggacaagatgaatgtccaggacatcagcgacctggatgcgcaggtgcccaacctgaccatctacgctgcccgcggcgccagcagcacggtcaccgcctacatccgtggcatcggccagtccgatcccacctggggcgccgatccgggcgtgggcatctacctggacgacgtctatatcgcgcgtccgcagggtgcgctgctggatgtgttcgatgtctcgcgcatcgaggtgctgcgcggcccgcagggcacgctgtatggcaagaacaccatcggcggcgcgatcaagtacatctcgcgcggcctgcccacccagaccgagggcttcgcccagatcaccgtgggcaactacagccagctggatgcgaaggcggccatcggtggcccgatcggcggtgccgacagcggcctgcgcgcccgtgtggcggtggccagcatgaaccacgacgggtttggcgagaacaccttcaacggccagccggtcagcgacaagcagatcaacgcggcacgcctgaacctgggcgcgtatgcgggcgatgacttcgacgtgcagttcgcactggactggatcgacgatcagtccggcatgcgcggctcgaagatgctggcgcccaatccgttcctgcgcgcctacccgccgatggacagccgctatgacatccgctcgggcatgcgcaacctcaacaacgtggagagcaagggcgcctcggccacggtgaactggcggccgaacgaagacatcgcactgaagtacgtgatcgccaagcgtgaatcggacagcgaggccaacatcgacttcgataccgctccggtcaagctcgccgacgtgggtggcacctaccacgacgaccaggtcagcaacgaagtgcaggtgaactacgatgccggcggccggatgcgcggcgtggtcggcctgtaccagttcagcggcgaagctggcgggcagatccagaacaactacttcagtgcgcagttcgccgacaaccagggcaaggtgctgaccgacagcatcgcgctgtacgcggactggaccttcgacctgaccagcagactgaagctcgatgtcggcgcccgctacaccgacgaggacaagcgcgcgatcgtgctgaaccgcctctacgccgacccgggcttcagccggccggtggcggtgaccgccgatttcgccaagaagaccaacttcaagaac

SEQ ID NO: 10466 - DNA, 288 bp, Glycine max
  Peptide Sequence Number=SeqID_102151
gcaaaaggcgatgtgaagcagcctgccgcgcaggtctggtccagcgatgagaagctgcagatgacggtttacaccaccgcgcctgccctgcaattctactctggcaacttccttggcggcacgacggcgcgcgaacacgttgagtacagcgactggcaaggactggcgctggagagcgagttcctgccggacagcccgaatcatccggaatggccgcagccagactgtgtgctacgcccgggtgaagagtacgtgagcgtgacggaataccattttattccgcattga

SEQ ID NO: 10467 - DNA, 426 bp, Glycine max
  Peptide Sequence Number=SeqID_102152
atggccgtggagctcaataacacttggaccattgtcccattgcctcagaggaagaaacctatcagtttcaagtgtattttcaagatgaaactgaattcggatgggatagtggcaaaacataaagcttgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10468 - DNA, 135 bp, Glycine max
  Peptide Sequence Number=SeqID_102153
atggcggccacatctcactttgagtgcgatgttccaataattgtgaccactgcaattttgacagagtttccaaaacgtagtgttccaatagttgtgatcactgtacttggtctacttggtctcattttgattaag

SEQ ID NO: 10469 - DNA, 489 bp, Glycine max
  Peptide Sequence Number=SeqID_102154
atgggagagttgtgcgtgtgtgacctttgcactgcgctagaacagtcacagcccaagatctcccgccatctggcaatgcttcgggaaagtggcctattgctggatcgcaagcaggggaaatgggttcattaccgcttatctccgcatattccttcctgggctgctcaggtgattgagcaggcctggttaagccaacaggacgacgtacaagccatcgcccgaaagctggcatcagccaactgcactggcagaggtaaggctatgaaaacgttaacggtgtttgatccggcgatgtgctgcagtaccggcgtttgtggttcagatgtcgatcaggttctggtcgatttttctgctgatgtgcaatggctgaaaggacgtggcgtacaggttgaatgttacaaccttgcgcagcagcccatgagctttgttcagaacgcgaaagcgaaagcattcctcgaagcatctggagcagaagggcttccgctaccc

SEQ ID NO: 10470 - DNA, 344 bp, Glycine max
  Peptide Sequence Number=SeqID_102155
ctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgggtttaatgatgccaaacttgaatgcactcaatgtcgcattcaagtttggcatcattaaagccaatatggggagattgttagagataaaggaagcaacaacttga

SEQ ID NO: 10471 - DNA, 332 bp, Glycine max
  Peptide Sequence Number=SeqID_102156
atggttaggaccagaggattaggtcgtgccttaggtcacgttactggcagaggtgtgggcagaggagatcgtgatgattccgatgatgctccgcagcatcgacggcctaccgcatccgcacggaggcagcgagtacctatgactgtggcacacgatgagccggtgctccctgcaccagatgtagaggatgacgtatttctggataagccaatggcaccagctgatgtagaggacactggggtagacattcttgtagacacaggcgcacaggctactgaggatgagcatgagggatttccgggtggtccgagcgacccatccgtgctgaccca

SEQ ID NO: 10472 - DNA, 103 bp, Glycine max
  Peptide Sequence Number=SeqID_102157
ggtcatacaatgctcaatggaatgccccgaaactcctctatgataagcacatgttgcattcaaatcaagcttatcgataccgtcgacctcgagggggggcccg

SEQ ID NO: 10473 - DNA, 490 bp, Glycine max
  Peptide Sequence Number=SeqID_102158
atgaagcacttcactgacaccctcatcagtgccaacatagtaagccagtattacactccgctagcgcccaatacgcaacccgcctctccccgcgcgttggccgattcattaatgcagctggcacgacaggtttcccgactggaaagcgggcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtgggggttacgcgcagcgggaccgctacacttgccagcgctgatagccggcggtgcttttgcc

SEQ ID NO: 10474 - DNA, 1004 bp, Glycine max
  Peptide Sequence Number=SeqID_102159
atggggatagatcagggcgatcggcatggaggcggcgcggtaagcgggcaggacttccaccagttcaccggcgtcgagcaggtgttgcacgtcgtagcgcgggatttgcatcagccccagcccggcgcggcagcaggcgatatagctctcggcgttgttgaccaccacccggctgggcagttcgagccgctgggtatggccgtcgtcggtcaggtattcccagggggattcgcggccggttttgggcgaggcgtaaccgatgctcctgtgcccctcggcaagatcggcgggctgaagcggatggccgaattcgctcaggtaggcggggctggcgcagttgatcagcgcgatatggccgagcgggcgcatcaccaggctgctgtcgtgcagatcgccgacgcgcaccgcgcagtcgaccccttcctgcaccagatcgatggcgcgatcggcggagccgagcaccagctgcaggtggggatggcgccgcagcaggctgggcagcgccggcgcgatcagccggcgggcgatgcggctcggcacgtcgacgctgagccgcccggaggcctggcgctggctggcctgaaacgactgatcgatatcctccacctcggccagcagcgggcgcagccgctcgagcagctgttcgccgtcggcggtcagccgcacctgccgcgtggtgcggtgcagcaggcgcacgcccagctgcgtctccagctgttgcacggcggcggacaccgaggcgcgcggcacctccagcacatgggctgcgcggataaagctgcccatctccgccacttgcacgaatacgcggtattgattgaatctgtccatcgatgcgcccgttattgtccttattattgccgcttaaagcattctgcggcgttatccggcaaaccctccttgctccaggaaggcttgctcctgcgtggtagtatcgcgcaacagcagctgattgcgatgtgggaaacgaccgaaacggcggatgatatcgcgtgtccctcggc

SEQ ID NO: 10475 - DNA, 171 bp, Glycine max
  Peptide Sequence Number=SeqID_102160
atggcgcctcccctcacctcttctcctttatcttccgctgatctccatggcgagaaatcaccattgaaggacctcattgaagctcaaagatccagcctctatagaagcttcacaagcaagcttccatcaagtggtaatcagagcacaagagcttcaatttccaccgattaa

SEQ ID NO: 10476 - DNA, 285 bp, Glycine max
  Peptide Sequence Number=SeqID_102161
atgattaaaaacgtaagtttggaaagagagggagaagggttgagtgcggttgggaaaagaagggaagaaggagaggagttggggaagggaagaagaggaagaggaaatggaagtggaagagagaaaagggagtggggtgaggtgcttaaggagggacagggaagagggaagatgatagaggactacccaaggaggaagagtttggcttgggtgggctcaacatggttggaccaatcacttgagcaaggagtaagagatttcaagaagagcttggcaagagactaa

SEQ ID NO: 10477 - DNA, 1039 bp, Glycine max
  Peptide Sequence Number=SeqID_102162
ggggaataaccaagctgctatgatatcacctaatgtggtgtcctggactgctatgatatcaggcagttgtgaaaatgagaactacatggatgccctacagtttttcatccaaatgcaagaagaaaatgagaagagatacactgctcttctatctggctgcaagaattcaggtttagttatggatgggtggaagtacttcgacaacatcaagatagattacaatattaatccaacaattgagcactactcttgcatggtagatcttcttggaaaagctgggtttcttgatgaagctttggatttcattcgcgccatgccacaaaaggtagatactagtatttggggtgttgttcttgcagcctgcaaacttcacaaagacattaagatagcggagattgccgctaggaatctcttaaggttggagccatataattctgctaactatgtgttgatgatgaacatatattccacttttgacagatggggggacgtggagcgccttaaagagtcaatgactggcttggggagccctttggacacaccctctaaaccaaactatgaagtcctgaatctggtgagcaaatatggagctttgttggaaaacatccatccatgcttcttgaagaagcataaagataaagggggcacagctacaagaacaaaggatgaacaagagagcaacaataataacaatagtgagggcaatgtgtccccaattatggttgggaactcatcaaacagtgtgaaggaagacaatatggaagacatagagaggcatcacattgagatggatgagggagagttcagtgatggactcccttataagcctagtttgatggatcacagtgctaataaccaagaatctgaggacttctttgctggatacttgatgaaaactgcacaagttacagttgatgctgaagagactaataggaatggtgtcagcagctctgctaatataggcacagatggagacactggtggtggaaaagaagaaaggcttcttcaagtggaagaagtaaatatttggcaagagtga

SEQ ID NO: 10478 - DNA, 318 bp, Glycine max
  Peptide Sequence Number=SeqID_102163
atggtagcgacactggcagtgaaatgtaccttaggtcactatggcactggcagtgaaacatacctcaggcgagatgtcacggtctttagcgcaatggagaacaacaagcttcgatggagaacaaccttaggatgcagagggtgcggtgtggaggcatttgggcgatggtgtttgggtgcgacgacggtggtgggtggagctctagaggtgtttgggtgcatttggtgtggagtgatagtgttgggtggagtcgtcaagatgcagtgtgactgccatggaggtttgggagagagaaggctagggttttgcttaagataa

SEQ ID NO: 10479 - DNA, 255 bp, Glycine max
  Peptide Sequence Number=SeqID_102164
tgtctcaccaccatcaccagattgacgactgaggccgcaaaggaaatcgctgagaagattgccacacaaggatccttcgtcccccatggacgtcaggatgttctcgccgctgctattggacgtccagagcaccctggacgtgtccgtgctgctggagccggtgtcaccatcaagaaatactttggatcggctccacggacatcccgcaactcttcctccctacctcctgaagaattgcagcagttgacccaataa

SEQ ID NO: 10480 - DNA, 579 bp, Glycine max
  Peptide Sequence Number=SeqID_102165
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgcagggagatacttaa

SEQ ID NO: 10481 - DNA, 447 bp, Glycine max
  Peptide Sequence Number=SeqID_102166
atgaagcacttcactgacaccctcatcagtgccaacatactcttaccacatcaaaaatttctccaaggtgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10482 - DNA, 489 bp, Glycine max
  Peptide Sequence Number=SeqID_102167
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccccgtcagtagctgaacaggaggggacagctgaaagaaacagaagccactggagcaccctcaaaaacaccatcatacactaa

SEQ ID NO: 10483 - DNA, 98 bp, Glycine max
  Peptide Sequence Number=SeqID_102168
atggtgtttttccctaaaaaaccaaacgtgaggagtgggtgtccgccatcgccttggccttggctaacaatcggggaagttcttgactcccgttcaag

SEQ ID NO: 10484 - DNA, 375 bp, Glycine max
  Peptide Sequence Number=SeqID_102169
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtggaccgctacacttgccagcgctga

SEQ ID NO: 10485 - DNA, 375 bp, Glycine max
  Peptide Sequence Number=SeqID_102170
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 10486 - DNA, 290 bp, Glycine max
  Peptide Sequence Number=SeqID_102171
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagaattcgatacttcacttcatcatggaaatattccatgggaggaagcagcaactttctag

SEQ ID NO: 10487 - DNA, 513 bp, Glycine max
  Peptide Sequence Number=SeqID_102172
atgaagcacttcactgacaccctcatcagtgccaacataggaacaaaagctggtaccgggccccccctcgaggtcgacggtatcgataagcttgatacatatggtatctcccatggagtggcacctgttcccacaaaggtcgaggcaatacaggcgtggccaattccgaattctacacaaggattaaggggcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgggcggggtgtggtggttacgcgcagcggtgacccgctacacttgccagcgctga

SEQ ID NO: 10488 - DNA, 248 bp, Glycine max
  Peptide Sequence Number=SeqID_102173
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccg

SEQ ID NO: 10489 - DNA, 513 bp, Glycine max
  Peptide Sequence Number=SeqID_102174
atggccccacaagcggatatggaatttgacgggcacccgttccgaagtaaggaacaccaacaccggtttgaagcaatcaagagttggtctttcctcaaggagggacaggtccaattgagagaaggagagtatgttgagttccaagaagaaattgctaggaggcgatggactcaactcgtagggcccatggctaagtatgatctagaaatagccatggagttctattccaatgcatgtcccatagaggaaggagtcaaggacaagcgctcctgggtgagaggccaatgggtctccttcgatgaagatgacattaatcagttcttggggcatccgttggtcctggaagaggggcaacgttgtgagttcagcgagaggaggagtcaggccttgggatttcatgaggaggccataggccaactactgtgcgttccaggacatgacttggcacggagtgtaacggggagacgggtgcggatcatgcgcattagcatgaccaccctgacacagatctag

SEQ ID NO: 10490 - DNA, 168 bp, Glycine max
  Peptide Sequence Number=SeqID_102175
atggctggccatatgggtagagatgtcatagaggagcaggtatggaggaagggaccttggactgctgaagaggacaggttgcttgttgagtatgtcaggttgcatggtgaaggcagatggaactctgttgctaggcttgcaatcaatctctacgtgatacgtagttga

SEQ ID NO: 10491 - DNA, 255 bp, Glycine max
  Peptide Sequence Number=SeqID_102176
ggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttagaagcttctcaagctcaagcatttacttttctagttagagaccaacgtcttggggctaatgtaggatctgctcaaggacctacaggtttag

SEQ ID NO: 10492 - DNA, 216 bp, Glycine max
  Peptide Sequence Number=SeqID_102177
atggcctcttcaaattctttgtttcctgaaggaaattccatccataggccacctatcttcaatggtgagggttaccactattggaaaacccatatgcaaattttcattgaagccatagatttaaacattttggaagcaatagaaataggaccttacatacccactgtagtagatgtaagcactagcaccacaacacaaaaacctagagataagtga

SEQ ID NO: 10493 - DNA, 630 bp, Glycine max
  Peptide Sequence Number=SeqID_102178
atgaccaccctgacccagatatggatgacgttgctgctcagcaacatcctgcacaacgatcataattccgacctccctttgccgaagtgtatggcgccgaccaggcaccctttggacccagataagtctaacagggccctgggatttcccgcactgatcataggactctgccagtcgttcggggttcccgtcacacctagtaaggtgattcgaccgtcgatcacccaggccttcatagagaagtattgcacgcctagacaggcacagggcggcgcaccgcaggccccaaacgcatcgccgccacctcatcaggctgatccagctgggtcatttgacacggagcggtatttagagcatttggtttgccagcaggcggccaaccacagggggcaggtacagacccatgagtgtctctaccagctcagcctcagtctgcagagccagggtttcgctccttttgcgtgccctactccagatcagttcagggcagaggtcgcatggcccggagattggcctgaggcccaggcaagggaggcgcccgcagaggctcctggtgatggagaggaggcccgcatggatgaggagatgacagatttgctcgatttcttgagaggaggcggagccacgtga

SEQ ID NO: 10494 - DNA, 375 bp, Glycine max
  Peptide Sequence Number=SeqID_102179
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 10495 - DNA, 184 bp, Glycine max
  Peptide Sequence Number=SeqID_102180
atgtcaaccaaaatcttaggttacatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 10496 - DNA, 102 bp, Glycine max
  Peptide Sequence Number=SeqID_102181
atgggatcgagtcaggcgccttcgcctaaaaagaggttctatcaagtcaaggacctagccatggcagaggtctccacagaggctattgcctccctcgcctag

SEQ ID NO: 10497 - DNA, 174 bp, Glycine max
  Peptide Sequence Number=SeqID_102182
atgactagatttgtgtatggtaactccgaaggtcaacatgaacatgatcctccagtcaaatatgacgtagataaagaaacttgggagcaacttgctgcaagccgcaaaactcctaactggcagggaatcaggaagaagatgcaagagatccaaaaatacaatcactgccctcat

SEQ ID NO: 10498 - DNA, 52 bp, Glycine max
  Peptide Sequence Number=SeqID_102183
gcgaacagtgctaggaaatcaattcgcagggcaccagactcgttgatggagg

SEQ ID NO: 10499 - DNA, 643 bp, Glycine max
  Peptide Sequence Number=SeqID_102184
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgcgtaccgccctaccgatattggtggggcattttttattgtgagcgtgcttattgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10500 - DNA, 420 bp, Glycine max
  Peptide Sequence Number=SeqID_102185
atgaagcacttcactgacaccctcatcagtgccaacatagactcatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10501 - DNA, 138 bp, Glycine max
  Peptide Sequence Number=SeqID_102186
atggagacctcagctggcctatggcaagctgccacggcgcacaatctttacagcgaaacacccaagactgaaacaggggaaacacttaatgggaaaactgaaatagaacacacattaaacaaaataccaggacactaa

SEQ ID NO: 10502 - DNA, 334 bp, Glycine max
  Peptide Sequence Number=SeqID_102187
atggccatcgctgaagatattaatgacatgtcatttatcagtgcacaatcagctgaagtcacctcacatacaacagacaagggacatgatggctgggagaaggctgaaaatgaagtgacaagtttaaagaaacaagtccaggcactgactctcagaaattcaaaacttgaagatagagtcacctatctagacagtgcacttaaggagtttgttaggcagctaagacaaacaagtcgggactccaacggaccgcggtggtcacgaaccccgacggcggtcacgaaccccagcgacgacgatggtgtggaggagaccacagtgacaggtcttcgcg

SEQ ID NO: 10503 - DNA, 942 bp, Glycine max
  Peptide Sequence Number=SeqID_102188
atggtgggtttatacgtgatttgtggatgtggagaattgttttgcaccatcgcccgaccgccacctagtaccacgtgtgatggtggtacctggagatatgtcgcgggggtcaggagaccttggggacgtcaggcgaactcctggcagtcaaccgataaaagaacaaagaccacaaagcagggaggcttgtgtggtggctggccagcaatgagtcttgagcttgaaaacgagatcaggaagctaggagggcttctggtaatcgattaccaagggaggaataagccactggtaatcgattaccagtcatgtgtaatcgattacacagtgcattttgcaggttttcacgtcctgaagctatgtaattcgagtttggcctctgataatcgattaccaatgaggtgtaatcgattaccagagatgaaaagccttgagatacctcttttaattgcatgtagtggttatgagacgcattgtgttgctaccacaatcgcgatggcggcgcaactaatccatgatcgagtggagatggagtgcctagagggagcttgggagaccctcgaaggcaatgcgaggtgccgatttcggggcacgattcgattcactgctacttcattggtgcatccaaatgaacccgcgcgcacgcttcagcgcactatggagtggatactacccacgcctacaccgtaccgtctagtggagccagtccaagtgatcaaggtgacgtcatccaaggaagaccctgaggaggatcctgaggagctacctcctgagcttgttgcggatgctcttgactttctagagggtgatgaggacccactccctaaggtggattctcccgaggacgtcatgtcggcatctgaggcagactctacggaggatagtggccctggagatggcgatcagtggaggctcttcatcatagtagacagctcattggattag

SEQ ID NO: 10504 - DNA, 222 bp, Glycine max
  Peptide Sequence Number=SeqID_102189
atgggagacttggctgtcaacttccttggagaggtagaaggaaagatcattcagcaacagggagaagatggttgggaatggattgaacatccatcaggtatttattctactcattctgcatatcagatgttacgggaagggagaccagctgcaattaaggaggaagtctttgtggaattatggaaattgaagatccctagtgtaacattccaatttctgtaa

SEQ ID NO: 10505 - DNA, 954 bp, Glycine max
  Peptide Sequence Number=SeqID_102190
tatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataatctggagccggtgagcgtgggtctcgcggtatcattgcagcactggggccagatgttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctg

SEQ ID NO: 10506 - DNA, 402 bp, Glycine max
  Peptide Sequence Number=SeqID_102191
atgatggtggcccgggtgatgttggggaatggttacgagcccggaatgggtttaggcaagaacaacggcggcagaaccagcctgataagcaccagaggaaaccgtgggaagtttggattaggctataaacccacacaagcgaacataaggaaaagggtcatgggaaggaagagcagaagccaaggttcgcaattgggacgacaagtcgaagggggcccaccctaccacattagtaggagctttataagtgcgggtctaggacacgaaggccaagtcattgcgatatgcgaggatgactctccgagtgggtcggatttggtacgaccatgccctcctggtttccaactaggaaattggcgagtggaggagcgcctgggcatttatgcgacaagcataatgtaa

SEQ ID NO: 10507 - DNA, 495 bp, Glycine max
  Peptide Sequence Number=SeqID_102192
atgaagcacttcactgacaccctcatcagtgccaacatagcccagtggagaaattgcggttgcgccgctattgatcagcgacgtgacacggccctgcatatctggccggacaatcgattatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10508 - DNA, 483 bp, Glycine max
  Peptide Sequence Number=SeqID_102193
atgaccatgattacgccaagctcgaaattaaccctcactaaagggaacaaaagctggaaatcagcaatcacatctgaaaacaaagaagggccggaaacggtctgcacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10509 - DNA, 435 bp, Glycine max
  Peptide Sequence Number=SeqID_102194
atgcaccagccccagcgcttcgttgttcatcaggataatttttacatccaactgattttcggcggcggtggccatctcctgaatattcatcatcaggctgccgtcaccggagaaacaaataaccttacgttgcggattggccagcgccgcgccgatggccgccggcaggccgaagcccatggtgccgagaccgccggaagtcagccactggcgcggacggttgagcggataggcctgcgccgtccacatctgatgctgacccacatcggtggtgatgatcgcctcatcatcaacgcaggcggccacggcgttaatcaggccataatggggagagcggatcgctttcctgcgggatggcgcaggggaattctctttgtaaaccagccaccagctggcgccactcatcacgcggctgcgcttcaatctgcggaataa

SEQ ID NO: 10510 - DNA, 2754 bp, Glycine max
  Peptide Sequence Number=SeqID_102195
atggaaaggaaacagtatgttaattgggatacccaaagagcgaccgttgagcagctcattaagctgggattcagcgtcaccgttgagcagggtgccgggttgcgcgccagctttgatgatgacagttttatcgccgccggtgccagcatcagtaatccgcaggatgtctggcagtccgacatcgtgctgaaggtgaacgcgccagacgacagcgagatcgccctgatgcgcgcgggcagcacgctggtgagctttatctggccagcgcagaacccggcgctgctggagaaattagccgcacgcaacatcaccgcaatggcgatggattccgtaccgcgtatttcgcgcgcacagtcgctcgatgcgctcagctcgatggcgaacatcgccggttaccgtgccattgtcgaagcagcccatgagtttggccgcttcttcaccgggcaaatcaccgccgccggaaatctcggtgccatcgtgcgcgccttcgacacccgtccggaagtgaaagagcaggtgcagagcatgggcgccgagttccttgaactcgactttgaagaggaagcgggcagcggcgacggttacgccaaagtgatgtccgaagcctttatcaaggcggagatggcgctgttcgcagcgcaggcgcaggaagtggacattatcgtcaccaccgcgctgatcccgggcaaaccggcaccgaagctgatcaccgcagatatggtggccagcatgaagccgggcagcgtgattgttgatctcgcggcagccaccggcggtaactgcgatctgaccgtcgccgaccgcgtcacgctgagcgacaacggcgtcaaaatcatcggctacaccgatctgccgagccggctgccaacgcagtcctcgcagctgtacggcaccaacctggtgaacctgctgaagctgctgtgtaaagagaaaaacggcgagatcgtggttgattttgacgatgtcgtggtgcgcggcgtcacggtaattcgtgacggcgaagtgacctggcctgcgccaccgattcaggtctctgctgcgccacaggccgcaaaacctgccgcacagccgcaggtgaaagcggcagagaagcccgctgcgccgtggcgcaaatatctgctgctggcgctcgcggtagtgctgttcggctgcctggccaacgtcgcgccagcggaattcctgtcgcactttaccgtgttcgcgcttacctgcgtcgtcgggtattacgtggtgtggaacgtcagtcacgcgctgcatacgccgttaatgtccgtcaccaacgccatctccggcattattgtggtgggcgcggtgctgcagatgggccatggcggctgggtcaccttcctggcgtttatcgccgtcctgattgccagcattaatatcttcggtggtttcaccgtcacccagcgcatgctgaaaatcctggccgggctctcgaagcatgagacctcaaagcagggcaatatttttggtatcagcggcatggcgctggcgctgctcgccaccatttttggtccgcacagcggccacgtggcgtggattctgctggcgatggtgatcggcggtgcgattggcgtgcgtctggcgaagaaagtcgaaatgaccgaaatgccggagctggtggcgattttgcacagctttgtcggtctggcagcggtgctggttgggttcaacagctaccttgaccacgcgccagggctgtcggcggtgatggaaaatatccatctgaccgaagtgttcctcggcatctttatcggtgcggtgaccttcaccggttcagtggtggcatttggcaaactgcgcggcaagatctcctcaaaagcgctgatgctgccgcatcgccataaaatgaatctggcggcgctggtggtctcattcctgctgatgctgtggtttgtgcgtaccgacagtaccggtgcacaggtggttgcgctgctgctgatgacggtgattgcgctggtgttcggctggcatctggtggcgtcgattggcggtgcggatatgccggtggtggtctcgatgctcaactcctattcgggctgggcggcggcggcggcgggctttatgctgagcaacgacctgctgatcgtcaccggtgcgctggtgggctcttccggtgccatcctgtcgtacattatgtgtaaagcgatgaaccgttcctttatcagcgtgattgctggcgggttcggcactgacgtgagcggtgccgacgcgggcgaagaggcgggcgaacaccgtgaaatcaacgcggaagagacggcagaactgctgaaaaactcgacctcggtgatcatcacgccgggctacggtatggcggtcgcccaggcgcagtatccggtggcagagatcaccgagaagctgcgcgcgcgcggtattaaggtgcgtttcggtattcacccggttgccggtcgtttgccggggcacatgaacgtgctgctggcggaagccaaagtgccgtacgatgtggtgctggagatggatgagatcaacgatgatttcagcgataccgacaccgtgctggttatcggtgccaacgacaccgtcaacccggcggcccaggacgatccgcgcagcccgattgccggtatgccggtgctggaagtgtggaaagcgcaaaacgtcatcgtgttcaaacgctcgatgaacaccggctatgccggggtgcagaacccgctgttctttaaagagaacacccagatgctgtttggcgatgccaaagccagcgtcgaaggcattctgcgcgcgctgtag

SEQ ID NO: 10511 - DNA, 371 bp, Glycine max
  Peptide Sequence Number=SeqID_102196
atgcattatctttacataatacttggttcctcagatcttccacacaagaatctcaagtccagcaatgttctccttggaccagaaaatgaaccaatgcttgtagattacgggttcagccacatggttaacccttcaaccattgcacaaacactgttcgcttacaaggcatcagaggcagcacaacaaggccagtatctcaacaatggaaagggtggggctgatgtggtgcaatgggtggaaactgcaatctctgagggaagggaatcaaaagtgcttgatcctgagattgcaggctctaggaattggcttggtgggataaagcaactcctccacattggtgcttcttgcactaaaagcaaccctctgtggcg

SEQ ID NO: 10512 - DNA, 392 bp, Glycine max
  Peptide Sequence Number=SeqID_102197
ggcgatcggtgcgggcctcttcgctattacgccagctggcgaaagggggatgtgctgcaaggcgattaagttgggtaacgccagggttttcccagaattcgatcagttcgccgtaggcgcacatggtgtcgcttgccggaacgagttcaatcgccctgataaaggcaccttccgctgcgtcgtactgttccagtattgcgaggttggtgccaagctcatcatgcaacgacgctacgttagggtgccgcatcaacgccttgcggcagcgcgctatcgcagcgcgggccgctgccttctgttgcgcagtggcgggagccgtgtggatggccatttggaggttgaatggagtggaatcaagcttatcgataccgtcgacctcgagggggggcccg

SEQ ID NO: 10513 - DNA, 333 bp, Glycine max
  Peptide Sequence Number=SeqID_102198
atggtggcagctttcatggacgagattgatggggttcagattcacctttctagactggatcatctcacttggagggctgatcctagtgggtcctattctacaaagtcagcatacaacctactcatggaagatggcagttctgattatgaagacaatgcctccaggattatgtggaacctgaaaattcctccaagagcagctgccttctcttggagaatttttaaaaacagattgcctactaaggcaaacctaagatggaggcagaggaggaaactgttggtcatgtcatgttctcttgcacaagaactaggagtctttggtgggaggctttga

SEQ ID NO: 10514 - DNA, 303 bp, Glycine max
  Peptide Sequence Number=SeqID_102199
atgtcctctcgggggaagaaaaccatatcttttctccgggtgtctcccctccttgagcagaattgcaactgtggtctaggattcggcaagaggtttggaccgcgtaaaacaaactcgaaacggcatagcgggcctaccacggaagtacctagaagacaaggcgagggatatggcaaatcaagaagattgggtcccgttaatggatgtgttagcattgctaatctttggggtcgtcctctttccaaacgtggatggtttggtggacctagccgcaatcgacgctttccttgcataccaccatag

SEQ ID NO: 10515 - DNA, 425 bp, Glycine max
  Peptide Sequence Number=SeqID_102200
ggcgcgtcccccattcgccattcaggctgcgcaaactgttgggaagggcgatcggtgcgggcctcttcgctattacgccagctggcgaaagggggatggcgaattggagctccaccgcggtggcggccgctctagaactagtggatcccccgggctgcaggaattcgatcagaaagcaactactacctaccttcctgtcgtcctcgatccgctgtctaggtggaaggcaggagaagagaagagaagctacaactacacaactacctcaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 10516 - DNA, 245 bp, Glycine max
  Peptide Sequence Number=SeqID_102201
agttacacacactccagtcacacacttcttcatctctccatttctctaactctgaccatgcaattggcgttggtctcattgcattctctgtacaaatgacgaacaaggccaaaggaaaaggcaaggaggtcgccagaaaaggttatgccgacaagcgcaagggctctttcgacgatgacaagaccgatgacggccgaaagagaaacaagcgaggtgtcattcagttatttctgacgacgaattaa

SEQ ID NO: 10517 - DNA, 584 bp, Glycine max
  Peptide Sequence Number=SeqID_102202
atggacatcgatacgccgggaaaagacagttatctgctgcgcaaagcgggagccgatcaggtgatcgtcgccagcgaacagcgctgggcgttaatgtgtgaaacgccacaacagccgcttagtttagcgcagctggcaagccgtatggacgctgcatcgctggatctggtgctggtcgaggggtctaaacaggaacccgtgcccaggatggtgctatggcggcgcggcgttaagagggaaattgatgaattgctggacgactgggtgattgccgtagcgacggatgaagcgttagcgcttcaggtaccggtgctggatatcaatcagcctgagcaggttgcagaacgtaaagaagccccggactctcgtccggggcttctttacgggtttgatgcctggcagttccctactctcgcatggggaggccccacactaccatcggcgctacggcgtttcacttctgagttcggcatggggtcaggtgggaccaccgcgctgttgccgccaggcaaattctgttttcgtccgcgtctttcgcgctctgactgcgttgccccgctcgcgccgctcagtcacatacttct

SEQ ID NO: 10518 - DNA, 411 bp, Glycine max
  Peptide Sequence Number=SeqID_102203
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggtgcatggtgcaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 10519 - DNA, 309 bp, Glycine max
  Peptide Sequence Number=SeqID_102204
atggctactccacctgcctcgcctcctcctcctcctcctccagcattagcatcagcgtctctatcaaccttgaagcggacacgcaaagccacacggctacgatccttggccactagaccacctggggcagagagaccagtggtccatgtcgatcttgcgatcgggaaggccgacagtccccacaagaagaaattaagaacacatttggggattgtcactggtgataaggttgacgtgacatatgagacttggaaggaagtcgctgctgctcagaaggatttgatatgggaggatattcaggcattttag

SEQ ID NO: 10520 - DNA, 204 bp, Glycine max
  Peptide Sequence Number=SeqID_102205
atggtccacaccgccagcggtgcttttgcacagattaagaccaaggcatttaactctcttggcttcgtgcagcaatttatgaccagcatccctaagaacttccgcggtatgcgtagactctttggcatcgaattcctgcagcccgggggatccactagttctagagcggccgccaccgcggtggagctccaattcgccctatag

SEQ ID NO: 10521 - DNA, 183 bp, Glycine max
  Peptide Sequence Number=SeqID_102206
atgggtgatcaagccacaagcatgcatacagatagaatgcccagggcacataattccacaacacaacaaagttcctatttcgggaaaagagctctagaggcagcaagaggagcagcttttgcagagatacctaggttttgtaagcttattattgttagggtttcttctgtaatggctggctaa

SEQ ID NO: 10522 - DNA, 144 bp, Glycine max
  Peptide Sequence Number=SeqID_102207
atggcagttgaaccacgatcatgtactgctagaacagggctgatcatctcgctatatgatggagacccattgctactagatctactactatatcaacaaccacccactgccatcaactaccagcaagtagcagtagacgagtga

SEQ ID NO: 10523 - DNA, 849 bp, Glycine max
  Peptide Sequence Number=SeqID_102208
atggaggattcatgggtggacttgttttctaactgggaaatgggtggtgatgatttcttcaatattcaaagccatggccacatgagccctttcaatgaagaagagtactcctcgggagagagagacatgattgttcagcaacaagttttctctcccaatctctcttcttcctcccttcaaagcaacttggaattaccttactcatcatctccaacgggtaacgttttgtcttttgataacccccttgtaggatcacttcaccctcaaaatgactccgctaaaagcatggaacaaagccattgcgttgaaccaaaggcgtacccacgaacaaacgcacaagttcacatactggccgagagaaaaaggagagaggagctgactaggtgcatcatagcactttcagccaccattcctggcttaaagaagacagacaaggtctctgtactgcgtgaagctgtgaactatgtgaaacaacttcaagaacgtgtgaaagagctagaaaatcaaatgaggaaggaatgtgtgaattcaataatacttaccaagaaagcgctaatttgcaaaaatgatcgtgtggaagaactcctcgaggtgaaagtaactgtgttagataaggaagtgctcattggagtccattgtgagaaacaaagaaaatctttgctcaaaatattgtccttgcttaataatctccatctttctataaccagtaccagcgtattgccatttgggagttccactcttaagattaccattatctctcagatggatgacgaatataacatgacagttgatgatctagtaagaacactgcgtcaacgcatattgagtttgaagtcacacgatacgtaa

SEQ ID NO: 10524 - DNA, 2883 bp, Glycine max
  Peptide Sequence Number=SeqID_102209
atgcaaaccttcttcttgtaccttttccttttcttcttgttatgtgcacttcaccaactagcctcatcccaacccttcttcctcaatagaaggattctccatgaaccctttgttcctttaaccactcttccaccttctgaagcaccaaaaccacaaccttctccttcaagccataaacaaaaaccaaaacccaaatatccatcatccaccattcccacaacctctaccactaccacaacaataccaacaccaactacaactacaccacaatcaccatttttcccattatacccttcttccccaccacctccttctccaatcacctttgcctccttccctgccaatatttcctctctcattcttcctcactcccccaaacccaattcttcctccaacaaactcctccccgtcgctctctccgccgtcgccgccgcggtccttgctataatcatctctgccgtcgtctgttaccgccgtcgccggagccctcccctcgctgccgacggcaaacttatccgatccgacaccgacctccgcctgctcccgcgcaataccgaaaccgccgtggaaactcgcaagctccggcacacgtcttccaccagctccgagtttctttacctcggaactgtagttaactcgcacataattgaagatggcgccgacgtctccgacgccggcggcgaccggaaaatggaatcgccggagctccgaccgcttccgccgcttgcgcgacaagcttctttgccgctgccgacgtacgacgaggcggggttcaccaccgcggaggaggaggaggacgatgaggagttttactctccgagaggctcatcgttgggaggctccggcggaaccggatcggcttcccggcgaattttcgccaccggaggaagaagcgtgatctctagttcgtgcccttcctcttcttccgcctcgccggaaaggcctcattctatcgcgacggcgagttcgagttcccggagaacccagccaaagtcgccggaaaattacaaccaccaacacgtgcaatcttctccttcttctccttcgttgtgctcaacaccagataggtctccaagaatgtcgagtgtctccgacggactaatgttaccgggtttgtcatcagtgcctttgtcacccgccctattgtcatcaccggaaaccgaaagaggaacatttagtggattaagaacaggttcttttggtgcggctgcgacgcagaggaaacactggaatatttccgacatgtcactaacaccaccctttgatgaaattggaacggttccggttccggctccggctcctccacctttgccacagaggaagcactgggagattccgggctctgctccgccaccgccgccaccattgccatggcaaaggaagcagtggggagtgccatcgccggcaatgaggccgtcgacaccggtgtcaaggccgccagaattggtgcctccttcgaggtcttttgtgttgcaaaaccaaggaaccaatgttgagttgccggcgagtttgggggaaattgaagagattagtaaaccaaaattgaagcccctgcattgggacaaagtgagaacgacctctgatcgtgaaatggtgtgggatcagatgaagtccagctcgtttaaattgaatgagaaaatgattgaaacattgtttgtagtgaacacatcaaacccaaaacccaaggacgcaactacgaactcagtttttcccctgccaaatcaggaggaaagaatacttgatcctaaaaagtctcagaatatttcaatcttgctgaaagcacttaatgtcactatagaagaagtgtgtgaagcacttttagaaggaagtactgatacacttggaacagaattacttgaaagcttattaagaatggcaccaagcaaggaagaagaacgtaagttgaaggaacataaagatgactcaccaaccaagcttggtctagctgaattttttttgaaggcagtgcttgatgtacctttcgcatttaaaagaattgaagcaatgctttacatagccaattttgagtctgaagtggagtatcttaggacatcctttcaaactctagaggctgcctgtgaagagctgcgacattgtagaatgttcttgaagcttttggaggctgtacttaaaactgggaaccgcatgaatgtggggaccaaccgcggggatgcagaggcattcaaacttgatactcttctcaagctggccgatgtcaaaggcgcagatggcaaaaccactctactgcattttgttgtacaggaaattattcgaaccgaaggtgctcgtctctccagaactaatcaaactccaagctctactttgagtgaagatgccaagtgtaggaggcttggccttcaatttgtatcaagcctgagttccgagctagcaaatgtgaagaaggctgctgctatggattctgaagttctcaacagtgatgtcttaaaactttcgaaaggaattgcaagcatagcagaagttgtgcaattaaaccaaaccatggcatcagatgaaagcagtcagaaattcacagaatcaatgaacaaattcatcagaatggctgaggaggaaattccaaaaattcaagcccaagaaagtgttacttccacccttgtgaaggagattacagagtattttcatggaaatttgacaaaggaagaagctcatccatttagaatcttcttggttgtaagagacttcctagcagttcttgaccgggtctgcaaagaagttggaatgataaatgagagaactatggttagttcagctcataaattccctgtgccagttaaccctatgcttccacaatcccttcctgggttacatgagaggcaacagtataataactcttcagatgatgatagttcttcttcatcaccatag

SEQ ID NO: 10525 - DNA, 111 bp, Glycine max
  Peptide Sequence Number=SeqID_102210
atgatgagcaagctcgtaaagagaaataaagaagatcttgaaaggatgctttatgagaaccggaggaaggttgaagaagctcagagaagggaagctttagaccaacaatga

SEQ ID NO: 10526 - DNA, 326 bp, Glycine max
  Peptide Sequence Number=SeqID_102211
atggatttgaagtggacccacgaggaaggggaattggttgccgccgcgttggatttcggtgcggtagcgtttgcggagcttctccatcttgtggcggcactgcacggcggttttcgccgtgggggaggcgttggggcactgcgcggtgacggcgtcggccacctcttgccagtgggtagccttcaggttggtgcggccgagggagtaccatttgtcgcggtaggcgtcgatgagggcggcggtttcctccggggtccagcagggaggaggaaggcggcgggaggaggtggcgggaggcgccgggagagggagggggacggcagagg

SEQ ID NO: 10527 - DNA, 1491 bp, Glycine max
  Peptide Sequence Number=SeqID_102212
atggatctgagagaaagtttggtacttcttcttgtggggtcgttcgtcgtgcaattttgttgcaatgccaatgcgaatttggtgttccccgttgtgcgcaaattcaaaggtcccgttgaaaacctcgctgctatcaaagctcatgatgctggtcgccgaggtagatttctctctgtcgttgatgtcgctcttggtggcaatggccgtcctacttcaaatgggctgtattataccaaaattgggcttggccccaaggactactatgtgcaagttgatacaggaagtgacactctgtgggtgaattgtgttggctgcacagcatgtcccaagaaaagtggtcttgggatggacttgaccctctatgaccctaacttatccaaaacttcaaaggcggttccttgtgacgatgaattttgcacttccacatatgatggtcaaatttctggctgcacaaaaggcatgtcctgcccatacagcataacttatggagatggaagtacgacctctgggtcctatattaaggatgatcttacatttgatcgagttgttggtgatctccgtactgtgcctgataataccagtgtgatttttgggggagccttggtcggtgcaagcgtaatggtaggagttgttgccatgtgtggttctaaacaatctgggacattgagttcaactactgatacatcccttgatggaataattggttttggacaagcaaattcttctgtgctttcacagcttgctgcagctggaaaggtgaaaaggatattttcacactgccttgacagcattagtggaggaggaatatttgccataggggaagtggtgcagccaaaagttaagacaactccattgttacaaggaatggcacactacaatgtggttttgaaggacatagaggttgctggggaccctatacagctcccctcagatatattggattcttcaagtgggaggggaacaataatagatagtggtacaaccttggcttatcttccagtctcaatttatgaccagctattggagaagattttggctcagaggagtggaatgaaattatatcttgttgaggatcagtttacttgtttccattattctgatgaagaaagtgttgatgatttatttccaactgtaaagtttacctttgaggaggggcttactctgacaacttatcctcgcgattacctattcctgtttaaagaggacatgtggtgtgttggctggcaaaaaagtatggcacaaactaaggatggaaaggaactaattcttcttggagatttggtgctggcaaacaaattagtcgtatatgatcttgacaatatggccattggatgggctgattacaattgctcttcaagcatcaaagtgaaggatgacaagactggatctgtatatacaatgggtgcacacgatctttcttcagcttctaccgtgctaattggaaaaatattaacgttctttgtgttgcttattaccatgctaagcacttaa

SEQ ID NO: 10528 - DNA, 795 bp, Glycine max
  Peptide Sequence Number=SeqID_102213
atggtttgtagacatgatattagttttatctttgaagctaacatgatcttgagtgtatatgtgtctttcagagttggaataccattggttttcaagtcaagctttgacaaagctaaccgaacatcatcaaaatcatttcgtggcccggggatggctgagggattgaagatactcgagaaggtaaaaatagcttatgacattcctatagtgacagatgtgcatgagaccatccagtgtgaagcagttggcagagttgcagatatcattcagattccagcattcttgtgtcgccaaacagatcttctagttgcagcagccaaaactgggaaaattatcaacattaagaagggccagttctgtgctccttctgtgatgacaaattcagctgaaaaggttcggttagctggaaatcctaatgtgatggtttgtgagagaggaacaatgtttggatacaatgatttgattgttgatccacgtaacttggagtggatgagagaagccaattgtcccattgtagctgatataactcactcactacaacagcctgctggaaagatgttggatgggggaggtgttgctagtggaggtcttcgagaactaataccttgcattgcaaggacagcagttgccgttggagtggatgggatcttcatggaggtgcatgatgatccactgaatgcacctgttgatggcccaacacagtggcctttgcgccactttaaggagctacttgaagagcttgtagccattgctgttgggtttaggcaatcatcggtgcaacctgatcccatttga

SEQ ID NO: 10529 - DNA, 156 bp, Glycine max
  Peptide Sequence Number=SeqID_102214
atggggaaaggagcacggaaacgcgttttttcggtgaagggttttggcttttttgttctgtgttttctgggggtggcgaatctgggaggttttgtgtggtgggttttggagggtggtggtggggatcgtggggagggtctaaagctgaagacttga

SEQ ID NO: 10530 - DNA, 906 bp, Glycine max
  Peptide Sequence Number=SeqID_102215
atgaataaagcaagcttgttgggtggcactatgattgaaactaagcaagtggatagcataatgattaaagcaaagaccactcttccctcggctgagtttgtgacaggatcaacagcatggcttggcagaggtctgtcctgtgtctgtgcacagagaagagaaagcgatgccagaccctcttttgatttaactccggcccaggaggagtgcttgcagaggctacagaatcgcattgatattccatatgatggttctatccctgagcaccaggatgccctaagagctttatggagtgctgcatttcctgaagaagaactccatggtttgatttctgagcagtggaagaacatgggctggcaagggaaggatccatcaacagattttaggggtggtggtttcatatcattggagaatttgttgttttttgctaggaatttcccggttttaccagacacattttttgcgtttcttttagaccctaattccccaaggaaatcttttcaagaccttttacggaagcaggaaggagatcggtcagtgtgggaatatccatttgctgttgctggtgttaacatcacattcatgcttattcagatgctggatcttgaagcagactattgcagcatagatgttttttgcaatttggatgggaagcagggaggtaggaacttaaccataacaaaatggaaaaatgttacaaaagtattggaaaatgattcagcttttgatcttctctattgcataacattcaagatgatggatcaacaatggctttctatgcgtgcttcatatatggattttaatacagtaatgaagtctactcgccgtcagctggagaaagagcttctgcttgaagacataatgcggctagaagatgtaccctcatacaaacttctcacacgatag

SEQ ID NO: 10531 - DNA, 900 bp, Glycine max
  Peptide Sequence Number=SeqID_102216
atggagggttgcattaattttttcaatttttgtgctgatcttgaagtgttcttcaacaagaacaaccttgtcatcttgaagttcaagccccttcctctaagagcaaatcttactcgttcttccagcatttttggacctgccgtcgaggctgcactctaccgtcaaggtgacaatacgcagggtagtgtaattagggtttctaatgtagggctaaagatttataaaaactacatgttcttcacgaagtgcaaatcatgggtcacaggcagaggtagacacgatgagcatcatgcagatgatgttcgccggcgacgtaggccgaccgcatctacccgtaggcaacaggtgactgaggatgttcctcatatgactgaggatgtagctccgattactgcagatgtacctgcagcttctgtagagggcttagctgatgctattgctgatgatgttgctgagggatttcctggtgggccacatgacccatcagtgctgacctcgtttggtgaccacgttgcacatcgcatatggatgggagaggaacatcctgacttgaggttggcctcccacggcaggaaggttgagaaaattgggaggccatcacctgagattgaagggctagtcgctgccataggattaagccctttgatcggttgctcaatagtcaccggcaatccgggacttatatctgcgcttgtgaagaggtggcacggggagaccagcagcttccaccttccaatgggagagttgacgatcacactcgatgatgtgtcattactcctccatctgccgatcacagacaccttgcataacttcgagcctctagttgtggaggaggcggtcgtcttgctgatggagttgctcgaggtcttgagtcaggaggttagagctgagactgcatag

SEQ ID NO: 10532 - DNA, 255 bp, Glycine max
  Peptide Sequence Number=SeqID_102217
atgatgcatgcatcagttttaggagttagttgctcgggagaggctaaaattctaaagcccggttcacacaattggaccacgtttgctggcacgtttgggtatgcagctccagagcttgcccagactatggaagtgactgagaaatgtgatgtattcagttttgaagtgctttctcttggaatcatcacggggaagcatccaggagatctcatttcttcattgttttcttcgtcttcatcagcaacagacttttaa

SEQ ID NO: 10533 - DNA, 1557 bp, Glycine max
  Peptide Sequence Number=SeqID_102218
atgggtcctaatctgtctgagattctgaagggtaagttgagtttgggggcaaggattatacaagaaggaggaagacggaacatcttcaagagtgtttttgggatgcaagaaaaagagctattgttgaaggcctctcagtgttatttatataccacagctggtcctattgctggaattctctttgtctcaactgcaaaggttgcattttacagtgaaaggcccataaccttctcttctgtgacaggagagttagtcagggcaccttacaagggtgccttggactctttaactaaaacagctaagtttttgtattgtggctctcccaaggttttgataccaataaggagaataaaagaagtcaatgaaagccagaatgtgaacaaggcagaacagaagtatatagagatagtgactaaggatgattctgaatttaggtttgaaaaatgttctttcaaagataatcagataaaggcattggaagagcaactaccaactgcagagaagaaactacaggtgtctaatatatctgcatacgagacaaggacagagtacgaaggacaacaaaaatttgtgaatgagttacaaagaggcttagcagatgcagaatataaacttatagaaggggagaggctgaggaaaaaattacataataccattttggagttaaaagggaacattcgtgtattctgtcgagtgaggcctttattagctgatgaaagttgtagcacagaagacaagattttcagttatccaacatcaatggaaacttctggacgagctattgacctagcccaaaatggtatatctgttgtaatgattttttacaccagaggcatcacagcagaagtttttgtagaaatttcacagcttctacaaagtggtcttgatggttacaaggtaatttcaaacccaatgtgtgcatcaatgacttctgatgggaaacatattctatcagcatgtgatgactgtaatgtatatctatggaatgttagtcaagaagagtctaatcccttaaaagctaagaagattacgtcttgtgagcggtttttctcaaatgcatccgtagcagtaccttggcatggtttgaaatctcaaaatattgaaatcgaacatcaactggatgccttggataaaacatcatctcaagttatacaactcagtccacctgcttcgttctctctgagtcaagagttcttcttggagtcttttccaaagggatctgcaacttggccagaggagaagcttcctgtttcaagccccaaggctaaagcatcagtgatgcgtaaatccgaatacaagttcttcaaatcttcttgcaagagtacctcctctgctcatgcgtggggcatggtcattgtcactgctggctggaatggtccacttcggcttcaagtacttcacgacgagaaacaaaacgtcagggtggtagcgggacagagttcatggcgggatgaagtagttcaggcaatagtgggggcgctaggtttttggaggacggtgtacctacaagcaccgtctttgatgacttccatcaaaactacaacgacggagttatag

SEQ ID NO: 10534 - DNA, 237 bp, Glycine max
  Peptide Sequence Number=SeqID_102219
atggctgatgttgaccaaaaatcattgttaaagtcgaccaaagctgcagtaactatggtggcagcagaggccaaagaaaccattttggaaaagcaaacaacttggggtgaagggtgtattagaaagaccaaaagaatctgccagcaggctagaatcttgatggataccatgatacacgtattgcaggatttttgggcttcaagaataccatcagaggctgcagattcttgcaagtga

SEQ ID NO: 10535 - DNA, 70 bp, Glycine max
  Peptide Sequence Number=SeqID_102220
gaatctcattagccatgaagggagcatttccaatgtagctgcaagaatacaaaagcaaaactctacataa

SEQ ID NO: 10536 - DNA, 546 bp, Glycine max
  Peptide Sequence Number=SeqID_102221
atgactttgaactcagcatctcagcagcagcaagctgagccgttggattcatctcccgtaatgctgataaccgcgagatacatccaaaggcttagagtgccgctgcaggagagagttttgctgagaggatccgaatccctattaagtttcagaaatacatccaacggtttgtttaaaaaccctctctctgctactatccctgaaacaacaggtggcataccaatcgagcttgttaaagcaacaaagctaggaaggcttcacctttcttccaaccacttgaatggaaagcttccaaacgaattaggcaacatgaaatcgttaattaagcttaagattagaaccaagtaccaaccatctttctggaaacattccaaaatcttgaagatttggatcttggctcttgaatctcttgatcttagtgggaatttgttgagtggaacaataccaagacagcttggaaaggtgcagcaactgcaatggttgaatctctcttgcaataatcttttggaagaattgcatccacttttgatgacatgtcagatttga

SEQ ID NO: 10537 - DNA, 1344 bp, Glycine max
  Peptide Sequence Number=SeqID_102222
atgaagttcacaataaaaacaccacaccctctcccttcaccccaatctaacaccctcctcaaacctcgctgcataataaccacaacccagacatccaaaccaaccaacaataaaaacctacacttttctaatgacacacgacaagccgcattacatttagagaaaatgataaacttagaagaacataataattatagcaattattttccgtccatgcaatcatcaaaacttggcaagaggtggaaggagtaccatggcatgagcaattgggacggtttgctagacccattagacgacaacttacgtgctgaaatcctaagatacggtcatttcgtggaaaccgtttacaaatccttcgagtttgacccttcttcacccaactatgcaaactcgaggttccccagaaaagatcttttagaacggtgtggtttacataacactggctacaaggtaaccaaatacctacgtgcaacctcgggtattcagctacctagttgggtggacaaagcaccaacatgggtggcaaaacaaacgagctatgttggatacgtagcggtgtgtcatgacaaggaagagatcaaaaggcttggtcggcgcgatgttgtggtggcatatagaggaaccaccacatgcttggaatggttagagaattttcgtgcatctctcaccaacctccctattccatgcaacaccaaaagggcctttgaaaaaaatggggtcatggacagaagtggggccatggtggaaagcgggttcttgagtctctacacctcatcacttcccagaaagacgtttaggtctttacaagaaatggtgaggcgagagatttcaaggatcctcgagacctaccggggggaacaattgagtctgaccgtcaccggtcatagtcttggggcagcattagccacgctcacggcctatgatgtcaagaccgctttccctggactgccggtgacggtcatctcctttggtgggccccgcgttggggacccgaggttccggaggatgcttgagaggcaagggaccaaggtcttgcggatagtgaactccgacgatgtcatcaccaaggttccggggtttgtgtttgatgatggcttggccagcgatggaggggtccacgtgccgggatttccgagatggatacagaagagggtggaggaggcacagttagtgtatgcggaggttgggagggaactacgcttatgtagcaaggattctccgtacctaggaaacacgaatgttgccacgtgtcacgagctgaacacgtatctgcacctcgttgatggctttgtcagctccacgtgtcccttcagagcctccgcaaagaggttcctccagcgttga

SEQ ID NO: 10538 - DNA, 1269 bp, Glycine max
  Peptide Sequence Number=SeqID_102223
atgacactctctataagcccaaccacccaaccacacacttcaccttgttccgtctccaaacccaacgttaacccaactttctcacacgccaccaccccaagcttacccttcaacaagtcccaactcgcttgggatcgcatcaagcatgactcagtgcaatgcaactcgcccaaactcggccacaagtggacacaataccaaggaatcaaccaatgggatggtttgctagaccctctcgacgacaacctacgcatggaaatcctaagatacggccaattcgtcgaatccacctatcgcgcattcgacttcgacaccaattctcccacttacgccacatgtcgctacccgaaaacatcgctactcgctcgaaccggaccgagaaaatccggttaccgagtaacgaagaacttacatgcaacatgtggggtagaattacccaactgggtttcctctttgtctcagctgccacgtgttcaatctagttggattggttacgtggcggtatgcgaagacagggaggaaatcgcacgtctggggagacgcgatgtggtaattgctctaaggggaactgccacgtgtctggagtggttggagaatcttcgtgtaaccttgacgaaattgcccagccatatgggctgtggatacgaagactgcatggtggaaaacggttttttgagtctctatgtctccaaaacgggcgcgtgtccgagtttgcaagacatggttcgcgaagaggtggcgagagtgatcgaatcatacggcgatgagccactcagcataactataaccgggcacagccttggagccgcactcgcgattctcagcgcgtacgatataaccgccacgttgaagaacgcgccgatggtcactgtggtttccttcggtgcgccccgcgtgggcaacgaaaagttcaggagtcagttggagaagagtgggacccgcatactaagaatcgtaaactccgatgatgtcatcacaaaagttcctggactcgtggttcgagatgatgacgtggcgtgcagtggcggtgtccacgcggcgggattgcagagttggttccgtaaggttgttgatgacatgcagcttgtgtacgctgacgttggacaagagttgagagtgagtagcagggaatcgcagtatctgaagaaaggagatgtcgccacgtgtcatgatctcaagacgtatcttcatctggtgaatggttttgttagttcctcgtgtccgtacacgaccaaaacgacacagtatccagcggaagcttggctatga

SEQ ID NO: 10539 - DNA, 660 bp, Glycine max
  Peptide Sequence Number=SeqID_102224
atgaaagatgattacattcatttgttcgtgagaagacctgttaggagatctccaataattaatcgaggttactttgctcgctgggctgctattcggaaacttctctatcagtttcttgatgttgagaagaagtcagatgaagatccccctataaagaagcagatattatcacttggagcaggttttgacacaacatattttcagttgcaggatgaggggaaagcaccttatttatatgtggaagtggattttaaggaggtaactagtaaaaaggcagcacttattgaaacttgcagcccattgaggaataaagttgacgagacagcagtcatatcaagagaaaaaggagaagtgttcagtgctcactataaactactccctgcagatttgcgtgatgtgcaacaattaagtgctattattactcatgctggtttggatccaagtctgccaacttttataattgcagaatgtgttctgatctacttggatcctgattcaactcgtgcaattgttggttgggcttcccaaacattttcaacagcaatattttttctttatgagcagatccacccagatgatgcttttggacaacaaatgatacggaatttggagattacccttaccattggaaatgtcttatctcaaaaatggaatttctaa

SEQ ID NO: 10540 - DNA, 495 bp, Glycine max
  Peptide Sequence Number=SeqID_102225
atggataattattacgatgctactactgctactactgaatccgacatgacactttcggaccttattcaacattacatgcatgatgatgaagccaatgctttgaacaataatgtggaaggtgctaaagcacaaaaagaagttccgaaatggacgaggtacaaaggagtgaggcgtagggcacatggaaagtttgctgctgagataacagacccaaacaaaaatggtagggtttggcttgggacttatgacactgaagaggaagctgctttggcctatgacaatgctgctttcaagatcagaggctccaaatccaagctcaattttcctcacctcattccacccaagctgccattggatgcttcaattgcaagtagccagatgagtgaccctccttcttcatcatccacatttgaggatggtttagaaggatccaagaaaacgaaggggatagctggtttgctaaataaattagcccatgaacgaaatagagtttga

SEQ ID NO: 10541 - DNA, 456 bp, Glycine max
  Peptide Sequence Number=SeqID_102226
atgggaaaggaggcttccctttattccccgaacgagaccacgcctcttaagtgtttggaaatgcaaggagaagttcacggtaacacgcgtgtgctcactggtataggattcttaccaccacgatcaccatcacaaccacacaagatttttccctccaacgccccacctcgacgtggacctcaattccctaacccacgaccatgtcgtcaccgttgtcgcttcactcgcttccgatgctggttcaatggtggcattgggttggctcccagtaccaaaacgctgaactgggtcgttaagattgtgactgaaatgggtttggttgagtatgcagagaacctgtttggtgaaatgtgtgcgagaggggtgcaatcgaattgtgtcagctacaggtcatggttgttggttattgtaaaatgggtgatgttttggaggcggataggtggttgggtgcgatga

SEQ ID NO: 10542 - DNA, 261 bp, Glycine max
  Peptide Sequence Number=SeqID_102227
atgagtgatctaggtcaaggttacaacatcctgagactttctcaggtgcgtccggatctgtcattgtgcattggaaaatactttccaaacatcaaaatgcatgtttgcttcgcactgggtctgtgctacaatgcacattttaatgtagatccaatggatgaacagagaagtgatgaagggtggagatcagttaatggtcaacctacgtttgctgtctcaccaacagattccccaacgtacataaacatagccttggtttaa

SEQ ID NO: 10543 - DNA, 885 bp, Glycine max
  Peptide Sequence Number=SeqID_102228
atggcatcctcgttggcaccagctaccaaagccgccactaatttgcgcctcacacactctctccgcttctctcctaaacccaacaacctacgctttgccaccaagcctggtaatacgctgttatgcacgagggttaaggcccaattaaatgaggttgcccttgatagttcctccaatgctacttctcctcctatgaaagccaaatcaaaggaggaaccacccgcaaagcctttagcagaaccatcttcttcagtgttggcaactcaagaatcggtctctcagtttattactcaagttgcaagtcttgtcaagcttgttgattcaagagacattgtggagttgaagctgaagcagcatgacgttgaagtaacaatcaggaaaaaggaggctatgcctcagccaccacctgctcctcaaccttctgtggtgtattcaccccctccaccagcgttgccaccaccacctgtaccagcatctactccagcacctactctagctcgtgcaacccctacaccaacttcagcccctgctgtgaagtcagctaaatcatcacttccgcctcttaaaagccccatggcagggacattctaccgaagtcctgcacctggtgaaccttcctttgtgaaggttggagacaaagtaaagaaggggcaagttgtatgcatcattgaggcaatgaaattgatgaatgaaattgaaactgttggatatgcagaggtagaggacgagcatttgatattaaaggatgaggatgaactaagtgatatttatcttgggaatggtggaagtacttctgcttgtggccactccaacaacggaattcctggtgtttttgctttagtggcttctgatctgttcttgctggcttggataattgggcggtga

SEQ ID NO: 10544 - DNA, 903 bp, Glycine max
  Peptide Sequence Number=SeqID_102229
atgggtgaagcaaacgctcaatctcagagcgaacccttcatcgcaaactctccacaaccaacatttcagaaacacaaacaccccatcaccgcaaactcaccaccaccaccaccaccaccacactcaccaatgtgcgatcatcaccacattcttcaacaaaaccaagaagcggtggagcccacagacttgttctccatgatgcacctctccaacagcaatgtctgcagcaaccgtcagccaccctgctccgccgccaccaacaacaaccccatgaagcgccgatcgacgccatcttcctcctcctccggcgagccctgcgccaagaagctcttctgcgaccaagaggatctcaccctctacggcttctccgccgtctccattcccctcaacatcaaccccctcgtcaacaagcgcggctctttccccgtcctccgccgctgcgtctccgacccctgcacccctccggcgccgttgccggaaccggagcaatccactccaccggagagaggctccgggctgccacccctaccgccgagattccaacggagcgtgtcggatctctctgttccttccccggacaaggctatgtcctgtttgagctctgaagaaaccgtcgcgcctgattccgtgaggctgagaaggatgaaggagcgtttgaaagagatgaggcagtggtgggatgaagttataaaagatgagaaggaagatggtggagaagaagagtgtgcagttgctgaaaatgtcaaggtcctagctcaggatgatttgggaggtggagattctgaagaagctgttagtgttgattgggctgaacggtgcataaaccttgcgtttaggtgcccgtgtgggaaaggctatgaggttctcctctctgaaaataactgttactacaagttgatgtag

SEQ ID NO: 10545 - DNA, 156 bp, Glycine max
  Peptide Sequence Number=SeqID_102230
atggacatgtatttggcatgggatggtgatggggcaatatttgaagtgagcatggagaccattatactgagacataatcttccaacatgtaaatacatgacttattcctctaatgggccaaaactgtggcccaggaactttgctgatccaatttga

SEQ ID NO: 10546 - DNA, 1068 bp, Glycine max
  Peptide Sequence Number=SeqID_102231
atggggttatctgccaagaaatctagaaaaagaggaaaaagggacagtgattcagatgaatacgataatatggagtatgaagaggtggaggatgattacgatgatgatggtgaggaggaggatgaagaggaagaacatggagaggaagtaacagatgatgaagatgggacaggagagcatggtgaatggaagaatgatgagatggaacagcttgagaaagaatatagagatcttcatcaccaggagctagatactttgaagaacttgaagcatcataaggatgaagatcttcttaagggtcaagctgtgaaaagccagaaggccctctggtacaaaattcttgagcttagattcttgcttcagaagcctttctcaagctccaataggttaccacaggaatcaatcaagtctttgttctgtgaaactgatgagacagttagagtagcatattcagatctgatgacttcatccaaagagactttagattctatattggaactgcaagaggctctctttgctaagaatccatcaattacccaagccatagttggttcagaaggttcatcaaaagatttagaagtttataagcatttggatggcaatcttgatcaggagtggtcacagatttcacagatgcacaagagtataacatctttcagagacaagtcaatcaacaaatggcagcgggtgacacaagtgactactggtgctgctgccattaagggcaaattgcatgcttttaatcaggatattagcaatcaagtcgctgcttatatgagagatcccagtagactaatcaagcagatgcgggttccagaggttgttggtgaacctaaagaagcggaaacatgtactgatggtgatcctgaacttctggatgactctgaattttatcaacaattattgaaagaattttttgagacagttgatccttcatcatctggcttcaaaaggcacactgtctttaacaggtccaaatggctgattttaagtttagctggactcaccatcacgatggttttgatattgaactttctatatggtctaggttttgcacttgtactgtag

SEQ ID NO: 10547 - DNA, 720 bp, Glycine max
  Peptide Sequence Number=SeqID_102232
atgcacaaacaaatagattattttaaagagtaccaacaacgactgagtgctctaattggtgtctcacgaactaaacgactcgtgaatcaagcgttgatccttatcactgttggtggcaatgattttgtaaacaactacttcctagtggactctactgcaaggtctcgtcaatactcactcccagactatgtcaagtttctcatcaatcgatatagcaagcacttgcagaggctatataatctgggagctcggcgagttcttgtgacagggtcagggccattgggttgtgcccctgcagaattggccatgcgaggcaaaaatggagaatgttctgctgatctacaacgtgctgcatcattgtacaaccctcaattagagcaaatgctacttgaacttaacaagaaaattggcagcgacgttttcattgctgcaaatacagcactaatgcacaatgatttcatcaccaatcccaatgcttatggatttaacacgtcaaaagtagcttgttgtggacaaggaccctacaatggtatggggctatgcttgccagtctccaacctatgccccaaccgagacttgcatgcattttgggatccattccatccaactgaaaaggcaaacaaacttgttgtagaacaaattatgtctggctctacaaagtatatgaagccaatgaacctcagcaccattctgaccttggatgctcgaacacattcatga

SEQ ID NO: 10548 - DNA, 249 bp, Glycine max
  Peptide Sequence Number=SeqID_102233
atgggcgttcttttttctagcaccctggaggaggagagtcctgacgtgaaagcgttccactccgcggagcgctgggagagctacttggaaaagatcaaagagtcccctaagctaggtgtggcgaaggagtttaaggtggaggcgatgccgacgttcgtgtggtggaaggaaggaaaggaagttgagagggttgtgggagccaataaggacgagctccagaacaagattaagaaacattatcaattgtga

SEQ ID NO: 10549 - DNA, 1095 bp, Glycine max
  Peptide Sequence Number=SeqID_102234
atggcggcttcctcgaggccatcgtccgcggccaccgcgccggcctcctcaccaccgccgattacaacaacctctgccaatgcgaaaccctcgacgacatcaagatgcacctctccgccaccgagtacggtccttacctccaaaacgttacctattgcagagccttctccgttgcataccaccacgattgtcgagaagtgtactcttaagctggttgatgattacaagaacatgctatgccaagccacagaaccgttgtcaacctttttagagtatatcacatatggtcacatgatagacaatgttgttttgattgttactggcaccttgcatgagagagatgttcaagaattattagaaaagtgccatccactcggcatgtttgacagtattgctactctggctgttgctcagaatatgcgggagctttacaggctggttcttgttgacactcctctggctccatacttctctgagtgcattacatcagaggacttggatgatatgaacattgaaataatgaggaacactctttacaaggcataccttgaagacttctacagattttgtcagaaacttggtggtgccacagctgagataatgtctgaccttctagcttttgaggctgatagaagggctgtgaatattaccataaatagcattggtactgagcttaccagagatgaccgtagaaaattatactctaattttggtttgctatacccatatggtcatgaggaacttgctgtctgtgaggacattgatcaggttcgtgctgtcatggaaaaatatcccccctatcaatctatttttgctaagctatcatatggagagagccagatgcttgacaaggcattctatgaggaggaggtgaaaaggctttgcttggcatttgagcaacagaaatgcgaggatcatgcagggtcaccatttgctccaccttcaatctctgatgatgatcaagagtttggaatttttggtgaatttgactggaaaattgttctgatcgggtatgggggtggacttattgcgggagtagcattgggaaggaatttcggtcaagaagtacttgaatggcttataaggctcatttga

SEQ ID NO: 10550 - DNA, 1422 bp, Glycine max
  Peptide Sequence Number=SeqID_102235
atggcggaggacaaggacgaggaaggagttttcgcggcgcagaagataacgattggagtatgcgtcatggaaaagaaggtgaaatgtggctacgagcttttttcggcgcctatggagcagattcttcagaggttgcaagcgtttggtgaatttgaggtcgtacattttggtgacaaggtcatccttgaagaaccaattgagagtgtgaatgttagacctcctgcaattcgtgaagtgcatgaaaggaggaatagggtagagaggataaatggagatttaggctgtaacaaccttgtctatgtggcaagggtggtgggaagtaaaggagtaactgctaggagaaagccatcagggagagtggagtggagaagggcatcggggtggcacatttcctctcatcatttagagttttacatattatgtgtgtatatgtgtcttgaaaagtttggaatccatgttccaagatatgcccttgtaaatagagaagtaccgtaccaacatttggattacttcattgaggaagaagattttgttgaggttcatggaatgcgtttctggaagccatttgtggagaagcctattgatggtgataatcacagtataatgatatactatcccagttcagctggtggaggtatgaaggaattatttaggaaggttggcaacaggtctagtgagttccatccagaggtgagaagagtgaggcgtgaagggtcatatatttacgaggagttcatgccaactggagggacagatgttaaggtatatacagttggccctgaatatgctcatgctgaggcaaggaagtctcctgtggttgatggtgttgtgatgagaaatcctgatgggaaggaagttaggtatccagtcctcctgactcctgctgagaaagaaatggcaagagaagtttgcattgcattcaggcaagcggtttgtgggtttgatctcttgagatgcgagggacgatcctatgtttgtgacgtgaatggatggagctttgttaaaaattcacacaagtattatgatgatgctgcctgtgtgctgcgaaagatgttcttagatgcaaaagcacctcatctttcttcagcaattccaccaactttaccatggaaagtaaatgaaccggtccaaccttctgagggactcactcgtcagggtagtggtattattggcacttttggacaatctgaggaactacgttgtgtaattgctgttattcgtcatggtgatagaactcccaaacagaaggtgaagctaaaagttactgaggaaaagctgctaaacctaatgttgaaatacaatggaggccgacctagagctgagacaaaacttaaaagtgctgttcaacttcaagatttgttagatgccacacgaatgctagttcctcgtaccagtcggttttcttctcaatattacttttga

SEQ ID NO: 10551 - DNA, 384 bp, Glycine max
  Peptide Sequence Number=SeqID_102236
atggcagaagaacacagatgtcaagcaccgtgcttctatgccaacaattgcagtttctttggcagccctaccacgcagaatatgtgctcaaagtgctactgcaatttccagctcaaggagcagcaatcttccaacgcgaagatggttttgaatcagtttctcgttccgctaccgcctttggcagtgatttctcagtcattgtctttttccactccggcagcagatctggcttcaaaggtggttcttgatgcgccacacgtggcggagaagacccatcgttacccaaagaagcacgcatgcgagtttgacttcaagaaaatggggagggagcagattgcgaaggcgaatccagtggtgaagggcaagaagcttgagaagatctaa

SEQ ID NO: 10552 - DNA, 261 bp, Glycine max
  Peptide Sequence Number=SeqID_102237
atggggattgggaagaacctgtctgagacaaaagggagggagttgtgtgaattgcgtgaagagaccaataccaacaccaccaacagcaataacaacaaatcgaggaggaaccggagacatcgtcagaggaagatgtcgcctggtcagaaattgtttcaaacgtgtaatgaagtgtttgcttctactggccctgggattgttccttcccctcaaaacattgaaatgcttctctctgttttaggttgcgtctgtgtcttgtaa

SEQ ID NO: 10553 - DNA, 366 bp, Glycine max
  Peptide Sequence Number=SeqID_102238
atggaatcaggagccagtgggctagtaccccacaatatgcctgatgaagatgaaggcagcaaaggaatgggctccttgttttcttcccccagcgccaccgaggcggagaatcctgacgtgaaagcggggaatcctgacgtgaaagcgaggagttctgatcacgtgaaagcgttcgactccgcggagagctggcagagctactggaaagagatcaaagactcccctaagccaggtgtggcggaggagtatgaggtgagggcgatgccgacgttcgtggcttggaaggaaggaaaggaagttgagaggtttgtgggagccaataaggtggagctcgagaaaaagattaagcaactttctcaatcgtga

SEQ ID NO: 10554 - DNA, 1638 bp, Glycine max
  Peptide Sequence Number=SeqID_102239
atgcatgctagaaatggtagagttctatggttgacggctaatcctagtaaaaccactgctaatggccctgttagtgttgcaaatgaagttgtctttgctggatccgcggatagactggggttgatatatgcaattgatgccaagagtgggaaaattttatggtcctataaaactggaggcagtgcttatggaggcatgtcaatcagcaatggatgcatatatgtgggtcatggatatactggaagagacattagtgcaacaccagccatatatgatggtaccctttattttccaagctgggatggtaacatctatgcagttaataaagcgaatggattgcttgtttggaagcagaacttgcagaaactgacaggtataaatgcaactggcggtgttcgcagtctgaattggaccgtgtcaaggtcaactcccacagtggctggggatgatttaatgataattaatgtgtatggccctgctgttgttatttgtgtcaaaagaacaaatggtaagcttgtgtggaagaccactttggattaccatcctgaagcactcgtcaccatgtctggaacatattacaaaggatattactatgttggaatatcatcacaggaatcacttctacccaaagagcaatgctgcatatctcgtggaagttttgtaaaacttagtgctcgatctggtgaaacgttgtggaggacttatatgttgccagataacaataacagaagaggagaatatgcaggagctgccatttggggaagcagcccgtccattgacgttaaaagaaaccatgtctatattgccaccggcaatctctattctgctccattacacatacttcagtgtcgtgagagacaaaataatcgaactgaacctactcaaccagacgagtgtatcgaaccagaaaaccactccaattctatattagcccttgatttggattctgggaagatcatttggtactgccagttaggaggatatgatgtatggactttagattgtaacaatgcttcaactcctaattgtcctccccgaggtctccggcaagatgctgattttggggaggcaccaatgatgttgacaacatatataaatcaaaccaagaaagatatagttgttgcggtccaaaaaagtggttatgcctgggctttagatcgcaacaatggtaacatcatttggtctacggaagctgggccgggcgggcttactggaggtggaacatggggtgcagcaactgatggaaaaacagtttacacaaatattgtcaattctgatgccaaaaattttactcttgcaccatcaaatgtgattacaacggctggtgggtgggtggcaatggatgctagaaatggtagagttctttggtcgacagctaatcctagtaacagcactgctaatggccctgttagtgttgcaaatgaagttgtctttgctggatccgcggatagactgggatacatatatgcaattgatgccaagagtgggaaaattttatggtcctataaaactggagccagtgtctatggtggcatgtcaatcagcaatgggtgcatatacgtgggtcatggatacagtgttggtcttgttttcagctatacgggtggtaccaaactgtttgccttctgtattgtctaa

SEQ ID NO: 10555 - DNA, 864 bp, Glycine max
  Peptide Sequence Number=SeqID_102240
atggccttcctaccttctcacggtttcacgtttaacactactcatgaagaagatcactgccacttccctccaacctctctcgaccccttcccctctttgccaccccagcactttcaagggggtgcacctttcatgttgaagcggtccatgtcgttatcaggcatagagaacaagtgcaatgaagtacatggagatgatgagttatccgatgatggggtcttccagagtggggagaagaagaagaggttgaatttggaacaggtgaaggcccttgagaagagttttgatcaggggaacaaacttgagccagaaaggaaagtgcagttagctaaggctttggggttgcagccaagacaagttgccatatggtttcagaatagaagggctagatggaaaaccaagcaattggagaaagaatatgaagtcctcaagaagcagtttgaagcagtcaaggctgataatgatgttcttaaggttcggaaccagaaactacaggcagagttggtcattcttgtgaagaatatctgtgttactgtcagaccccatatcagcatcttattacaagctgtaaaaagtagggattgttgtgaagctggaataatcagccttaagaaagaaactgagggttcatggagcaatggaaatgataacaactcagatctaaatttagatccctcaagagcactaggtttgaacagtcctatatcttctcataacattaaaaacctactaccaaattcgttaaagccaaacagcataacccaactccttcaagatgatggcttgtgcaacatgtttcacaacattgatgcaccacagaacttttggcccaggcctgatcagcaccaccagcgtttccattga

SEQ ID NO: 10556 - DNA, 1404 bp, Glycine max
  Peptide Sequence Number=SeqID_102241
atggaacaccaaaaggaggagcaagcagaaccagtgagtcctgtgggacaatacttcaacagctctgtgctatgcatatacatcattggagttttagaattcgaagttccaattgatgacttgcaaacatatgctcttctcaaagatgttttccttcccatcaatccacgcttctcctccatcatggttcaagataaagatggagagaaacgatggaagcaagttgctgtaaacttgaaggaccatgtgaagatccccacattccccgaaggcaaaacagtggaaacctatgacaaatattttcaagattatttatcaagcatagcaatggagcagttaccacaaagcagaccattatgggatattcacataatcaatcaccgtacaagtgatgcatccagcactataatatttaaacttcaccatgcacttggagatggctattctcttatgggtgcacttctttcttgtctacaacgagccgacaacccttctcttccattgtccttcccttctctcaaacaatctaaaccagaaccttccactaaaagctttagcagaaaaatttcttggatgtgttcctctgccttcaacactgtctcagattttggttggagtgtattgaagagtagcatcattactgatgataaaacgccaataaggtttggagacgaaggagccgactttcaaccaatttctatatcaagcatgacattctccattgaccatatcagggaaatcaaatcaaggcttgaagtgactataaatgatgtggtcactggaattatcttctatgggactcgattatatatgcaagatattgactccaaatcaaagacagcacaatccacagcattggtattactgaatacgagaaacattgaaggttaccaatcaatcaatgacatgctcaatactaaagcaaagggtccatgggggaacagaattaccttcttgcatgttccaataccaaaattaaatgaaaccagaaattcaaaccctcttgaatttgtttgggactcacataatataatcaagaggaagaaacaatctctaggagttgtactcaccgggacacttctggagatagaaggcaaattgaggggacaagaggcagtggctaaacgcattcgtggcacattgacaaaatcaagtgcagtgatttcaaacttggttggaccaatacaacaaatggctttagctaaccatcctgtgaaaggcttgtatttcacattggctggtggacctgagagtctagtcatttcaattatgagctatatgggagtgcttagagttaccctcaaaacggaaaaaggcttcatagacgaacataaattgaagtcgtgcatgcaaagtgcatttgataaaattctccaagcagctatggaaattaccaaacattag

SEQ ID NO: 10557 - DNA, 459 bp, Glycine max
  Peptide Sequence Number=SeqID_102242
atggtattagctagtttgaagagtcaccagagtacaccacactctaacccaaaggctcaagcttatgggtcttctcatttatatggtgttcaacctgtttattactcgatgaaggctcttatctttcaggaaatcgcatggactacttggaggattatcagaggaattcagtgcttatatgatgctattttgaagagtcaccagagtacaccgaagcagactctactgcgagaagtgcgttgggaaccaccaccagctacggctatcaaactgaacctggatggcatttttcgagaccaccatggtaactggatattgggtttcaccaacctcaaggcagagctgtttgcccttatgcatggtctctgcaaagcttggaacctgagataccgtaacatcatgtgccagacagattcgaagttggcactggatctactgcaagggaacgttgatgcttaa

SEQ ID NO: 10558 - DNA, 360 bp, Glycine max
  Peptide Sequence Number=SeqID_102243
atgagactttgcacccgaaaggacaaagatgtacgtgcaaactctttagaagaagagtttttcacatgcgagtccgattcagcacagagggtgaagtgttacctaattggtgagattcagaacagagtgaaaagagaaaaaagatgtgggaagaaaagaacatgtcagcgacttgttgtgtttgagttaatctttcggttgcttagaatcacgggattctggtttctgtgtaccgttagtgttatgggagtcatagattcgaaggtttcgtattgttatcagttggaagaaaaagtcaacaatgcgttgctaggggaaaacgaccatatagtcgacatgggtttatacagtattttatag

SEQ ID NO: 10559 - DNA, 225 bp, Glycine max
  Peptide Sequence Number=SeqID_102244
atgggggtggtgatcctggtcggtgtttctgtttcatgttccggggattttgctgcactgggagtggtggtggtgttgatgatcgttgttgttggggttatgtccatggctctaacatctagggaaatggaaaggaagagaaaaaaaaaagttgctttgttggaggaaggaggagaaggaagagtgttgaatgttgatgatggtgttgagagagtaatgagatga

SEQ ID NO: 10560 - DNA, 2124 bp, Glycine max
  Peptide Sequence Number=SeqID_102245
atggggtctatgaatttgttaggtttttctctctctcctcaagaacacccttctagtcaagatcactctcaaacggcaccttctcgtttttgcttcaaccctgatggaatctcaagcactgatgtagcaggagactgctttgatctcacttctgactcaactcctcatttactcaaccttccctcttacggcatatacgaagcttttcataggagcaacaatattcacaccactcaagattggaaggagaactacaacagccaaaacttgctattgggaacttcatgcagcaaccaaaacatgaaccacaaccatcagcaacaacaacaacaacagccaaagcttgaaaacttcctcggtggacactcatttggtgaacatgagcaaccctacggtggtaactcagcctctacagaatacatgttcccggctcagccggtattggccggtggcggcggcggtggtagcaatagcagcaacacaagcaacagtagctccatagggttatccatgataaagacatggttgaggaaccaaccaccacactcagaaaacaacaataacaacaacaatgaaagtggtggcaatagtagaagcagtgtgcagcagactctatcactttccatgagtactggttcacaatcaagcacatcactaccccttctcactgctagtgtggataatggagagagttcttctgataacaaacaaccacataccacggctgcacttgatacaacccaaaccggagccattgaaactgcacccagaaagtccattgacacttttggacagagaacttctatctaccgtggtgtaacaaggcataggtggacggggaggtatgaggctcacctgtgggataatagttgtagaagagagggacaaactcgcaaaggaaggcaaggaggttatgacaaagaagaaaaggcagctagagcctacgatttggcagcactaaaatactggggaacaactacgacaacaaattttccaattagccactatgagaaagagttggaagaaatgaagcacatgactaggcaagagtacgttgcgtcattgagaaggaagagtagtgggttttctcgcggggcatccatttatcgaggtgtgacgagacaccatcaacatggaagatggcaagcgaggattggaagagttgctggcaacaaggatctctacttgggaactttcagcacccaagaggaggcagcagaagcatatgatgtagcagcaatcaaattcagaggactaagtgctgttacaaactttgacatgagcagatatgacgtgaaaagcatacttgagagcaccactttgccaattggtggtgctgcaaagcgtttgaaggatatggagcaggtggaactgagggtggagaatgttcatagagcagatcaagaagatcatagtagcatcatgaactctcacttaactcaaggaatcattaacaactatgcagcaggaggaacaacagcgactcatcatcataactggcacaatgctcttgcattccaccaacctcaaccttgcaccaccatacactacccttatggacaaagaattaattggtgcaagcaagaacaagacaactctgatgcctctcactctttgtcttattcagatattcatcaactacagctagggaacaatggcacacacaacttctttcacacaaattcagggttgcaccctatgttaagcatggattctgcttccattgacaatagctcttcatctaactctgttgtttatgatggttatggaggtggtgggggctataatgtgattcctatggggactactactactgttgttgcaaatgatggtgatcaaaatccaagaagcaatcatggttttggtgataatgagataaaggcacttggttatgaaagtgtgtatggttctacaactgatccttatcatgcacatgcaaggaacttgtattatcttactcaacagcaaccatcttctgttgatgcagtgaaggctagtgcatatgatcaaggatctgcatgcaatacttgggttccaactgctattccaactcatgcaccaaggtctagtactagtatggctctctgccatggtgctacgcccttctctttattgcatgaatag

SEQ ID NO: 10561 - DNA, 666 bp, Glycine max
  Peptide Sequence Number=SeqID_102246
atgggaggcaactccgactccaactgttccatcactccacgccattacaacacccacaaggtgttccttttctgcaactacattctcttgggtgcagcctccagctgcatcttcctcaccctctccctgcgcctcattccctctctatgcggcttcttcttcatccttcttcaggtcttcacgattgcgggtgcagtctcgggttgtgctgctgtgggggctaataggtggtactctgcacacatggtggccactgttctaacggctatctttcagggttctgtttcagtgttggtgtttacgcggactggcgattttctgggtcagttgaaatcttacgtgagggaggaggatggtgctgtgattctcaaattggctggtggactcaccattttgatctttgtcttggagtgggtagttttgactcttgcatttttcttgaagtattatgcttgtgttgaggggaatagtggcgctgttgtgcctgtgaggagtgggaaggtgcagcaggatgaggacttgaaggattggccttggccttttcaaactatggctcggatgatccgcgtggtggatgaagagagggtcgcgaggattaagcggaagagaagaagtagcagccatgaaagaaatggaaatggcggtactgaatcaaaaaacttctga

SEQ ID NO: 10562 - DNA, 3276 bp, Glycine max
  Peptide Sequence Number=SeqID_102247
acaacggatgatacagaggtagtaggacaacaacaacgtcatagtccaatacatgatattgccttgcagatacagacacaggctccggtggaaacccatgggctataccaaacaaatgatgttcatacgcgtccgatgggcatggccgtgatagacgcgatcctcccaccacaaaatccttctagcttaatgagcttcaaggaagctgtagtgtcaaatgcaaggagaattccccttaagaccctagttactttgctccttgtttgtgttggtatcatggatcatcttgcaaaagagttgagcattcaattccttttggaattaataaactcccatgctgcaacacaagcaccgcttagcctaggcgaggcatttcaagggtttcgtactgtgattgcatatgagatggcaatcatgctggtctttctgctggctttgttgcttagttgtccacaaccattatgtgggatggttatggtgacaatctcctttcttggactattcgtccacattccagatctggtgggcaaggcaccagggattgctgtgactagcggtttcttcaggatgcctctcatttgctttacaaccatagtggcttttgttcttacgctggtttttgttttccttgcggtgttctttgcttatcttacctatggatgcgcacgtggtgcggggatatcaacagggggagaacttgaggttgccatgcaagattcgctggggaatgtggaagagggggggaactggcatcagaagctagaatctgttgttatggcttcaagagtgattttgcaaaagagaaggagcctcttcttcaaccccctatgtagtcaacctacttgcattatttttggattctcacgtgttgggcatgctcagccattagaatctagtgaattagaaggtttgagccggtttcccttatgtccatctgcaactacggaaaatggacaggaaaaaaaattatttactgtcaacaaagatgatcttgcagcttatcctgctttgagatttatctcgcctagttcctttagagtatcaagttttggatttagatctgacaagatagagttggtttatctttcaagattggggtggttatcccaatgtacccgtaatatttccatggcttcagctgatcaatctggattggctagcaataataagggaagtgaacaatcagctactaaacagaaaaaggaagcttcaccagaggaatgcgatgaagctgttgaaggcttgagcagcataaaagcaaaagctaaggctaaacaaatgcaagaaccacataagagtgcggattctattataaagaaattatgggctaagattttaggaattggtccagcattcagaactataatgtcaatgagcagggatgactgggcaaagaagtttcgtcattggtgggatgaatttaaatctaccctgcaacactactggtttggtacaaaactactttgggctgatattaggataagctccagattattgttgaaacttgccggtggaaagagtctttctagaagggagaggcagcaactcacaaggacaacagctgatattttcaggctagttccatttgctgtatttatcatagttccattcatggagttattgttgccagtattccttaaattatttcccaacatgctgccttccactttccaggacaagatgaaagaacaggaggcattgaaaagaaggttaaatgcaagaatagaatatgccaagtttcttcaagatactgtaaaagaaatggcaaaggagattcagaactcacaaagtggagaaatgaagaagacagcagaagatcttgatgaatttatgaacaaggttggtgcttctaccattgcttatgttcaacaagttgtgctctccagttcctcttggtctttccttcttgttgatgcatgcctggctctgcgtgtgacacttgacatccggttcagacctgctcatccaagatggaaagaggcacaatccccctccacagcactcaacaatttaccgattactaagaagaaagggatggagaacatcaagagaaagggaaagatggaaaggagaagaaattgtgaagggggtacattagcctcatatccgttagggatcaagaatgatgataaactgattcaagttgagggtgtcgaatctctttcagaagcagagcttcgtcaagcttgtagagatcgaggattgcttggattactttcagtggaagaaatgcggcagcagcttagggactggctggatttgtctctcaaccattctgtgccatcttccctcttaattctttctagagcattttctgtttcaggaaaggtcagaccagaggaagctgttcaagctacactctcttctctgccagacgaggttgtagatactgtgggggtgacaactttgccatctgaagattctgtttcagaaaggaagaggaagttggaatatcttgaaatgcaagaggagctgatcaaggaggaggaaaagaaagaggaggcagagcaggccaaaatggtagaatctgttggtagtgaaggggatttgggtattatgaaagagagggcttcaacaaccaaccaaacacaaggagaggtaaaagcaaagacattggataaacaggagcacctctgggagctcagccgtgcattagccgttttagcatcagcatcttcggtgagcagggaacgtgaagagtttttgaggcttgttagaaaggagatggagctttatgatagtatggtagggaaagaaggtacagaaggtgagcaggaagctaagaatgcctataaagctgcaaggaaggaaagtgatggtgctattgaggtagctattggtgataaggtttcttcagcacttgttgacagggttgatactatgctccagacacttgaaaaagaaattgatgatgttgatgctaaaattggagaccgctggcggttgctagacagggattatgatgggaaagtgacacctgaggaggtagtatctgctgctatgtatctgaaggacactctgagcaaagaaggaattcatgagcttatcagcaacctttccaaggatagcgatgggaaaatattggtggaagacattgtcaaattgggcacccagaaagaagaagccgatagagatgaagcgggaagatcataccatgcccccaacaaagtattacaagaggctggtaaagctgttaagcacatggaatcacttcactcatcttccccttccccattttttatggataaagatgcaggtctcgctaggttatgctag

SEQ ID NO: 10563 - DNA, 1866 bp, Glycine max
  Peptide Sequence Number=SeqID_102248
atggtaccgtctcggccgtccggttttgttctcaaaccaattgcaaacttatttcctatttctggtggtgaggctagccttctgagttttaaaagaaaaggccaagtttggatttgtccacaacctgcagatgtagttgaaatctttatttatcttggtgaaccttgccatgtttgtcagcttcttctcacaatatcccatggtgcagatgattcaacttatccatcaacagttgatgtacggacaggaggccatttagatgggcttaaactggtcttagagggtgcttctataccacagtgtgcgagtgggaccaaccttttaatacccttacctggggcaattaatgctgaagacatggctataactggagcaaattctcgtctacatgcccaagatgcatcacccttatcattactgtatgattttgaggaactcgagggaaagtgggatttccttactcgtgtagttgcgctaaccttttatccaactgtttctggaaggaaaccattaacacttggcgagatcgagggaaagagggatttccttactcgtgtagttgcgctaacctcttatccaactgtttctggaaggaaaccattaacacttggcgagattgaaatccttggagtttctcttccttggagtgatatatttactaatgaaggccctggtacaagattagttgagcatgtcaagaagtttgaagaggagcttaatccctttttatctggttcagatacgaatccacttaactcttcatcctcagaaaaagtgtcaccacccatacaaggaggcacttctgctgaccttttcattgacctcctgtctggggaggacccactttcgcacccacttgcgcaaccagttactgaaaatgttgtctaccaggaaagtgacccacttgatttcttggacctaagtgttgaaagccatagtgccaaaagtgatggtaaagtttcatcagaagatgccagacattcagatagtagtgctgaacaatatttaaagtgccttaaaactcttgcagggccaagtctgcaaagaaaaatcaacttcattgaagccattaaacttgagattgaacgccttaagttaaatctttctgctgctgaaagggatagagccctgctatctgttggaatggatccagcaaccttaaatcctaatacactgctcgatgaagcttacatgggaagattatctaaagttgcaagcaatcttgccctgcttggagaagcttctcttgaagataaaattgttggtgctattggtcttgggactgttgatgataatccaatagatttctggaatattatcagaattggggaaacatgttctgggggtaagtgcgaggtgcgtgctgaaattagaaaggaagttcattcatctaacacaatgtcatctgctggagcttcagaaactgtattcttgtgttctcaatgcgaaaggaaggtttgcagagtttgctgtgctgggaggggggcacttctgcttataggatataattcaagagaggtccaagttgacttacctgtaaatcgtttattagctcgggatggtataatttgtaaacggtgctgccaggatgttgtgcttcatgcattgattttggactatgtgagggttctgattagcttacgaagaacagaacgtgttgaaaagtctgcttacaatgctttgaagcaaatcattggatcatcttgggattgccatctagaaaagaatcggttctctgatagcaagtctgctggcaaagcagtacagttgttactgaatggatatgaatccctggctgaatttccttttggcagttttttacacccgttgttgcaaaaggaaggaaggcattggatattcatataa

SEQ ID NO: 10564 - DNA, 504 bp, Glycine max
  Peptide Sequence Number=SeqID_102249
gcgatgcgtctgaagcaggatttaccctatacgcgcgggctactcatcatcagcgcgatcctgctgacggtggcaggcgtggtgatggtgctggtgttctatggcggatagccgcaaagcgcgacgcgaagcggaccctggcctgcagccggagcggacgtcgctgcgcatggctgcgtacgctgctggggtatggcgcgctgattgctctggcgatcaagcacaactggcaccggaccggggtgccgttctggatctcgatcgtcgtactggcgctggtggctgtcattttatggcgctatacccgcagccgtaacctgatggacgtggcgcaggacgattttgtgcagccgaaggcggtgcgggataagttcctcatcgccctggccgtgctgtcgctgtcactgctgtttgcgccgccacccggcatcatggcttcccttgagccagatacttcgccatctcctcttcaggtaccatgccgccgccggtcgcccacaccag

SEQ ID NO: 10565 - DNA, 317 bp, Glycine max
  Peptide Sequence Number=SeqID_102250
ggcgcgtcccattcgcccattcaggctgcgcaactgtttgggaagggcgatcggtgcgggcctcttcgctattacgccagctggcgaaagggggatgtgctgcaaggcgattaagttgggtaacgccagggttttcccagtcacgacgttctcgcctggaagaggacaagcaacgcctgaaaaaactggagtttgcccatgccatttctccgctggaaaatccgatgactatccgtggcctgcgccgggatcaagcttatcgataccgtcgacctcgagggggggcccggtaccagcttttgttccctttagtgagg

SEQ ID NO: 10566 - DNA, 239 bp, Glycine max
  Peptide Sequence Number=SeqID_102251
atggtcctggaccacccagttttgagaggatgggatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10567 - DNA, 210 bp, Glycine max
  Peptide Sequence Number=SeqID_102252
atggagaaaactatgaaattgaagttgggagaatgcgtaaatgaaaagtctcgcgaatttgctgagcaacatcgccgaaaggaaatattgatgcaatcctaccccgcaagggcattggatagaagactccaaaaagattgggctagagatgcaagagaaggccctaaggttctcatgagccttagggtagattttgggcccatgggctaa

SEQ ID NO: 10568 - DNA, 318 bp, Glycine max
  Peptide Sequence Number=SeqID_102253
atgggtgaagtagaggaggtgcaaaagcagatgaaggccgacatggaggccatgaaagagcaaatggccacaatgatggaggccatgatgagcctgaagaagataatggaagccaatgtggttgcagttgccgctaccagcgttgttgctaaggtgaacctgatgcccccatctggcctcaaccaaatgaatcatccaacctcagctatggtaggcaaagatttgggaagtacgagcaacccctattatgtgcaaattcaaaacaagcatgccttcccgccatatggcttgcctcccaaattattcaccatccaatga

SEQ ID NO: 10569 - DNA, 386 bp, Glycine max
  misc_feature (343)..(343): n is a, c, g, or t
  Peptide Sequence Number=SeqID_102254
atggcacatcagttagattggctctccaagttgaaaattatcaacgaggagaacttcgaagctccggaagaggatgaagaagtccaagctctaaaatcagagctaggaaaggcaagactcgccaaagaaaaattcaagttagtcgctacagacattcggaaagacaacaatgagctcaagctccgaagagaggaaagagaccagtcacgagtacatggcatggtcttaaaggaggagttagctgcttgctcaagatccaagaggagtttggcccaacacttagaagccacggagcaaagcatgctagctataatagggaagtacaaagaaaagttaaaccagnctttgacccatgaacaaaaactagtagaggacttcgcacaagc

SEQ ID NO: 10570 - DNA, 402 bp, Glycine max
  Peptide Sequence Number=SeqID_102255
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 10571 - DNA, 421 bp, Glycine max
  Peptide Sequence Number=SeqID_102256
atggtagcaatagaccctatcgttgtaagattcgagcccctgggtttgctcatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 10572 - DNA, 207 bp, Glycine max
  Peptide Sequence Number=SeqID_102257
atgggcccattgttactgcctctgagctctttgtccttattttgtaccacttcccatgctttgcagaccttccgaagcgtctccacgttggtctcactgaaccctcgtgaaatgacaggttcgagctcttcctctagtggtgcccctcttatcgggcatgcctcacctcttggcgaaaaaggtgtggaaccaactgtcataccctaa

SEQ ID NO: 10573 - DNA, 507 bp, Glycine max
  Peptide Sequence Number=SeqID_102258
atgaagcacttcactgacacccctcatcagtgccaacatactggcacgacaggtttccccgactggaaagcgggcagtgagcgcaacgcaattaatgaaacagctatgaccatgattacgccaagctcgaaattaaccctcactaaagggaacaaaagctggtaccgggccccccctcgaggtcgacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 10574 - DNA, 336 bp, Glycine max
  Peptide Sequence Number=SeqID_102259
atgtcacagaacttcacggattgtgctacaatgctttcttttggcttccggcatgtctcggaacttcacggattgtcaaggatgtttcgatccatcagactcaccgttttggatttgtggaatactccagtcatccatgttttggtttatctcttcgaagcgtacttcttcatcgaagagattatgtttagggtaagaaaatttaagtttcttgggtctgaagttgaggatgaagatgaagaactagaacgaaaagagattcgggaaaatgaacgcaagagacgagacatgataaaattcatcctccagtatcttttccttcatttggtttcatag

SEQ ID NO: 10575 - DNA, 309 bp, Glycine max
  Peptide Sequence Number=SeqID_102260
atgaggtcttcgttgaagatgttaaccagattgaatctggttgtgtgcctttaccatcttataattcttctgcagagagctcaacaagccatgctagtgatgaaggagctggctagaagggaagccactcttggaatagtaacaatgaatgtaatcatggaactaaggcttcaagatcagatcaagaacgacgaaagggtattgcatgtacagaggatgaacacagcacaaggcaggttcgattgtactgtggaagaggcaattctgacaggaagcttacttgctacctcttttgttcatgcttcatga

SEQ ID NO: 10576 - DNA, 522 bp, Glycine max
  Peptide Sequence Number=SeqID_102261
atgacttcaaattcccaacaatttagtgctagaagtgatgctattgtcattagaggagtgcatgaagtagccacgaattcatcttcatcagctgagactaagaagcttgaaggtaaactagatgccttggttaacctggtaagccaactggccatgaatcaaaaatctgcacctgtcgccagactctgtggtttatgctcctctgccgaccaccacacagacctttgcccttctgtgcaacaatctgaagcaattgaacagcctgaagcttatgctgcaaacatctacaatagacctcctcaacctcagcagcaaaatcagccacaacagaacaatgatgacctctccagcaacaggtacaaccccaggtggaggaatcatcccaaccttagatggtcgagtccttcacaacagcaacaacaacaacaacagccttatttccaaaatgttgttggcccaagcagatcatacgttcctccaccaatccagcaacaacaacaacagccccagaaacagcaaaca

SEQ ID NO: 10577 - DNA, 354 bp, Glycine max
  Peptide Sequence Number=SeqID_102262
atggccaaatatgacccagaaatagtcatggaattctatgctaatgcatggcccacagaggatggagttagggacaagcgctcctggctaatctcggacaccatttaccaatttgtaggggttgcacctcccagacatctagtggacccggaaaagtccaatagagcattggggttttcggcctttatcatgggtctctgccaattctgtggggtgccggttactcccacaaagcttatctggccttccattaacaggacctttatagaaaagtactgcatgccaaggcaggcacaacagcaggggcaagaccatcagcagccagccacagatgcaccaccaccccctctatag

SEQ ID NO: 10578 - DNA, 417 bp, Glycine max
  Peptide Sequence Number=SeqID_102263
tgattgctttagtgcaattctcaattctcaaccctttttcggagcccatgaattgcgttttcgttcatgcatcctccaccttcgagtttggagccatgcgtagtgattgcttagtgcaattctccattctcaaccctttttcggagcccatgaattgcattttcgttcatgtgtcctccaccttcgagtttggagccatgcgtatcatgcgtagtgattgctcagtgcaattctccattctcaaccctttttcggagcccatgaattgtgttttcgttcatgcgtcctccaccttcgagtttggagccatgcgtagttattgcttagtgcaattctccattctcaaccctttttcggagcccatgaattgcgttttcgttcatacgtcctccaccttcgagtttggagccatgcgta

SEQ ID NO: 10579 - DNA, 448 bp, Glycine max
  Peptide Sequence Number=SeqID_102264
cttgcttctacaacacaccctcgcctttagaggactacacgtcctcgccttcagaggactacacgtctctgccttcaaaggactacacgtctctgccttcaaaggactacacgtcctcgccttcacagggctacacgtcctcgccttcacagggctacacggcctcgccttcagaggactacacgccctcaccttcaaatgcctacacgtccttaccttcagaggcctacacgtccttgccctcggagggctacaggccctcgacttcagaggactacacgtcctcgccttcagaggactacacgtcctcgccttcagagggctgcacgttctcgcctttagagggctgcacaccctcgccttcagagggctgcacgccctcgccttcagagggctgcacatcctcgccttcagagggttacacgtcctcgccttcagagggctgcac

SEQ ID NO: 10580 - DNA, 201 bp, Glycine max
  Peptide Sequence Number=SeqID_102265
atggaatccttcgccgaacaagaacatcaagaaaatgagcaatttaggctcttcatgcagaatatgtccatgcttggagttattgctgcacttgcacctcatccttttgaacctccaccaccaaccttaagcccaccaccaccacctccatcttcacctccaccttctcaacctccacaaccaccatctactcgggactga

SEQ ID NO: 10581 - DNA, 147 bp, Glycine max
  Peptide Sequence Number=SeqID_102266
atggaatacatatccaagcggtttgaagagcttgatgtatgtggcaaagtgactctaaagagtaaacttcaggaaattccccaccttgatctaaattctatgtgtgctcctcttgaaaaggtatgggtgaagattcatggtatttga

SEQ ID NO: 10582 - DNA, 780 bp, Glycine max
  Peptide Sequence Number=SeqID_102267
atgaggaagaagctcctcaatgttgaaggccgacaacatctgcacgtagacaacaaacaacagcaactattgctgaggatgttgaccatgtggatcatgttagtaacgaggaacgtactgagtagaacttgtactctcatgggaggaagtggtggcacaaggaaactagtagtttccatctaccttactataaccctcgatgatgtgacatccttattacatctgcccattacaggtgccctccatacctttgattctcttgatgtagaccaagccacggacttgttagttgagttgcttgaagtcaatacacaagaagcaaaagatgagacatttcaatgcagaggggcatatgttcacatagcttggctgcaagacatttattgtagcaaatgtgatgcaagacaatggaccctagtagctcgagcatacacatcactgtgccaatctggaggctattcatggggagcggctgcattggtccatatgtatgacaatctaaatgttgcgtcgaagcatacaacaaaacatcttgcaggatatatcactctgttacagatttgtagttctcctggtcagtgttcaccaaactgcatggactggttctataggatatctaatccattcatgagtctatcacaacttgagcatcctcctagacatccacctgtggtgcataatgatacatttattgtaccagatccacctgtgttacccattcattcagtagctatgccacaaccacctgcacctgagactttcaatgtagacatgccttga

SEQ ID NO: 10583 - DNA, 390 bp, Glycine max
  Peptide Sequence Number=SeqID_102268
ggtggacccttgggtacttgtacctatcaccttgagaggactacacgtcctcaccatcagagggctgcacgccctcacctccagaggactacatgtcctcgccttgagagggctacacgccctcaccttgggtactagttaccctcaccgtcagaggactacacatcctcgccttgagaggactacacgtcctcaccatcagagggctgcacgccctcacctccagaggactacatgtcctcgccttgagagggctacacgccctcaccttgggactacacgtcctcgccttgagaggactacacgtcctcaccatcagagggctgcacgccctcacctccagaggactacatgtcctcgccttgagagggctacacatcctcaccttgg

SEQ ID NO: 10584 - DNA, 201 bp, Glycine max
  Peptide Sequence Number=SeqID_102269
atgtccgggcgctcctccactcgccaatttcctagccggaaatcaggagggcatggtcgtaccaaatccgacccactcggagaatcatcttcgcatatcgcaacgacttggccttcgtgtcctagacccgcgcttataaagctcctactgatgtggcaaggcgggcctccttcgacttctcgtcccaatcgcgagccttga

SEQ ID NO: 10585 - DNA, 375 bp, Glycine max
  Peptide Sequence Number=SeqID_102270
atggtgaaagttggaacctcttacgtgcccgatcaacgtctcattttcgccaaaagttggcccagggcttcccggtatcaacagggacaccaggatttatttattctgcgaagtgattcttccgtcacagctgtccctcctgttcagctactgacggggtggtgcgtaacggcaaaagcaccgccggacatcagcgctggcaagtgtagcggtcacgctgcgcgtaaccaccacacccgcccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 10586 - DNA, 311 bp, Glycine max
  Peptide Sequence Number=SeqID_102271
ggctccccggtatcaacagggacaccaggattttatttattctgcgaagtgatcttcccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 10587 - DNA, 276 bp, Glycine max
  Peptide Sequence Number=SeqID_102272
atggtgaaagttggaacctcttacgtgccgatcaacgtctcattttcgccaaaagttggcccagggcttcccggtatcaacagggacacccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 10588 - DNA, 134 bp, Glycine max
  Peptide Sequence Number=SeqID_102273
atggatacctccgtgcgcggatcaggcggcacgaaggtgacggatggaacatgcgcgctgaaggccgggacaggcctcgacgtcagcgggtttcataccggcgagtttgcgtctgcgtggagagagagtatgac

SEQ ID NO: 10589 - DNA, 147 bp, Glycine max
  Peptide Sequence Number=SeqID_102274
atgacggtgtacacaccaccgacgttaacatactaccaaacaacgtcggtgttgtgtaacacagtgtcgttgaataccgacatcggttggaggactgtctttgaagggcgacctttctacatcggttgtgtaactcaaccgatgtag

SEQ ID NO: 10590 - DNA, 366 bp, Glycine max
  Peptide Sequence Number=SeqID_102275
atggtcatcattgtcaatgcggaagcttgtggttacgtgagcatgaactactaccaatatatagatgttgtttatacaaatgagcacatcttaaaagcttactccgcacaatggtggcctcttgggaatgaaacgactattcctccttctgatgacctatggacacttatccctgacccaactacaatttgggcgaaaggtcggccaaaatcaacaaggataaggaacgagatggattgcctcgaaccatctgagcaccgacaaaaatgtagtagatgtggagcagaagggcacaataggcgccgatatccaatgcaatttgaccgtgggagtaattcatttaatagatttatgtatgttaggtga

SEQ ID NO: 10591 - DNA, 318 bp, Glycine max
  Peptide Sequence Number=SeqID_102276
accggtcaaagccaagtccagacgagctggccaaaaggcatagggccaaggcggagctggcaggctcatctcacttattgtgtgctttgttggaatagactgacatcaagggaaagtgcactttatctcgattcctctctttctacaactctttctttccaacccactgctcagccccctccaaactatggcatcaaggtcggaccaagggtcgggcctccaccgatctactggataagggggacgacccggagaaagataagtcaaggaggacccgaagaggaaggaagagcggtcgctgagagcgaaatgaactga

SEQ ID NO: 10592 - DNA, 261 bp, Glycine max
  Peptide Sequence Number=SeqID_102277
atggaagttcttcgtcgttctttgttcgttcttcatcattcttcgatcttcaatcggtcctttaatggtgattttccaccatggagatgcagcggaagacaaaggagaagaggtgagaggaggtgtcatccactagggaataagccatggaagaaggagcttcaccaccaagatgagccttggataagaagcttggagaggatgcttcaatggaggaaaagaaagagggagagaaagagagaggggggagcacgaaattga

SEQ ID NO: 10593 - DNA, 325 bp, Glycine max
  Peptide Sequence Number=SeqID_102278
tgatcttccgtccacaggtatttattcggcgcaaagtgcgtcgggtgatgctgcccaacttactgatttagtgtatgatgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 10594 - DNA, 420 bp, Glycine max
  Peptide Sequence Number=SeqID_102279
atgtcgtcacatcggcttgatggctccataaaagaatctcatttcatatactctactgttgtccagctgctcccacgaatgaaggttcacaatcatcataggtaccaaccacacgggatatccatcatggttactgcatcccccatgtacatacacaacatacattatcacaatgacattttcaacatcaacaacatctcatctcaatgtcattatccacatcaacatcatctcatctcaatgtcattctcaacatcaacatcatctcatctcaatgacattatcaataacaacaacatcatctcatctcaatgttattctcaacatcaacatcatctcatctcaatgacattatcaacaacaacaacatcatctcatctcaatgtcattctcaacatcaacatcatctcatctcaatga

SEQ ID NO: 10595 - DNA, 351 bp, Glycine max
  Peptide Sequence Number=SeqID_102280
atgagtctggaaatcaaccagattgccttgcaccagcttatcaagcgtgatgagcaaacccttgaagtggtgctacgcgattcgttactggaacccacggcgaccgttgtggaaatgatggctgagttgcatcgcgtctacagcgccaaaaataaagcctatggtctgttcagcgaagagagtgaactggctgatagcctgcgcctgcagcgtcagggggaagaggatttcctggcgtttagccgcgcggccaccgggcgtctgcgcgacgagctggcaaaatatccgttcgccgacggcggcatcgtcctgttctgccactatcgctacctggcggtagagtatctgctg

SEQ ID NO: 10596 - DNA, 696 bp, Glycine max
  Peptide Sequence Number=SeqID_102281
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatggcaaatatatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 10597 - DNA, 652 bp, Glycine max
  Peptide Sequence Number=SeqID_102282
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctttcttctcgaataacgtcacgcgtcgccgccttggaccagccaccaccgcgccgccgtcacaccatcattgcacctccatctgtgtgcgcgaatcaatctttgaggcttcctgcgcgcgcgcgacttctccgttgcgcggtggtgttgtggcgcatagatctgttgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10598 - DNA, 448 bp, Glycine max
  Peptide Sequence Number=SeqID_102283
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagatactggccttcccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10599 - DNA, 473 bp, Glycine max
  Peptide Sequence Number=SeqID_102284
cgctggcaagtgtagcggtcacgctgcgcgtaaccaccacacccgcccgcgcttaatgcgccgctacagggcgcgtcccattcgccattcaggctgcgcaactgttgggaagggcgatcggtgcgggcctcttcgctattacgccagctggcgaaagggggatggcgaattggagctccaccgcggtggcggccgctctagaactagtggatcccccgggctgcaggaattcgatgaagtaatgggagattggggggttagggtgagtgcactgtcggaaagcttttcagtgttcgaggatcttctcctcttgaaggcgggccagaccggcggcgtgcaccagcgtcaacgactggagaacctggaattcgcgccggacgtcaggtattctttcaccgtacctttctgggttaatttgaagaagagtttggttatcaagcttatcgataccgtcgacctcgagggggggcccg

SEQ ID NO: 10600 - DNA, 234 bp, Glycine max
  Peptide Sequence Number=SeqID_102285
atgtcactacagaatgctagaaaccaaagtgaaatgcagtctacaagattttgttttaatcaagtggcagtggtcaactatgatgaggataacttcttgttgggttgtagataccatgttaagagaaaagaaaatgagagttatgacggtcatggtggtgattgcggtgacggtgacgctcgtgatagtggtggtggtcatgatgatgatgatgatgtgcttgagatattttaa

SEQ ID NO: 10601 - DNA, 312 bp, Glycine max
  Peptide Sequence Number=SeqID_102286
atgtatcctcttgatttcatgattgtcatcatcaaaaagggggagattgtggaagcaatgacttccaagattattttgatggtgccaaagaatcaagagttaagcaagttccaaagaattaggagtcaaaaagcttcaagaatcaagtttcaaagaatcaagattcaagaacattcaagtttcaagattcaaaattcaagaacaattaagtttcaagattcaagattcaagaacaatcaagtttcaagaatcaagattcaagaacaatcaagatcaagattcaagaatcaagagaagactcaatcaagataa

SEQ ID NO: 10602 - DNA, 311 bp, Glycine max
  Peptide Sequence Number=SeqID_102287
atgtcgcaaaaccttacgaattgcgcaacaatcccttctttgacttctggaatgttgcggaaatgtacagatcgcgcaacaatgtttcctttcgacttccggcatgttgcggaacttcacggattgcctaacgatgggtgtcaagtttctcaaagaggtcatgcgaaggcgcagaatgaccataatttgtctctgcgtgccatcggacacgatcgtctccgaatggcgaaaagggatgacaaaaaggcgcagaatgaccaaaacttgtctctgcgtgccatcggacacgatcgtctccgaatggcgaaaag

SEQ ID NO: 10603 - DNA, 530 bp, Glycine max
  Peptide Sequence Number=SeqID_102288
atgaaatcttacaacgttcgacagaggaagacacatctacacaggattcccctaacactgttacttctgttaatgataatgaaatatatttgaatgttgttggaggtccaaattacaaggggaacgtgtacgacctaggtactttaagcaaaaggtttagttgctcaaaattagctccatctacttctattgctcatgtggaagaccaaataaaggaaatgcgtgagacaattaataaattgaatgctgagcttttggcaaaggcaaataaggagaagacacttgaggaaaagatgttgcagatgatggagaatcatgaccaccaaagtcaggagatgcgacaacagatgcaacaacaaaatgagcaaattcgtcaacaaaatgagcaaatgcagcgtatactacaacacttgcatattcagtctatcataccagctcctagtctatcacctaccataacagatgaaacagagcaccatgttaatgatgctcaggttgatcgtcctcatgacatgggaaatgatcattga

SEQ ID NO: 10604 - DNA, 216 bp, Glycine max
  Peptide Sequence Number=SeqID_102289
atgccttcttttaggtccaatccacctcgcccgaagtggtgggtaaggcaagccctgaatctttctcaacggttcagtgctcgctccgatcaccattggatgaaccattcattggatggaggatggcccagcgaggttgtagtccatagctattctatattacgccgaagggctaagcgcgcgatcgattatttcgaatgttctcatgccgtatga

SEQ ID NO: 10605 - DNA, 390 bp, Glycine max
  Peptide Sequence Number=SeqID_102290
atgaccatgattacgccaagctcgaaattaaccctcactaaagggaacaaaagctggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10606 - DNA, 468 bp, Glycine max
  Peptide Sequence Number=SeqID_102291
atgaagctggccgccgtgcacgccatcgcggagctggcccacgccgagcagagcgaagtggttgcctcagcctatggcgatcaggatctgagctttggccctgactacatcattccaaaaccgttcgacccgcgtctgattgtcaaaattgcccctgcggtggccaaagcggcgatggattccggcgtggcgacgcgtccgattgaggatttcgacgcttacgtcgataaactcaccgagtttgtctataaaacgaacctgttcatgaagccgatcttctcccaggcgcgcgccgacgcgaagcgcgtggtgctggcggaaggggaagaggcgcgcgtgctacacgccacccaggagctgatcaccttaggtctggcgaagccgattctgattggtcgtccgagcgtgatcgaaatgcgtatccagaagctgggcctgcagattaagccgggcgtcgacttcgagatc

SEQ ID NO: 10607 - DNA, 541 bp, Glycine max
  Peptide Sequence Number=SeqID_102292
atgggcgacgcgcggccgatcctgttctttgactccggcgtgggcggcctgtcgatcgcgggaccagcgcgcgccgaagtcccgcatgcgcagttcgtctatgtcggggactcggcggggttcccgtacggcacgcggagcgaggcggagatcgcggtgcgggtgccagcgctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 10608 - DNA, 531 bp, Glycine max
  Peptide Sequence Number=SeqID_102293
atgggcccgatcggcgtgaaagcgcacctggcgccgtttgtgccgggccacagcgtcgtgcagatcgacggcgtaaccacccagcagggcgcggtctccgcggcgccgttcggcagcgcctccatcctgcctatcagctggatgtacatccgcatgatgggcgcggaaggcctgaagcaggccagccagatggcgatcttgaacgccaactacatcgctacccgcctgaaagacgcctatccgattctgtataccggccgcgatcaccgcgtggcgcacgaatgtatcctcgatattcgtccgctgaaggaagagaccggcatcagcgaaatggacatcgccaagcgcctgatcgacttcggcttccacgcgccgaccatgtcgttcccggtggcgggcacgctgatggtcgagccgaccgagtcggaaagcaaagtggagctggatcgctttatcgatgcgatgctggcgatccgcagcgagatcgaccgcgtcgccaaaggcgaatggccgctggaagacaacccgctg

SEQ ID NO: 10609 - DNA, 258 bp, Glycine max
  Peptide Sequence Number=SeqID_102294
ggggcgtgtggtttgtgctggtctttcagtaccacgagatcattggaaggagctcattatctagccactggtgagcttgggagccttagcgagcaacagcttgtggattgcgaccatgtggttagttttgtggaagcaatgccttccaaggttattttgatgatgccaaagaatcaagagttaagcaaattccaaagattcaagaatcaagattcaatattcaagaaccaactttcaagaatcaagattcaagaataa

SEQ ID NO: 10610 - DNA, 222 bp, Glycine max
  Peptide Sequence Number=SeqID_102295
ggtgcggataaccgtaaggtatctccgcgtatcatcgggcccgccctctggatgatacaagggtgcagaatgaccaaacttggtctctgcttgtcatcgggcccgccgcctctggatgacaaaaggggtcagcatgacaaagattatggggcggccgacaaaagcaaggctcttgctcctacgtatcctccaatgaggaactcagacctacgtagttcttga

SEQ ID NO: 10611 - DNA, 646 bp, Glycine max
  Peptide Sequence Number=SeqID_102296
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgaaggtgagggtatgtagccctctgaaggcgagggtacttgtacctatcacttttagaggactacacgtcctcgctaacagagggcggcacgccctcacctccagaggactacatgtcctcaccttgagagggctacacgccctcaccttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10612 - DNA, 564 bp, Glycine max
  Peptide Sequence Number=SeqID_102297
atgatcgaccctctcgatgagtcaatctcttgcattctcataagggaggacccttgggtacacgccctcaccttcagaggactacacgtcctcgccatcaaagggctgcacgccctcgtcttcacaggactacacgtcctcaccttcagaggactacacgtcctcacctttagaggactacacgtcctcaccttcataggactacacgtcctcaccttcagagggctacacaccctctccttcagaggactacacgtcctcagagagctgcatgccctcaccttcagatggttgcacatcctcgcctttagagggctacgcatcctcacttttagagggctccacatctgcaccttaagagaattaaggtcctgtgcccttaaatgcttaaccgagacttgcgctcccgattatggggccagtagtttccttttatcagttcctgggccaccccttgatattggagggcgaccaactatgcgaacacaaccagagagggaggctatcacgcagctactatacataccgaggcaagatttcacccgtgccgctgcaaagggatga

SEQ ID NO: 10613 - DNA, 594 bp, Glycine max
  Peptide Sequence Number=SeqID_102298
atgagcgttcacgtggctcagttgattgctgacgccatctatttatttgcaggtatgccacccaccaggcaccctctagacccggataagtctaacagggccctagggtttccggcattgatcacgggcctctgccaatcattcggggttcccgtcactcctagtaaggtgattcaaacgccgatcacttgggccttcattgagaagcattgcacgcctaggcaggcgcagggtgatgcacctcaggccacagacgcacagctaccacctcatcaggctgatcccactcggtcactaggcatggagcgttatctacaacacttggttcgccagcaggcgacaaaccatcgggggcaagtgcagatacatgagtgtctctaccagctcagccacagtcagcaggggcagggttttgctccttttgcgtgccctactccagagcagtttagggctgaggtcgcatggaccggagattggcccgaggcccaggcaggggaggcgcttgcaggagctcccggtgatgcagaggaggcctgtatggatgaggagatgacagacttgctcgatttcttaggaggaagtggagccacgtga

SEQ ID NO: 10614 - DNA, 477 bp, Glycine max
  Peptide Sequence Number=SeqID_102299
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataggaaagaaaattaaggttatcaaatctgatcatggggaatactatgtcgggaaacctgtcgtgccagctgcattaatgaatcggccaacgcgcggggagaggcggtttgcgtattgggcgctagcggagtgtatactggcttactatgttggcactgatgagg

SEQ ID NO: 10615 - DNA, 420 bp, Glycine max
  Peptide Sequence Number=SeqID_102300
atgtaccctccacttgaactgatccacaagagatgtaccctctcttgttctcagtataacaatccccaagtagatgtaccctctacttgtaccacaaaggatgtaccctccaatgtgttgggacaaagaattctcaggcgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 10616 - DNA, 321 bp, Glycine max
  Peptide Sequence Number=SeqID_102301
atggcttacgatacatctggacgaagatatggtcacatgacaaccaacctctcaaaatgtgtgaataaggtgttgaaggattgtcgcagcataccgataacagcgttggtcaagtcaacatatacttgtggttacgtgagcatgtactactaccaatatatagatgttgtttacacgaatgagcacatcttaaaagcatactccgcacagtggtggcctcttgggaatgaagcgacaattcctccttttgatgatgcatggacacttatccctgacccaactacaattcatgcgaaaggtcagccaaatcaacaaggataa

SEQ ID NO: 10617 - DNA, 549 bp, Glycine max
  misc_feature (546)..(546): n is a, c, g, or t
  Peptide Sequence Number=SeqID_102302
atggggacatggggttgcatcagttacaatctcgttcttgctataaagcaacttggctaccctatgagaggggcaccactagaagaagagctcgcgcctgtcatttcacgaggtttcaataagaccaacatggagatacttcagaaaatccacaaggcatgggaggtagtgcgaaagaaggacaaagaactcatgggcaataacaatgggcccatcggtggctactttgaggcaccagaggaagacgaagaggtgcaggcccttagggcagaactcgaacaagcccaaacagtcaaagaaaggttcaaattagcagctcttaagatccgaaaggagaacgccaaactaagagatataaatacggctaccaccaaggccttggaacaagagaccaaaagggctcgtagggaagagcacggccggaacaagtttcgaggggctctgtgggacagcaacagtgagcttaagctccggagagaggaaagggaccaatcacgagtagacagtttgatcttgaaagataagttgaaggtttgctcaaggtcntaa

SEQ ID NO: 10618 - DNA, 195 bp, Glycine max
  Peptide Sequence Number=SeqID_102303
atgcctaaatcatctcccaacatgcatgtgaagcaagaagtatcaacaagaatcaagtcaaggctattgtgcaagaaatcaatggggaaaaacacactgaataaaatagatgatgatggctcaaattctcaccaaggcacaatcacaagatcaagagcaatcaaaacaatcaataaatttggacaagtgcaataa

SEQ ID NO: 10619 - DNA, 62 bp, Glycine max
  Peptide Sequence Number=SeqID_102304
atggtgagtatgccacctgtcgcaacgtgtccttcgcgggcgagcgagggcgaggctcacgg

SEQ ID NO: 10620 - DNA, 405 bp, Glycine max
  Peptide Sequence Number=SeqID_102305
atgaagatgaaagccaacaaaacaagaaatgaattgaaagtctcggattcaaaaacttaccggttgaagaacgaagaatgcatgaagaatggtggaaaatcttcacgaaattgctcacggaaacgtctcggaagcgttacggaagcacctcagcttggattttcttcacagaaaacacgtttttcacccaaaacagctgaaatgcatagccaagggggttatgcaacgatgcttgcttttcctttcggaatgttgcaaaactttacggattacacaacaatgcttgttttgacttatggaatgttgcaaaactttacggattatgcaacaatgcttgttttgagggtcccgaagggaacaaacaaggttcgaaagtcaatcgcaagtgtccccggacgaaattag

SEQ ID NO: 10621 - DNA, 1137 bp, Glycine max
  Peptide Sequence Number=SeqID_102306
atggcagaaccatcgaagaagagaaagggatcatcctccaccaccgctgctgctgcccatcgccgtcacggaccatccggagcacccacaacacctattcatccttctttgtcatctctaagatcatccacattgttttcatccgatgatcagcgtctacggtacctttctcagttttcttctagaatcatcttagaccctaagtacctagacgtagaattctttaatgatgaaacgtttgattgctatcaagtgtttcaaaattctggccttgttgatttcatgtcattaaaattgccatattatcctaaacttgtaaaagtcttctactgcaatttaaaaattcaggattgcattattatttctgaggtgcatggtattcctatggtcattgatcagtcattgttcttttctttaactaatttacccagtcaaggtgcaccttttgagggcaccattgttaatgactggaaatttgattattcgagtcatgatgctcgtcgtatggtctgcaatgatcaagctgaaatgaccggtagattgctggccgggtcattaacatttgataatcgcatcatgcactatataattgttagaattttgcttcctcagtcttcaaatttagcacaagcctctgaggaggatttgattcttatgtgggcttttcttaccggtcgtcagatcgactgggcccattttgttcggtaccgaatgcataaggcattacgggccaatgcacctctcccttatccacatttgattactctgtttctgcgtcattttcaaattccgcttgatgatgaaccatttgttcaagtcaagcattcctttgcaattggtgctggggcagtaacttcctttgggtaccgtaaagatcggaatgatcaatggctgaagaaggatgcgctccttcctcaagatgaacgtactccttcacctcctcctcagcgcgatgtttcagcactcatgaatgaagtcctctccgaattacggggtcttcgttcttatgttggtgaccgtttcgactcattagatacacgctttgccagcatggacattcgcctcacacagcttgaagaggatgtaggttacattcgtcagagtttcgatcttccaccaccacctccaccttcttag

SEQ ID NO: 10622 - DNA, 685 bp, Glycine max
  Peptide Sequence Number=SeqID_102307
caaccagcaatacaacagtgcactctcactcactataagtcatgcactcactgcactcctcgctgcctcattgcgtatcaaccagcagcatcaatggccaccaccgagccaccacaatgacgacgatgaccatgtgccagcggaggacgaggacacgggagcgcaggtcgctccgatcgtgaagctcgaagaggtcgccgtctccactggtgaagaggaagaggatcccatccttgatctgaaagcgaacctgtatcggttcgataacgaagggaatgagtggaaggagcgtggtggtggaaacgttaagctgctgaaacataaggtcagcgggaaggtgaggctcgtcatgcgccaatccaagacgctctcaagatctgcgccaatcatcttggagcattctgggaatgagaaatcgtgtgtgtggcatgcttctgattttgcagatggagaattgaaggatgagctgttctgtattaggtttccctctgttgagaactgcaaggccttcatgaaaactatgcaagaagtggctgaatcacaaggagaggaggaggaaaacaaagatgcttcagctgctgccggtctcctcaagaaactaactgttggcgaggataaattggaggacaaagagccgccggaaaaggccacggataccaatgtgaaaggtgagcaggatgtatag

SEQ ID NO: 10623 - DNA, 222 bp, Glycine max
  Peptide Sequence Number=SeqID_102308
atgggtgatcgggttatggtggggattgttgtggtgtgtgatgtgaatggtggcctctgttaccaaagcatggtgtcaacttttaaaacactccaacaaaatgaccctgtcaataggggtggaaatgagccgagcagcttatcgagggcctttggctcggcttatgtaaggctcggctcggctcggcttgtttactataaaggccaagctcaagctttttaa

SEQ ID NO: 10624 - DNA, 278 bp, Glycine max
  Peptide Sequence Number=SeqID_102309
agtcagaatgcactaaccatgttgcgggaagtacatatacttctgacttgctttatgaggtacaggctgaggaaccttcctcttcttctcctaccctatttcctcccactgttcagccacaacccacactggagttgaagcccttaccagcaaacctcaagtatgcttactttgagtacaaggaaaaatttccagtgatcatctctgcctcctttgctgctgaacaaaaggagaagttgttgctagtgctcaagaagcacaagaaagctatggaatga

SEQ ID NO: 10625 - DNA, 402 bp, Glycine max
  Peptide Sequence Number=SeqID_102310
atgtgctgcaaggcgattaagttgggtaacgccagggttttcccagtcacgacgttggcgaattggagctccaccgcggtggcggccgctctagaactagtggatcccccgggctgcaggaattcgatcccgggacgtcaccggctcgaggtggagtcgtcggtcggcttcacgacctacggggagacccgcacagacgtcgacgtggcgccgggtcaggcggccgacctcttctacgccgtcccgaagtcgatggtgtccaagggagagctgggcacgacgccgcaggctcggcgcgccggcctcgacatgcggcaggtcgccgtctcgatcggtggcggtgtcgggctgatctgcctctgcggtctcatcgggggcgtgtggaagctcgtcttcggctga

SEQ ID NO: 10626 - DNA, 598 bp, Glycine max
  Peptide Sequence Number=SeqID_102311
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcaacgggaaatcagcgttgcaacggtaagctgctctcccccgcgacctaccgatcgtgcagccgaccccgtcaaaagagatgacagggttctccctgctaattggggccgggcccactacggtcagatcgcctatcagcttgaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10627 - DNA, 255 bp, Glycine max
  Peptide Sequence Number=SeqID_102312
atgagcgcccacgtggcccaggtatggcgcctactaggcaccctctggacccagataagtccaacagggccctggggtttctacgctgatcacgggcctctggcatactgcacgcctaggcaggcgcagggtgatgcacatcaggccgcagacgcactgccaccacctcggcaaaccgatccagctgggtcactgggcgtggagcattatctacagcatttggttcaccagcaggccgccaaccaccgtgggcag

SEQ ID NO: 10628 - DNA, 577 bp, Glycine max
  Peptide Sequence Number=SeqID_102313
atgaccgccagttcgaacttcggcaatgtgttctcggtgctggtggcgagcgcattcattccgttcctgccgatgctggcgattcatctgctgattcagaacctgatgtacgatctgtcacagctggcgctgccgtgggacaaaatggatcgcgagttcctgcgcaaaccacgcaaatgggacgcgcgcaacatcaaacgctttatgctgtggattgggccaacgtcgtcaatttttgacatcaccacctttgcgctaatgtgggctgctgtcgcagacgctggtggtgcacatgctgcgcacgcgcaagattccgtttatccagagccgcgcggcgctgccggtgctgctgaccaccgcctgcgtaatgattgccggcattctgctgccgttctcgccgctcggcgcgatggtcggcctggtgccgctgccatggagctatttcccgtggctgctggccacgctgctcggctactgcctggtggcgcagggcatgaaaacgctgtacatcaagcgctttggccagtggttctgagtgcaggaggcgtcatgaaacaacgcaacctggataaaacgg

SEQ ID NO: 10629 - DNA, 103 bp, Glycine max
  Peptide Sequence Number=SeqID_102314
atggaacgttacacgccattaaagcgcatgtcacctcctacacctgctgctattgcatgcttcatcaagcttatcgataccgtcgacctcgagggggggcccg

SEQ ID NO: 10630 - DNA, 180 bp, Glycine max
  Peptide Sequence Number=SeqID_102315
atggggggttttgatgttgtcgcaacctacccttttgggggtgagcgaggcgaggttcgcgggtgcgtcttccaaaggaggaaaatgcacggagtcgccaccaaggtcgacaaaagcggggctcttgctcctacgtaccctccatcgaagaggaaatcagacctacgtagttctttctaa

SEQ ID NO: 10631 - DNA, 249 bp, Glycine max
  Peptide Sequence Number=SeqID_102316
atgacctactttcacacgggaacccgcactatcatcggcgcaaagtcgtttcactgtcctgttcgggatgggaaggagtggtaccaacttgctatgggggctcaaggccccggcagatctcatcttgaaacgagtttcccgcttagatgctttcagcggttatctcttccacacttagctactcggcaatgccactggcgtgacaaccgatacaccagaggtgtgtccactccggtcctctcgtactag

SEQ ID NO: 10632 - DNA, 108 bp, Glycine max
  Peptide Sequence Number=SeqID_102317
aatttcacagatcgcaatagcccgcttccctttgatttccgacacgtctcgggacttcatttattgtgcaacaaaggacgccaagtatctcaaagcggctagcgaaag

SEQ ID NO: 10633 - DNA, 237 bp, Glycine max
  Peptide Sequence Number=SeqID_102318
atggacagccaaaccaacaatcatagcattccaaccgttgcaattgaagaatcaaaggacttatacataatacagattgaagaattacaacactctcttaaggcacatgagatgaggatcaatgagcaaagatcccatcaagaacgggcacttcatgcacgatccaataacaaagggaaagggaaaggaccatggaagggaaacaagttaaacaccaccaccaagaaccaagaataa

SEQ ID NO: 10634 - DNA, 375 bp, Glycine max
  Peptide Sequence Number=SeqID_102319
atggttagaacacgaggtttaggtcgtgcgttaggagctggtagaggtagaggcattagtgaggatacgcatgaggctgatgttcctctgcgtcgcagacctactgcttcagcacgtaggcaacgggttcgtttgcgtgaggacatgacagagagacctgaggatgtgcctcaattgcatgaggatgttccttatgtgtctaatgccaccccagagataacaggcgccgccgatgctgttcagacagagggagtggctattgatgggagcttagggtcacctactgcaaatgagggtttccccggtggaccacgcgacccatcgattttgaccgattttgttgagcatgtcgcacacagcatctggagtggacgg

SEQ ID NO: 10635 - DNA, 562 bp, Glycine max
  Peptide Sequence Number=SeqID_102320
tgcaacatatgttcatgtggtgcatctagaggcttttcgccaacagagacagagtgggggctatgcgtggggagttgcagccctggttcatatgtatgaccagttagatgaagcttctaggaccacgacatggcagattggggggtgctggatctatgagcactttccgagtgtgcatcagtgtgtcaccgatgatgcgtacgaggaaacgtcccctcgtgcctcccggtgtctgacggcgaaggctcatatgaaggaaattacaggagcatcgtaccgggcaagttgtgatgctttgacgggtcagctgagatggagtcctacagtggtcacagttcgaccgaagagggtgctacgccaatttgggtacattcagagcatccctctactgcctgttagcgcttcattgtcatatgatgatataaatgacaggtggatgcatttctcggaccacgtagtagctgcgggtgacctttgtgtagtgcttgggcaggcaggtgaccagcccagacatgcacctgccccagaccatgaggactacatgcagccggacatcccacag

SEQ ID NO: 10636 - DNA, 492 bp, Glycine max
  Peptide Sequence Number=SeqID_102321
atggtcgaatccttcacaacagcagcaacaacaacaaccttattttcagaatgctgctggcctaagcagaccatacgttcgtccaccaatccagcagcaacaacagcaacagccccagaaatagacaaacagttgaggcccctccgcaaccttccccttgaagaacttgtgatgcaaatgactatgcaaaacatgcagtttcaacaagagaccagagcctccattcagagcttaactaatcagatgggacaattggctacacagttaaatcaacaacagtcccagaattctgacagattaccttctcaatctgtccagaatcccaaaaatgtgagtgtcattgcattgaggtcgggaaagcagtgtgaatcttccactggtaattctgatttacagaagcagcatatccctcttccattccctccaagagcaatttccaacaaaaaatggaagaggcagagaaggagatattggaaacatttagaaaagtag

SEQ ID NO: 10637 - DNA, 285 bp, Glycine max
  Peptide Sequence Number=SeqID_102322
atgttgctaagtagcaatgtcatctatatctgtgtaagagtggtcatgttggtgcgcatggtccgcactcttctctttgcagcggcacgggtgaaatcttgccccagtatgcatagtagctgtgtgatagcctccctctctggttgtgctcgcatagttggccctcctccaatatcagggggtggcccaggaaccgttaaaaggaaactactggcgagggcgtgtagcctttcgaaggcgagggagtgtagtcctatgatggcaaggacgtgcaatcctctaaag

SEQ ID NO: 10638 - DNA, 327 bp, Glycine max
  Peptide Sequence Number=SeqID_102323
atgtcattccaccacctgtcacgtgacaccacacctcaacacaacacgcctcatttaatttcatatcattcacgtactcaagggtcaaagacaatatcacccaaccaatcaatatcaatcaatacacaagcgttatgcaacaaatatactaagactcaatcatatatgcaatgtggtatcatgtcagtgaaaaacctcgttgggcacccaggaggagaccagtcagggtcactctgttttacaagaacactccaaccatatggggtcaacataggcttcaaggaacattcaaaccgagtgtatttacccccaaggcctacactctga

SEQ ID NO: 10639 - DNA, 225 bp, Glycine max
  Peptide Sequence Number=SeqID_102324
atggtggtaaatggttacacaatttcaagccaagttgttgaagacaaaactatagagaaaccttttgaatcatggtctcatgaagaaattaaaaaagttaaaagtgactctaaagttggtattaacatgttctatgtgtcataccctaatttcgtccgggaacctttgctcgatgacatgcgaccattctttggtccttgtgaggtgcttggcacccatcattag

SEQ ID NO: 10640 - DNA, 375 bp, Glycine max
  Peptide Sequence Number=SeqID_102325
atgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggcacgcagagaccaagtttggtcattctgcacccatgatacgcggagataccttatggttattcgcacccattcttttgctatctgtaagacagaacgcttga

SEQ ID NO: 10641 - DNA, 339 bp, Glycine max
  Peptide Sequence Number=SeqID_102326
agggtacatctacttggggattgttatactgagaacaagagagggtacatctcttgtggatcagttcaagtggagggtacatccacttggtatttcaaagagaacaagagagggtacatctcttgtggatcagttcaagtggagggtacatccacttggtttttcaaagagaacaagggagggtacatcccttgtggatctttggcttgtaaaggattttacaaggttgaaaataaatctcaagaaccgcaagttgcttggggattggatgtaggcacagtttgtggccgaaccaataaggaattagcccacccaatccgaacaacatcatccaagtga

SEQ ID NO: 10642 - DNA, 588 bp, Glycine max
  Peptide Sequence Number=SeqID_102327
atggagaacaatgatggtttgtggtggctaatggtggctgtgggtgatggagaaagttcttggaactttagaaatggatttggaagaaagaaagaagaagaaatgatgttttccctaagctacacgaaagcaaaggctgaaatcatggacaagtgtcttgtgacgttgttgaccaaatttcgagaagatccaacggttaacaaatgctgggaatcgtttttaccaaggcagcttcatggtgttacaccttccacttcagcatcagaggcaccaataccttcttctttttcagtaccttcctcttcatccactcagattttagttattcctctagtacctctacagatgccacttctagctcctctctctgcagcatggaggagtttgatgctcaggtggcctggccaggagaccaaccctctccttcaagagggggtggagcctgtgattaaggagccacgagcaccaacaccagcagcagcagaggaggagactactcctgaggaaaccacctaccacaaacaacatattatgcaccaagttagagttactagggatgttgaagaattgatagggtttcaattctag

SEQ ID NO: 10643 - DNA, 180 bp, Glycine max
  Peptide Sequence Number=SeqID_102328
atggggtggatgggaaggattggggaacccaaccatggtgacatagttaggaagaaggtagtcagtgctaagagagagagagaggggtgtgatgttgatgtaggcagtgaggaaaaaagaaacgaaacatcgtcattggaaatcatcttcgatgatgacaacggtagtcaacgacaatag

SEQ ID NO: 10644 - DNA, 399 bp, Glycine max
  Peptide Sequence Number=SeqID_102329
atggttcggctgttgcccgagaatgagtggcaaaagaaatggtcaagacgcgaggcgaggctcacgggtgcgtcttccaaaggaggaaaatgcgcggagtcgccaccaacgtttatttgtggaaaacgtcggaaaaaccgaaggaaactggtcatgaagaatattccagattcgggagttgtatttacattcgaggaaggtattagcacctctcacggcgaatcaagcgattctttttacttggaaggtggtccttttaaggcgttggaccttaaaatgatccatttttacttggtgagaaaaactgaggaaaataggggaggagcttgccacccagctcgcccaggcgagtcaggttgcttcctccagaagcaactgccttctagaggaacatcctag

SEQ ID NO: 10645 - DNA, 447 bp, Glycine max
  Peptide Sequence Number=SeqID_102330
atgaatttgaaaagaggcttttggctgatgttattccacctagtgacattgatgttacttttgatgatattggagctcttgaaaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10646 - DNA, 396 bp, Glycine max
  Peptide Sequence Number=SeqID_102331
atgttgtgtccgggggctccactatggtatgtgcacatggcatttgagttgtaccacttggggtatgctgactggaagactttcccgggtatggccaccaccaaatggttttccaataatgagggccataactcggaatacgccatgggaataggagataactgcattttggggcgttttcatccacgttggggcggtggtgactgcatgggtatccccttcctttttccgtgtgcccaccactggggctcttctattgctgttggggccagcgttggaggcatattcaaacttgcctttcttcaatccggactcgattctttctccggcgaagacgaggtctgcaatgttggccggcatttatcctatccgcttctcgtagtagaacgtaggtag

SEQ ID NO: 10647 - DNA, 517 bp, Glycine max
  Peptide Sequence Number=SeqID_102332
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataataatcgagataaagaaagagctcaagaatattacaaaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10648 - DNA, 102 bp, Glycine max
  Peptide Sequence Number=SeqID_102333
atggttactatggataagtggatggatataactgagatgggatatgttattgcatcaaggaattgtcatcctcgggcaaaggagtggccaactccatattag

SEQ ID NO: 10649 - DNA, 336 bp, Glycine max
  Peptide Sequence Number=SeqID_102334
atgaagcacttcactgacaccctcatcagtgccaacataagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagccctgaatggcgaatgggacgcgccctgtagcggcgcattaagcgcggcgggtgtggtggttacgcgcagcgtgaccgctaacacttgccagcgctga

SEQ ID NO: 10650 - DNA, 589 bp, Glycine max
  Peptide Sequence Number=SeqID_102335
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgtccatccttcacaagctgctaaccaagttttagccgatgcattgattttacaaggcatagcccttatcacttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10651 - DNA, 669 bp, Glycine max
  Peptide Sequence Number=SeqID_102336
atgaagcacttcactgacaccctcatcagtgccaacatactggtaccgggccccccctcgaggtcgacggtatcgataagcttgatcgctgggcagcaccaagaaaaaccccaggtgcgcagccgacggcaacgaactcttgcggttccactgcaccaccttaacgtgcgcactgggtgcacgtggctcttcctccctctgcgcctccgtacccggctgcagcgtctgcaccatcatcaggcacggtttccaaggcgggtgcggcggcggtggagaccacgcgagggcgaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10652 - DNA, 240 bp, Glycine max
  Peptide Sequence Number=SeqID_102337
atgataataaccaagaagttgtacccacttcttgcaatgaacccaaatgcggttagtcttttaagtccaatgataacaaccaagaagttatacccacttcttgcaatgaacccaaaagcggttagtcttttgagtctagtgatcaaccaagaagcaaatcctgcttcttgcaatgagcccaaaagagtcaccaagagtaggtctcttgaaaagctaaaggaggagaggaaaatagaatag

SEQ ID NO: 10653 - DNA, 391 bp, Glycine max
  Peptide Sequence Number=SeqID_102338
atggcaacgtgtatcattgataggaagaaggacttacagaaggaggaagaggagtttcaagatggcatgaggatagttcttctagatcggccaccaccgcgatggagctccaattcgccctatagtgagtcgtattacaattcactggccgtcgttttacaacgtcgtgactgggaaaaccctggcgttacccaacttaatcgccttgcagcacatccccctttcgccagctggcgtaatatcgaagaggcccgcaccgatcgcccttccccacagttgcgcagcctgaatggcgaatgggacgcgccctgtagcggcgcattaagcgcgggcgggtgtggtggttacgcgcagcgtgaccgctacacttggccaacgctgatgtccggcg

SEQ ID NO: 10654 - DNA, 195 bp, Glycine max
  Peptide Sequence Number=SeqID_102339
atgatgcttggcagctgcaaaggacctacttcatttgaggatatcaggactgttgcgaatatccaatatccaacatatagagaagcatgtgccatgagcaaacctgaagaagtttggaatcaatgttggcattggctagctgatgacattgcatatcaatatactaaatcaacaatcaacttaggtaggctgtaa

SEQ ID NO: 10655 - DNA, 137 bp, Glycine max
  Peptide Sequence Number=SeqID_102340
atgcctaaatcatctcccaacatgcatatgaaccaagaagtatcaacaagagtcaagccaaggctattgtgcaagcaatcaatggggcaaagcacaccgagtaaaataagcaatgatggctcaaaatctcaccaatg

SEQ ID NO: 10656 - DNA, 153 bp, Glycine max
  Peptide Sequence Number=SeqID_102341
atggcttacactcacattccggattcacaagctattctcctcaaatttcagccagcccgcatcaattggaccttgcaccttatgcttcaaagccctacaatgctcaatggaatgccccggaattcctgcatgatatgcacatgtcgcgtttga

SEQ ID NO: 10657 - DNA, 620 bp, Glycine max
  Peptide Sequence Number=SeqID_102342
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgaataatgttctgcacttcagttccttcctaaagcacaaaacattattcaacaacctcaccaatagcatcaggacagcggtaataggaccagtagcaacaacaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10658 - DNA, 384 bp, Glycine max
  Peptide Sequence Number=SeqID_102343
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtggggtggttacgcgcagcgtgaccgctacacttgccagcgctgatgtcccggcg

SEQ ID NO: 10659 - DNA, 429 bp, Glycine max
  Peptide Sequence Number=SeqID_102344
tgcaaagcaaggaaccattcggtgtttcgatcaggaagacaaaagacaccaagaaaggagggcaaaagggtcttctccttatttttcctaggccccagctcgcccaggccagcatttggctcgcctgggccaccagataacttcaaggctaagggactagctttcctgggcgagctcactacttcaaggttaagtttcagctcgcctaggcgagttgcaaccgccccaaggtggccttttgatgaggacatggcaaagactaagggcaaggaacctttagaaggaattggacgacctatgacaagtgctagaacaaagaaggccaaggaagctcttcaacaagtgttaaccatgctatttgaatttaggcccaagttacaagtggagaaacttcagattgtcaattgcaccatgttccaagaagagtag

SEQ ID NO: 10660 - DNA, 409 bp, Glycine max
  Peptide Sequence Number=SeqID_102345
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 10661 - DNA, 87 bp, Glycine max
  Peptide Sequence Number=SeqID_102346
atggaagagggatatgaggctgcgcccgggggatccactagttctagagcggccgccaccgcggtggagctccaattcgccctatag

SEQ ID NO: 10662 - DNA, 444 bp, Glycine max
  Peptide Sequence Number=SeqID_102347
atgttagtagctactaaaaaggagaccaaagcctatatgcgatacaaccaaaagagtaagaagaactaccttgccatagccttcgacgccttgttccgaaaccatagctccaagcctactactacgagtcatcagcctttttggtgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10663 - DNA, 309 bp, Glycine max
  Peptide Sequence Number=SeqID_102348
atgaggcttcactgttatcaagcgagtcggagacccagcatgaccacaaatcaacctccactccttatggctcatatagacccgggtatagggcctaatatctcaacgtgtgtgcgaggtgtaggtgccagtgtaagcgaaaagccaaaagagcgtcttccaaaaaggaaaacacgtgggagtcaccaccaacatttattcgaagaaaatgttaggaaaccaaaaagagatctacgaatattgaaaagaaggttcaggagttgtttacgcatggggaagcctgaagtactaaacctcgatcccttgtaa

SEQ ID NO: 10664 - DNA, 204 bp, Glycine max
  Peptide Sequence Number=SeqID_102349
atgcaggaaatggcaacgaaaaagctttccgcgaagaggtctaggagagacgccgcggctgaagggaccagtgccgcccccgagtttgatagccaccatttctggagcgccgagcaccagcaacgcttcgaggccatcaaaggatggtcgttccacagagagaggcgcgtccagctcagggaggatgagtacacagatttttag

SEQ ID NO: 10665 - DNA, 240 bp, Glycine max
  Peptide Sequence Number=SeqID_102350
atgagggttcaccgttatcaagcaagtcggagacctagcatgaccacagattcacctccactccttatgttccatggacccagtggagtcgccaactgtcgcaacctacccttcggcgggagggcggcgcaagactcatgggtgcgtcttccaagaaaggaaaatgcacagagtcgccaccaacgtttattcgaggaaaacgtcggaaaaatcggaaaaggtgtagtctacgaactttaa

SEQ ID NO: 10666 - DNA, 1491 bp, Glycine max
  Peptide Sequence Number=SeqID_102351
atgaaggacaacacacagaaattacagcatgaagtggcagaggtggtgtcctttgagcattttcctgcagagagttctccagataatgtgagcaatgcagagatgagtacgacatcaacgccagtgaccaacgaagatagaagccatgcgattgccgttgcagcagcaactgccgcagctgcagaagctgctgtggtggctgctcaagcagctgcaagagttgtaagattggcaggaagttacgggcggcagtccaaggaagaaagagcagcaacactcattcaatcatactatagaggctacctggctcgacgtgcactacgagcattgaagggattagtgaggctgcaagcactggtgaggggacacaatgtgcggaagcaagcgcagatgacgatgcggtgcatgcaagcactggtgagggtgcaggcacgagtacgggctcgccgattccaattgagtcacgcggatcaggaaagagagaagaaagaagagcccaagcccatacccgtgcccgtgcccatgagccccctgagaagaatagacgacattaatgactgggacaataggcgtcaaagtagctacaaaattaaggaaaacgatttgcggaaacatgaagctgtaatgaagagagagagagctcttgcatacgctttcaactatcaacagaaaaagcagcctcgggaacggcagtgtttgggaattaagagtttggacttaggaagcagatttatcaaacgatgggggtggagaaggcataatttggtggcattcagtggtgggcacgggagcagaaggaagcgtagatgtagtgtttgggaatccagaaatttgatgttgcatagtactactaaaagagagaggcaccaacaacaaaagcaatttttgcagccagactggaatggtaatgatgatgtaggaacaaactatgagcatgaaaaagcccaatggggttggaactggttggagcgttggatgtcatcccaaccatacaatgtcaggaacatggggccacatgagacctcttacatgactcttgcttctacaacatcaactaccactgataacatgtctgagaagaccgtagaaatggacatggttgcaactccaggcccaaccaacactagaaatgtcagtcccatgaaccaagactttgttgatttaagcccagtttctaataggcaccgtcacatacctcccagcccaaatagacctagctatatgaccccaactcagtctgcaaaggccaaggttcgagcccaaggcccatccaagcctcgagtttcagttgggcagtggaacttctcaacaaagggaggttcgactggtgactcatctagctcgggaggacgaattgtcgcttaccaatttccaaggagcccaggcccaaaaattaatggcattcggtcacagtctaaaaggattgtgggtagcagtccagattacactgaagattggacccttccactcggagcccatggctgggcataa

SEQ ID NO: 10667 - DNA, 420 bp, Glycine max
  Peptide Sequence Number=SeqID_102352
atgacattgaccatcccagagcttttcttgaggccttaccaggttacatgggatgccaccgtgttcggggtctttaatccaaattttccactctacataaagcacgaagacctctccaaaatcgcacacggtggtcaatgtctcagcatatcagtgttacagttgtcgattctgcatctcactgaaacaagtatgcgagcgggaaattttgatatctatggattcctcgagccacagtccattcagaggtctgggcaattgcagtttgagtctgaaagttacataaagacttggatgcagagtttaaaacgcgatgtctatcttggagcctacctaaatgggccagacaactaccttagggggattattaacagtggacatagtattatctccgagttagagatcagacctaggatttag

SEQ ID NO: 10668 - DNA, 426 bp, Glycine max
  Peptide Sequence Number=SeqID_102353
atgtatgctagtaaaccacatgtggtggttgttaggtcatgtgtgggacttgatgtccatgtttttggcttcataagggatgaaatgtcaagcctaacgccgactccttcattctacattgacgccatcaagacattgtgggagcatgatgacgcgctccatgtggaccacttctacaggttcctctattgccgctatgtgccggtggaggcgttcctcgttttaacatttggtcactttcgcaactcgaagaaaactaggaaaggaaagagtcccagaaagggtgggaatcgattttggaagtccattgtggttggctttaagactcccagggaagccatcgaaggtgatttcttcgtcttctttagtcgttgtcaaggtttgttgttgattgtgttctgtgtgctggttagtgatcagtgctga

SEQ ID NO: 10669 - DNA, 93 bp, Glycine max
  Peptide Sequence Number=SeqID_102354
atgggaatacttgtttatgattatgtggttgacactgctgcctctgttcaaacaagagagagcatcaatgagttcttgacaagtgttaaatag

SEQ ID NO: 10670 - DNA, 126 bp, Glycine max
  Peptide Sequence Number=SeqID_102355
atgaaggaagtggtgaataaggtccagtcgttaagccgtcgagtcggaaacgacgtaaacatagctgctcgcccgtgtgccggatggttcaacgaccaagcgtatatcgtgttgtgttcgagcgag

SEQ ID NO: 10671 - DNA, 360 bp, Glycine max
  Peptide Sequence Number=SeqID_102356
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctcaaacccattgtgctaaggtttaacaagcttagcataatggggttgggaaaagttaagagtgggatggttaaaacacccaaaactatgaag

SEQ ID NO: 10672 - DNA, 48 bp, Glycine max
  Peptide Sequence Number=SeqID_102357
atggttgaaactagccaattaaacactaaaagaggtgtgaaagataag

SEQ ID NO: 10673 - DNA, 305 bp, Glycine max
  Peptide Sequence Number=SeqID_102358
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccaaaaatcaaaaatcgtagtgacaaatccaagcaacagggatacatgatcgcaattcatctttag

SEQ ID NO: 10674 - DNA, 225 bp, Glycine max
  Peptide Sequence Number=SeqID_102359
gttaatcgcgttccacgagccggaaagcagcattataaacgtgaactcgtcgccgagcatggccaagcggctgtcttcaatattgcagccgcagctgctgacgtggcgagtgattgtgtttacgatgccggggcggtctgcgcccagagcgcaccaaacgtaacattgagaatcttgtcccacttctgctctgaggatggcccatgttcacgggaagtattgtag

SEQ ID NO: 10675 - DNA, 492 bp, Glycine max
  Peptide Sequence Number=SeqID_102360
atgaacggcggaccttggaatgaccggtggatcaatacgaccaccgtaccaaaattgcgtgaacagtttagtctggcatataaaagcggcatcgaccgtatctggatcgttaacgtaggtgaccttaagccgaaggaaatgtccatcgattttattatgcgctatgcctggaatcccgatgccatatcagctgatcaaacctctgactatatgacagattgggtaattggaattttcggaaaagaacatgccgcggaaattgcagagctggtatcaagatactcaaaatataatctgatgcgcaagcccgaggatcttaccgccaaagcggaagcattagagaaaaaaatacttaaagaagcattggatgcttattatcagttagtgctttatcctgttaaagcatcagctggtgtggcagaaatttatctggcagcaggacgtaataacctctacgctaaacaaacacaccagctgggagaaatagtctaa

SEQ ID NO: 10676 - DNA, 186 bp, Glycine max
  Peptide Sequence Number=SeqID_102361
gctgaatgtgatatccctgaagcatctgatgtaaggataaaaaagaaaatacttcagactatgggggagtggtggagacaatttaagtctgatttgacgtccaaatgggcacttgcagccgacaaggacagtgtcgatgacactgtatgcaaaaagtacgacattagcaaggagaagtgtgcctaa

SEQ ID NO: 10677 - DNA, 177 bp, Glycine max
  Peptide Sequence Number=SeqID_102362
atggtttccggggctttcgtcgcttccgtaaaatttccgaaaaccttggataggggtgtaaatagcaattcgagtctaggcccttggaagttgggttgcttaaggaggaagcaactaggcggcaagctccaccacgtttttgaaaaatggtttccggggcttccgtggcttccgtaa

SEQ ID NO: 10678 - DNA, 193 bp, Glycine max
  Peptide Sequence Number=SeqID_102363
atgacgagtgcggataactgtaaggtgtctccgcatgctactggactctcgggtcactggatagcaaagggtgtgtgcggggcttttgctcctacgtatcctcaatttgtgatgaggaactcagacctacgtagttcttgcgaaagcggtgcggataaccgtaaggtgtcttcgcatgctaccggactctcgg

SEQ ID NO: 10679 - DNA, 75 bp, Glycine max
  Peptide Sequence Number=SeqID_102364
atgaagaaagagtatcccaagtatgccgcatggcgtgtgaagaaagggttacctgtggagccgaccgccaagtaa

SEQ ID NO: 10680 - DNA, 287 bp, Glycine max
  Peptide Sequence Number=SeqID_102365
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattggcatggttattgttacattgaaatatttctctggacctgatgtacccaaatatgtgttcttcaccgttgcatacacatggttctgctccctctccatcatcatcctcgtccctgctgatatatggacg

SEQ ID NO: 10681 - DNA, 287 bp, Glycine max
  Peptide Sequence Number=SeqID_102366
atgaagcactcaaatgatcaacaggcctgttgtgatggggaaaaggtggaacaggagatagaattagcagctacaaccatgatactgcagtcccctttggaaaaagcattgaataatcatgtcgaatgtctgaccaaggaagaggaagaagaaatgcgggcttgtattgaagagttagatggtgcaggggaaaagtctgttggacatacaatgtttgaagaattgaagggcagcaggccaacggaaaaacccaaagtagaattgaagactctgcctgtacacttaaa

SEQ ID NO: 10682 - DNA, 120 bp, Glycine max
  Peptide Sequence Number=SeqID_102367
atgtggaagcaggaaaaggcaaatgacgaaaaagggctagggaggagaatagggcactgtttgcatagggaaatcagaaatcacatgcatgcatggcagcttagagagctaggcatctag

SEQ ID NO: 10683 - DNA, 228 bp, Glycine max
  Peptide Sequence Number=SeqID_102368
atggtgtatggtacatttagagaagcatgttttgcaaaaggctttctaggtagtgatcaagaacttattggtgctttacaaaaagctaatagttggggcactgcatactgcctcaaaattatttgtcaagcttttatttatgaacaccatggacagaccagaatatgtttggcaataaacatgacaatggatggtatccaacttattgaaaaagaaacaatccattaa

SEQ ID NO: 10684 - DNA, 704 bp, Glycine max
  Peptide Sequence Number=SeqID_102369
catcactttgccttcacgcgcggcacgtcactaatacgcgtggtgtaagccggggagagcatgtcgcgtttcatcgcccagggtttctggatcccctgaccggcaaaccacaaggcaccgcgctggtgggcgttgatcttatccatcagcgccatcagctgatcgctgttacggcgcggctgatagtcagcaaacagatcaagctgcgccaccccgtcgctgaaaaagtcgcccagcattacgccgcctttcaggtagcgcttgccggggatccagatgcgatccagacagttgagcgtggcctgaataatgtcgcggctgtcggcggtaggggtaatcagcgtctggctggcggcattggcatagtagggctgatgcggatcgtgcgggctggtgcggataaaggtgccgatgtagcggcaatactggcgctcgctgcgcagtttctccgccgcgcgtgccgcatagctggcgatggcttcacgcatatcctgatagtcggtaatgcgatcgccaaacgagcgcgagcagaggatattttgccggtgcggaatcacctcttcaaatgccaggcacggttcgccgcgcagctcgcgcacggtgcgctccagcaccacgccgaaatgcttgcgaatcagcgcagtgggcgtctccgccagttgcagagcggtttgaatgcccatcaggttcagcttgttagataa

SEQ ID NO: 10685 - DNA, 721 bp, Glycine max
  Peptide Sequence Number=SeqID_102370
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaccccattaaccgtcacaccacaaggagaatacaacgtgagagtcagctccataagaatcaaccagcacagtgtgttcccaccgaacaagatatcatcaaccatcgtagggtcttctggaggaacaatgattagcacctcaactcctcacatggttctccagcaatctttgtatcaggctttcactcaggtgtttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10686 - DNA, 192 bp, Glycine max
  Peptide Sequence Number=SeqID_102371
gtagcagatcctcctacaccagtacgggagagacaagcaaatcctcctacacctatgatggagatgccagaagaccctaccatgccaatcctaagactttcatccactccttcaattaccccagttctacatctgacagatgaggaggatatgcaagaccaggacacacaagaccagtcacaggaattctaa

SEQ ID NO: 10687 - DNA, 267 bp, Glycine max
  Peptide Sequence Number=SeqID_102372
atggtggtcacaattcgatacttcaaaggctgctccagaacaagtcaagaactaaagtcgcaacttgcagcattcttagcaagctcaaaatctaaagagagtcttgcccagaatctcaaagaagttctccaactacttcaacaggaagcgaaagaagaacctcccaagaaggaagccgaatcaccggagactaacgatgaccaagaagatgatccattctaccagaatgaagatgactgttttggtatatcgttagacgacgattaa

SEQ ID NO: 10688 - DNA, 243 bp, Glycine max
  Peptide Sequence Number=SeqID_102373
atgacatctccttttagtagaatccgaaacacccccttagccctttatgttttgacaaggaagcttgcgtttggagtgaaaaacatgaatgagagaggtctcggagcgacgcaaagaggaactgacatagagcttacgatagcggaatggagaaggaagaaagacgattggagatgccacttcaaggagaagatgagtcaacaacaagctcaccaccataagaagctatggataacaccttga

SEQ ID NO: 10689 - DNA, 421 bp, Glycine max
  Peptide Sequence Number=SeqID_102374
gtcgactctagaggatcccacacctgcacaaattgagctagagtctcttccagcttcgtggatggttcctccattgtccttgatgttggttgtattgatgtccatgttggaatccgggaaatccacctgcattaaaattgtttctaggctggttccccatataattgacttcataatagcaatgtcacttttcaatgagatccatgacttctttagaggtcttcaacttgattttccccctacaaaggcgtccaacaactgcttggattgtggtcttaacccatctataaaaatgttaagcttgatcggttctgagaatcctttctcaataatccacagaatctttctaaggcctcactcagagattcatctggaaattggtgaaaagaagagatggcagctttgcgttccgcagtcttag

SEQ ID NO: 10690 - DNA, 789 bp, Glycine max
  Peptide Sequence Number=SeqID_102375
atgagaggaaggcataggtcacatcttagacctcactcccataggagagaaaaggagcgaaagcctcaagaggctaacattaacctcccatacttccatgggaaggacaatgtagaggcttacttagattgggaaataagggtagagcaacaacttaaaaggaagtctagttcaaaatattatggctctcactcttatccaaagaaagaccaaggtcaaggcatcttaggggcagcaccatctatgcccaatgatgataagggtgagacaatagaaaagcaaccccttaaggctagtatgcaagagaagactaactcaataaagtgctttaaatgtcttggaagaggacacattacttctcaatgccccaccaagaaaaccatgatcgtgaggggccaaaacatttatagtagccaagatgaggctactacttcaccttcctccaatgaaagagaagaaatctatccccaagaagcaagacaacctttaatgtctcctccaagagacattgaagaaactttccctcttagacaacctccacatcttctcctttgtaaaaagacacttgttagcactgttacacctcttgggcttgaggttattcctcaagtaaaggagttgttggatgagggtttggtccgaaagagcttaaatccttatactttgttggtgcctaaaataggtgttgaggaaataagcctagagtttcaagaacatcttaatttgaggtcaaatccttttcaagggggaggggatgatgcaatcctacctcccaagggcattggatag

SEQ ID NO: 10691 - DNA, 531 bp, Glycine max
  Peptide Sequence Number=SeqID_102376
atgaccttatttgtctctgcgtgtcaacgggcttgcttgcctctggttgacgaaggggagactaaagtagtctcggaaaatgaggactttgagtcctataatggcgaggactttgagttctctaaaggcgaggactttgagccctctaaaggcgaggtctttgagtcctctgaaggcgaggactttgagtcctctaagatgaggactttgagccctgtaaaggtgaggactttgagtcctctgaaggcgagaactttgaattctctaaaggcgagaactttgcatcctctgaaggcaataactttgagtcctttgatggtaaggactttgagccctctaaaggcaagaactttgagtcctctcatggcgaggactttgagccctatgaaagatcaagcgaggtatttgagtcctacaaaagatcaagtgaggaatttgtgtcgtacgaaagcaaagatagaggactttgagccctatgaaagcataaagcaaaggacgttgagtcctacgaaacaagccaatgggtactag

SEQ ID NO: 10692 - DNA, 641 bp, Glycine max
  Peptide Sequence Number=SeqID_102377
atgggaaaccagcctagacaaatttttaatgcaggtggattttttggatttcaacatggccaagcttaccaacaacataatcaatggagaactcaccttggtaatcacttcaacaaagaccagggtggaccatctaacaggccacaacaacaagggtctagcttatatgagagaacaacaaagctagaagaaactcttgctcagtttatgcaggtgtcattgactaatcataagagcacagagtcagccatcaaaaatctagaggtaaccatggaggaggagaagaagaaggagaaaatggtggatgatgacaaacaacagctgaggattcttccacctaagcacaaagatcctaggagtgtgactatttcgtgtgcaattggtgaagtttctattggcaaggctcttattgatttgggagccaaaatagaagaggactctgagattcccttaatcttaggacgccccttcatgttgactacaagttgtgtagtagacataggaaagaaaaagctggatttaggcattgatagtcagaaaatcagcttcgacttgtttgatgaagaaaaacatttgtcggaccaaaatgtctccttaaaggtgaaggagtatgaaaaagaggttttgatggagggaaccaa

SEQ ID NO: 10693 - DNA, 183 bp, Glycine max
  Peptide Sequence Number=SeqID_102378
atgtacaatttcaggcttagcgcagcattggcgccatgcccaaatccacttactcgtgctaagcgcgacagtggcgctaagcgctatttcagagcctatttaaagcctaaattgtcagaattaaggcatgatcatcacaagaaggacatcacagcaaggaatcaacaacaaggagccatttga

SEQ ID NO: 10694 - DNA, 930 bp, Glycine max
  Peptide Sequence Number=SeqID_102379
atggcttctaggaagagaaaggcccctgcctcaggatctcaggcccaatttgaccgattaagattcacatctcaggaggcctgggatcgctattctgatattgtgattggtaggaagatcttgcctgagagaaatgtcatgatatatcataaagaatttgatgagttcaaggctaagctcgagagaaggaattggcacaaggagctgaccaatttcatggatggaagcattgatgttgcaatcgttaaggaaggtcacttgatcaactttgatgcagatgctttgaatacttttctgaagacccatgtgatcatagaggaaggggaagagctacctttatactccagattctatcgtctaaggccagatccacaggaactagcagcccgattatgcatccctgggaggggatttgagctaaatgcagatgggctaccgttgaagatcgtgaggaagaatctaaccactctcgctcaaacatggagcattctttcattctccaacctggcccctacttctcacacttatgacatcacactggatagggccaggttgatctacgacatcatccagaagatggacatgaacatggggtatattatctcaagtcagatttctatgattgcacaacatgactcctcgaggttgggtttccctgccctcatcactactttatgcaaggccaggggagtcacttcatattcaatatcttttgagagtctcagtctagccattaatttaccttacgtgaagaaaaactattggaacctcgatgacccctcagtcactttcagagggcctcgtaaggccaaggggaagagatcaaagactctcccattatctgagatttccccatcaacagctccttctactacaattccagcttcttctgccccatcttcatttcacccttaccagctcctattatag

SEQ ID NO: 10695 - DNA, 477 bp, Glycine max
  Peptide Sequence Number=SeqID_102380
atgatagaaccttctatgttaataaaaattcatcttgatactaaaaaccaacttgcagacatcttcacaaaaccactaaccaaagattctttctacaccattagaaaagaattaggacttctagatgcaaaagttgtcatcatcaaaaagggggagattgtagaagcaaagcttcatggtgaatcaagagtaattcaaagatgttttgatgataacaaagatgatgccaaaggtgatgacaaaaagctcaaaggtcaatcaaagaatgagttcaagatgttcaagatagaatcaagaacacttcaagattcaagaggaaagttgaattcaagaatcaagattcaagattcaagagatcaaggttcaagactcaagattcaagaatcaagaaaaggctattcaagaatcaagaaaaagcttaatcaagataagtatgaaaagcttaatcaagatcaaagagtttttactctctggtaa

SEQ ID NO: 10696 - DNA, 420 bp, Glycine max
  Peptide Sequence Number=SeqID_102381
atgacagaaggatatactggaagcgatcttaagcaagagaggctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10697 - DNA, 492 bp, Glycine max
  misc_feature (22)..(22): n is a, c, g, or t
  Peptide Sequence Number=SeqID_102382
atgaagcacttcactgacaccntcatcagtgccaacatagaaacagctatgaccatgattacgccaagctcgaaattaaccctcactaaagggaacaaaagctggtaccgggccccccctcgaggtcgacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10698 - DNA, 234 bp, Glycine max
  Peptide Sequence Number=SeqID_102383
atggacacccgtctccgtgtgattggtgatcccatgaatggagttcaacggagcaagagcattggtgttcataaggttcggggatcctttcgctgcacacgatcggaaccaacgggttgtcgtatcttgggagaggagcgcaatcagaatttcttacccgtgcagtgggggcgttttctctctaaggatagcgtttacgcgcttcaacccaggctatttaattctttcccttga

SEQ ID NO: 10699 - DNA, 264 bp, Glycine max
  Peptide Sequence Number=SeqID_102384
atgacatgcggggttaccttatggtttccccgcacctttcgtcaaccaggggcaaatgagcccattaacgcctggagattaaatcatcttctgcacgttttatcgtccctactcgtgaagtcaggtgacatgcggggttaccttatgggttaccttatggttacctgcagctttggtcaaccaggggcaaacgagcccgttggcgcgcggagactaacatcatcttctgcacgttttgtcgtcctgacccgtgaagtccggtga

SEQ ID NO: 10700 - DNA, 833 bp, Glycine max
  Peptide Sequence Number=SeqID_102385
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgcttgggaacgagtgggagagcagtccatcgtaaccagggcatcgaggacactgaagaaccctcctgcaacgaagccgactcccgaccatccctgacgtccgaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10701 - DNA, 219 bp, Glycine max
  Peptide Sequence Number=SeqID_102386
atgcgtagtgattgcttagtgcaattctccattctcaacctttttcggagccgcatgaatttcgttttcgttcatgtgtcctccatcttcgagtttggagccatgcgtagtgattgcttagtgcaattctccattctcattctttttcggagcccaatgaattgcgttttcgttcatgcgtcctccacccaagagtttggagctatgcttcattattga

SEQ ID NO: 10702 - DNA, 444 bp, Glycine max
  Peptide Sequence Number=SeqID_102387
atgaccatgattacgccaagctcgaaattaaccctcactaaagggaacaaaagctggaaaaatacaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10703 - DNA, 92 bp, Glycine max
  Peptide Sequence Number=SeqID_102388
atgagtttctggggtgagagtgagacactgtttgtttatccacgtgtatgtgtcatgtggacaggaggtggcatcactggaattggttcacg

SEQ ID NO: 10704 - DNA, 231 bp, Glycine max
  Peptide Sequence Number=SeqID_102389
atgggggagacacatgaaattccccaccacaatctagccgacttcgaaccttgcctcggatatgccactgaagggaaagcatttggtggtatacccctgcaaaacactttggagagccctcagtatcacccacaaccacaccccttgcattccacagcgggtaaaaaccctcatgctatggcagaaacgggagaaattggatcatatagaggaaaggctcagggccattga

SEQ ID NO: 10705 - DNA, 199 bp, Glycine max
  Peptide Sequence Number=SeqID_102390
tcgtaacaaggtagccgtactggaaggtgcggctggatcacctccttttcagggagagctaatgcttgttgggaaagagagggatggggtttctcttgcttttggcatagcgggccccggcgggaggcccgcacgacgggctattagctcagtggtagagcgcgcccctgataattgcgtcgttgtgcctggactgtga

SEQ ID NO: 10706 - DNA, 417 bp, Glycine max
  Peptide Sequence Number=SeqID_102391
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccggtacgcaccaccccgtctgtag

SEQ ID NO: 10707 - DNA, 130 bp, Glycine max
  Peptide Sequence Number=SeqID_102392
atggtaggtctggaaggcaaagaattgggaggtacgagcggccctcatttagcgcaaaaaaccaagcttgccttcccaccatatggcttgcctcccaactatacaccacccaatgcggcgtacactcccg

SEQ ID NO: 10708 - DNA, 554 bp, Glycine max
  Peptide Sequence Number=SeqID_102393
atcgcgtgcacttcggccaccagcgcgccggcttcggccaccaggaagcggcccggttcgatctccaggcgcacctcgtggcccaggcgctgttcgatgcgtttgcgggccgcgtcccattgctcgaagtagtggtcgcagtcgatgcgcggctcgccttcgcgatacggaatcgacaggccgccgccggccgagatggcctcgatgtcgtggtccagcgaggcgaccacgtcgaccatcgcgtcgcacacgctggacaggtggccgtagtccacgcccgagccgatgtgcatgtggatgccgaccagcttcaggccgtagcggcgcacgatgccgatggcggcggcgacgtcgtcgatccagatgccgtgcttgctctgcgggccgccggtgttggtcttgttgctgtggccgtggccgaagcccgggttgatgcgcagccacacgcggtgccccggcgcgtgctggccgacgcgttcgagcatgtcgagcgagccggcattgaccgtgatgccgtgcttgacgacggtggccagggtggcgtggtcgatcag

SEQ ID NO: 10709 - DNA, 498 bp, Glycine max
  Peptide Sequence Number=SeqID_102394
atgttagggggccggcggaaatacccaagtggttatccgtataaacattcttttgctatctctaagactgaacgcatgataccatgcaaaaacaaatgtcgtcttctgcaccatttgtcaatcgcggccaacaagcccgttcacttgcggagatttacatcgtcttccgcgcttacaaactttgtcgagacaaacgtcgtcttctgcaccctttgtcaatcacggccaacaagcccgtatccaagcggagatttacgtcgtctttcgcgcaaacaacctctccaatacaaactcgtgatgtcagggggccggcggaaatacccaagtggttatctgtataaacattcttttgctatctctaagactcaactcatgataccatgcaaaaacaaatgtcgtcttttgcgccctttgtcaatcgcagccaagaagcccgttcacttgcggagatttacgtcgtcttccgcacttacaaactctgccggtactaactcgtga

SEQ ID NO: 10710 - DNA, 204 bp, Glycine max
  Peptide Sequence Number=SeqID_102395
atggatcaagatcgacatcaagcctttagcaaggtgtatgggaaaattagggatttggccatgatagaagtgtccgttgaagccattgcatccctcgctcaatactatgaccagttgtcataccctaattttgtccggggaccattgtttgatggcatgcaaccttcgcttgaccgcttcgaggaacttgacacccatcgttaa

SEQ ID NO: 10711 - DNA, 144 bp, Glycine max
  Peptide Sequence Number=SeqID_102396
atgacgatcttggacttggagaaaaatgaatcgcatgaagacaatacaagtggaggtttcaatttcttctccgtctctctgacgtttgggaattctatcggaacagtcggaggaataactgaaggaatctcaggggactgctag

SEQ ID NO: 10712 - DNA, 186 bp, Glycine max
  Peptide Sequence Number=SeqID_102397
atggcatgcacgaaccgatatgggaagatgacatctgaggcggcaagacaaattgctgataaaattgacttgttggaagaacaagtgacacagggtgagtttgtcccccagggtcatcaagatatacttaacatggccatagggagaccaaatcatggaggtcgtgttcgtgtagctgggtctggg

SEQ ID NO: 10713 - DNA, 346 bp, Glycine max
  Peptide Sequence Number=SeqID_102398
atggcggtggttgcggtgccgtcaaagcccgaccttaaaagcgtatgtttcaacgtcgttgctgatgtcaacaacgtcttcaaaggcgaagcttcaactacgactgtgacgtcagccccatcgcaggaatcacatccttctaaaacggtgtttagtgaccatgatagattggtcggaggcctgttgaatgatggtggcaccggtcgagctacctcaaaactagaagctggtagtttaggtggacgcgcagaacgacattgccgccctatgcacgcaataggggtctcaggatgcgctggatcaggagacgctgggataatgctagggtcgtcactaagcgttgaag

SEQ ID NO: 10714 - DNA, 273 bp, Glycine max
  Peptide Sequence Number=SeqID_102399
atgggcggatattcagccgacaaggacagtgtcaatgacactttatgcgaaaaatacggcattagcaaggagaaatgggcccaattttgtcagagccgcagagacccctcgtgggaggatgtgcggaaaaaggcacaggccatccaaaagcaaaacactatcccccacgtcttgtcttgtggaggttatgaatatttagaagataagctgatggatgagaaaacaaagaaaaactggaggaagctgctcaatccggaagcactgaggcagtga

SEQ ID NO: 10715 - DNA, 534 bp, Glycine max
  Peptide Sequence Number=SeqID_102400
atggcatctaagaaaaggaaggctctttctacacctacccaggccagatttgatagatcttggttcacatctcaagaagcttgggagagatatacaaatattgtggtgcccaggaaactattaccggagaggaatgtggtagtttattacaccgaatttgacgagttcaaggaggaactcgagagaagacactgggatgagaagttaactgattttgctgacagtaacatagacattgcttgtgtgaaggaattttatgccaacctctatgaccccgaggataaatcaccgaagcaggtgagggtgagagtgacatttagagggccaaggaaggccatgggtaagagatcagaggtccccactacttcaacagcaccagagacaacaactccttcttcttccacaactcctgtacctcccattcagactctagctattcctcctacatctacacaaataccacttccagctcctttatctgcaggactttcagatttttcatttacaccacagatgcttcattccatgctctag

SEQ ID NO: 10716 - DNA, 465 bp, Glycine max
  Peptide Sequence Number=SeqID_102401
atgggagagccgaccacgaaaaagacttcttcgaactctctctccccgagaaagggaactcggggggaaaaagaagaaaccggagaggcaatcgcagcctcgttcgacacgtcggtacaggctataaaatccgtgccaagtcgtgaaagaattagacgcgcgtgcaagccgtatgatgggaaaactatcatgtacggttacgagagaggtgcactagaggcgcaaaagaaatccaaaattggccccacccgagtatgccacgtcgcattccagattatccagatgcttacgctggatggaatgcttttagtagtttcggctctggccaccctaaccagtgaaaacaagtgtgcttcaagtccttgggctgttgaacagaattcaacgacacttgaatggatggtcaaaagccctccggcatttcacactttttcagaacttccggttatcaaggaaagcatttag

SEQ ID NO: 10717 - DNA, 489 bp, Glycine max
  Peptide Sequence Number=SeqID_102402
atgaagcacttcactgacaccctcatcagtgccaacatatggctaggtgtgaagtttagtagggttgctggcaagttgttgaaatccaatggttggatggttatgttagtgacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10718 - DNA, 462 bp, Glycine max
  Peptide Sequence Number=SeqID_102403
atgattctttggcttaaaatcatttgctcatttgttcgtatagctaaccagtggatagtattgtgggactatcaactaaatggtagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10719 - DNA, 414 bp, Glycine max
  Peptide Sequence Number=SeqID_102404
atggtggaggccatgatgagcatgaagaagataatggaagccaaagcggttacagttgctgctaccagcattgttgctaaggtgaacccgatgcccccatctggccttaaccaaatgaatcatccaacctcagatatggtaggcaaagatttgggaagtagggacgacccccatgatgtgcaaattcaaaacaagcacgccttcccgccatatggcctgcctcccaactgtacaccacccaatgtggcgtacactcccagtgagaatacacatgaaattccccaccacaatctagccgactccgagccttgcctcggatatgccactggagggcaagcagttggtggtatacccatgccaaacactttggaggcccctcagtttcgcccacaaccacaacccttgcattttgcg

SEQ ID NO: 10720 - DNA, 783 bp, Glycine max
  Peptide Sequence Number=SeqID_102405
atggggacaaatcaaatcggaaaaagattctatcaagtcaagattaagggcctagatgtcaccagccttaaggagttgggatggttgatgggacccctccagatgcaagccttccgcaaggcgtacggaaagattttagatttgaccatagcagagtatgaccagccattgagatgcttcacgtttggggacttccaaatagtaccaactgttgaagaatttgatgagattctaggatgtcctcttgggggaagaaaatcgtatcttttctccgggtttcttccctccttgagcaagattgcagctgtggtcagggattcggcgagagagttggatcgtataaagcaaactcgaaacggcgtagtgggcctaccgcggaagtacttggaaggcaaggcaagggatatggcgaatcaagaggaatgggtcccgtttgcggacatactagctttgctaatctttggggttgtcctctttccaaacgtggacggtttggtggacctggccgcgattgatgctttccttgcatatcaccatagcaaggagagtccggtggtagctatcttggcggacttatttgatacatttgaccgaaggtgtgagaagaacagcgcacggattgtctactgcttacccgctctttgtgtgtggttggtttcgcacctattccaacaagacataaggcacccatgtccgctccaatgttatcgctcgtgtgtcgaaaagagaagagtagattgggaccaatacttggctgggataggaggcagaacaatcaactga

SEQ ID NO: 10721 - DNA, 282 bp, Glycine max
  Peptide Sequence Number=SeqID_102406
atggggactttactgaagacactattaagtcttgtggatgtgtgtattgaattgattgatggtgaggatgagagtaatccgagagagaaaccagaagagactacaactataagagatgatgcattgcggtggttgacaatgttaaggcttggagggattgatggaaacccggtgctaagaggaacgaggagaagaactacagtggtacctgaggatatatcgcgagggtcaggagaccttggggacgttaggtggggtgctattgcccaaaaccaagcttga

SEQ ID NO: 10722 - DNA, 540 bp, Glycine max
  Peptide Sequence Number=SeqID_102407
atggcttctaggaaaagaaaggcaccctctacacctacccaagtcagatttgacagatccagattcacttcccaagaggcttgggaaagatacacagatgttattgtgcctaggaagctttttcctgagaggaacgtggttgtttatgccatggagcttgatgaattcttagatgagctggcgagacgccactgggatgaggaattgactgatttcattgacggaagcatcgatgttgccattgtgaaggagttctatgccaacctctatgacctcgaggacaaatcacctaagcaggtgagggtgagaggtcatttgattaagtttgatgaggacactcttaacactttcttgaagacccctgttattgtggaagaggaggaatcactctgtgcttattctagatttgcactcctgaggcctgatcctcaggagttagctaccaagctctgtatccaagggaggggattcaagcttaatgcttatggatacctagtgaagattctgaggaagaacatgactacactagctcagacgtga

SEQ ID NO: 10723 - DNA, 601 bp, Glycine max
  Peptide Sequence Number=SeqID_102408
cgataccctgcgtgaacggctgtacacgccgaagaatgaactcggcgatctgcctgcggtgccggtcaaactggtgcatatcaataaatgtccggtcctggcgaaggcgaatacgctgcgcccggaagatgctgacaggctgggcattaaccgccagcactgcctcgataatctcaaagtgctgcgtgaaaatccgcaggtgcgcgagaaagtcgtggccatttttgccgaagccgagccgttcgtgccgtctgaaaacgtggacgcccagctctataacggtttcttcagtgatgccgatcgcgcggccatgaatatcgttctgcaaaccgagccgcgcaacttaccggcgctggatatcaccttcgctgataagcgcatcgaaaagctgatgtttaattaccgcgcgcgtaattacccgggaaccctggatgaagcagagcaggaacgctggctgcagcaccgtcgtaacgtgtttacgccagaatatctgcacagctacgcccaggagctggaaatgctttatggccagtatgaagggaatgctgagaaacaggcactgctgaaatccctgtaccagtacgcgcaagagatagtttga

SEQ ID NO: 10724 - DNA, 219 bp, Glycine max
  Peptide Sequence Number=SeqID_102409
atgccgatgtgtatggatttcttgagccacagtccatccagagatctgggcaatcacaaatttgaatcaaaaagttacatgaagaactggatgcaaaattcaaaacgggatgtgtacctaagagcctacctgaatggtgctttgaaaggacttaacgatatgtcacaacctaaatccaaggttggtgctaggtggattgttgttaaaactaatttgtag

SEQ ID NO: 10725 - DNA, 314 bp, Glycine max
  Peptide Sequence Number=SeqID_102410
atggctgactcaatggatgactactcaacgattgaagaacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10726 - DNA, 240 bp, Glycine max
  Peptide Sequence Number=SeqID_102411
atgagggctgacatggaggccatgaaagagaaaatgaccacaatgatggaagccatgatgagtatgagaaggatgatagaggtcaatgcggctacagttgttgccgcaagtaccgccatagaagtggacccgactcagccacctaacttcaatcaagtaaatcatctagcctcggatatggtaggccagggaggcaaagagttaggaagtgcgggtggcccctatattgtgcaagtttag

SEQ ID NO: 10727 - DNA, 673 bp, Glycine max
  Peptide Sequence Number=SeqID_102412
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcccccagtgcttctaatctcagagcctctgcacccagctctcctgtgcacactcctccccagtcaagttcctcgcggcttccctcccctccttgaagctctatgcagctttaagttctttaagcatggactgttcatgaagccttctcctgccctgcgacctcatccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10728 - DNA, 398 bp, Glycine max
  Peptide Sequence Number=SeqID_102413
gctgcgcaactgttgggaagggcgatcggcgcgggcctcttcgttattacgccagctggcgaaagggggatgtgaagcaaggcgaggcgaattggagctccaccgcggtggcggccgctctagaactagtggatcccccgggctgcaggaattcgatccatgaatcttcatccatacccacatgcaataacttccttattggatgtggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcatga

SEQ ID NO: 10729 - DNA, 129 bp, Glycine max
  Peptide Sequence Number=SeqID_102414
atgtgggtttcaaatggggtaggaaataagaagaggcctttgctgccctcaaacatagggctttacaaacttggcagcattacctattacccaaagagtttgtcatccatagtgatcacgagtccttaa

SEQ ID NO: 10730 - DNA, 624 bp, Glycine max
  Peptide Sequence Number=SeqID_102415
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatctcctcactatgcaaaggcacaacttcaccgctgtgccagggcttgccctctcagacaaactgttaaccataacaaaattcacaagccagatgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 10731 - DNA, 246 bp, Glycine max
  misc_feature (241)..(241): n is a, c, g, or t
  Peptide Sequence Number=SeqID_102416
atgacacagtcagacattcacagagatgaacatcagataccaactaacaccacacaggatgatcaatttgtcggcgatgacaactcagattccaccgataatgatgtaaatatgacacaggaaaacattaatatagaatactcatcaaatgacccaacaatagatgatcttgatgattatgatgaacaaacttttctatctgcctcatctgcataccaaaatacaggtttgattttccaantataa

SEQ ID NO: 10732 - DNA, 429 bp, Glycine max
  Peptide Sequence Number=SeqID_102417
atgaagcacttcactgacaccctcatcagtgccaacatatatgattgttcaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10733 - DNA, 344 bp, Glycine max
  Peptide Sequence Number=SeqID_102418
atgaagaagcttcaggacaaagtcgccctcataaccggcgcatctaaaggcattggtgcggcgattgcccgccagctggccgccgacggcgcaaagatcgtcgtcaactatgccgcggataaaaacggggcggataaggtggtcgccgctattgaggccgccggtggcacggcggtggcgctggcagcggatgtcaccgatcagccgcaggttgaggcactcattcaatctaccctcgcgcagtttggccggctggacatcgtggtgaacaatgccggtgtgtatcagtttgcgaagattgaagagagcagcgaagcgctgtatcgcaagcagttgacatcaat

SEQ ID NO: 10734 - DNA, 618 bp, Glycine max
  Peptide Sequence Number=SeqID_102419
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtgcatcaccctgcgcctagacaggcacagggtgatgcaccgcaggccgcagacgcactgccaccacctcatcacgctgatccagctgggtcatttggcatggagcggtatttacaacacttggttcgccagcaggcggccaaccacagggggcagttcagggcggaggtcgcatggcctagagattggcctgaggcccaggcaggggaggcgcccgcagaggctcccggcgatgcggaggaggcccgcatggatgaggagatgacagatttactcggtttcttgggagggaatggagccacgtga

SEQ ID NO: 10735 - DNA, 765 bp, Glycine max
  Peptide Sequence Number=SeqID_102420
atgtttcacgtttggggacttccaaatagtaccgactgtgaagaatttgaggagattttaggatgccctcttgggggaagaaaaccgtatcttttctccgggtttcttccctccttgagcaagattgctgctgtggtcagagattcggcgagagagttggatcgtatgaagcaaactcgaaacggcgtagtgggcctaccgcggaaatacttggaaggcaaggcaagggatatggcgaatcaaaaagagtgggtctcgtttgccgatatactagctttgctaatctttgggattgtcctctttccaaacgtggacggtttggtggacctagccgcaattgatgctttccttgcatatcaccatagcaaggagagcccggtggtagctatcttggcagacttatttgatacatttgaccgaaggtgcgagaagaacagcgcatggattgtctgctgcttacccgctctttgtgtgtggttggtttcgcacctattccaacgagacataaggcacccgtgtccgcttgaaagttatcgctcgtgcgtcaaaaagagaagagtagattgggaccaatacttggctgggataggaggcaacacaatcaactggtttcctcgatggaaggaaggaaaggagggagttctcttctcatgtaaggactacccaaacgttccgttgatagggacgaggggttgtattaactataatcccacacttgctataagacagttagggtaccccatagagagcctctcgcctttcctt

SEQ ID NO: 10736 - DNA, 169 bp, Glycine max
  Peptide Sequence Number=SeqID_102421
atccgacgacgagtcccgcgaaggtactaataccggggacccggccatagatttcgagcaagaagcgagtcggacagaggatgaagaagacgaagatgtggggcttcccctagagctagaaagaataattgctcggcagaatcgagagatgaggccgcatccagaatag

SEQ ID NO: 10737 - DNA, 432 bp, Glycine max
  Peptide Sequence Number=SeqID_102422
atggaactcggcctcaagtgggaggcgttaaatggcaacttctccaatgtgctcttgggcatcacatttaggcttgagccgttgttgatgagtactttggctataacgtgttccatgcatttgaccaacacatgtaaagccctattatgtcctctcccctcggcgaggatttcttcttcagcgaaggtgagaggaactcgctggcctcctcgagtgatacctctttcttgctgcaaccctctctcccctcggcaaattccttcattgaacctcctcgtccggtgcggggatcaccttgacattttgtgcttcggttacttttgttttccctttagcgtttgcgggctgcgttggcaggctagggggtgcgaacacgcgaccgttgcgggttatgccgctcagcccagtgatgttggttactttggccgatag

SEQ ID NO: 10738 - DNA, 383 bp, Glycine max
  Peptide Sequence Number=SeqID_102423
acccggataagtctagcagggccctgggatttccggcattgatcaggggcctctgccagtccttcggagttcccgtcaccccgagtaaagtaatccgactaccgatcacccaggccttcatcgagaagtattgcacgcctaggcaggcacagggtgatgcacctcaggccgcagacgcgccgccaccacctcatcaggccgatcccgctggatcactaggcatggagcattatctacaacacttggtcgcatggcccgaagatttgcccgaggcccaggcaggggaggagcccataggatcccctggtgaggcaaaggaggcccgtatggatgaagaaatgacgaacttgcatggtttcttaggaggaagcggagccatgtga

SEQ ID NO: 10739 - DNA, 462 bp, Glycine max
  Peptide Sequence Number=SeqID_102424
atgaccatgattacgccaagctcgaaattaaccctcactaaagggaacaaaagctggtaccgggccccccctcgaggagcaagggcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10740 - DNA, 189 bp, Glycine max
  Peptide Sequence Number=SeqID_102425
atggcgagggctactactagtgccgggcctccatcccccacctactacctacttgatgaaacaacttggaggggccaagcgtgccgcaaggtcaacgacgatgagtacacatacatagttgttacttccaatacaggactgaacgaatgtgtcttcttgccgctgcactactggtgtggaatgatgtga

SEQ ID NO: 10741 - DNA, 723 bp, Glycine max
  Peptide Sequence Number=SeqID_102426
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaggatgagatgacgaagcctcgacctccgaccacgcgtttggctaaagacgttaaagaaacgctcataggaggcaacctacttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10742 - DNA, 183 bp, Glycine max
  Peptide Sequence Number=SeqID_102427
atgccaaaagatagggggacttgtcttgattttagggattgtcatcatcaaaaagggggagattgtagacaaatgatcaagctgaatgttttgatgatgccaaaggttcacatgcgtctcaaagctttattcaagacaaagaaattaaagatattcaagatggatgatcaagacagtctctag

SEQ ID NO: 10743 - DNA, 239 bp, Glycine max
  Peptide Sequence Number=SeqID_102428
atgtcgttgacaatctcccatgcttcctccacgaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10744 - DNA, 117 bp, Glycine max
  Peptide Sequence Number=SeqID_102429
atgtcaaatgagtttcagaaaaatagggcaattttacaaggtagcatcgctcaagcagggtatagggcactcaggccagctcaaacagaggagaagatgaaatttttcaaaagataa

SEQ ID NO: 10745 - DNA, 390 bp, Glycine max
  Peptide Sequence Number=SeqID_102430
atggttgaagatattaaaaaatctgctgagcagaagatgcaaaagtctttggaggcattgaaaacagatttggctaaagtacgtacagggcgtgcacatgcgggtttgctggatcacgtgatggttgagtactatggttccatggtggcagtaaatcaggtggcgaacgtgaatttaggtgatgcgcgtacgattaacgtgcagccttatgaaaaaaatatgatcgctaaagtggaaaaagcgatccgcgatagcgacttaggcttgaatcctgccacgaatggtgacttgattcgggtaccgatgccgatgctgactgaagagcgtcgccgcgacctgaccaagattgtacgtaacgaaggtgagggcgccaaagtagcgatccgcaat

SEQ ID NO: 10746 - DNA, 336 bp, Glycine max
  Peptide Sequence Number=SeqID_102431
atggtggtcattgtgcccaaggaacacctaattgtctggttttgttcattgcataataggtcagacaactaccttaaggggataattaatagtgctttaaaaggtcttaatcaaaggctcttgctaggaggattgtcgtcaagacaaaaaggaagtaccgagtgcggctactatgtcatgcactggatgttcaccatcattttaggaagttttaggaataactgggaagcgtattttaacgatcctagaccattggagccagagagattaaaggtgttgtggatgcagtgggcacagtattatctccgagttagagatcagacacctaggatttag

SEQ ID NO: 10747 - DNA, 357 bp, Glycine max
  Peptide Sequence Number=SeqID_102432
atggctttaactaacctggaggagactttaactcagtttatgcaggtaacaatgtcaaatcataaaagcactgagtcagcactgaagaaccttgaggtccaggtgggacaactagccaagcagatagctaacaagtcatctaatagttttgtggcaaatacagaaaagaatcccaaggaggaatgcaaagttgtgatgacaaggagtaaaaggtttgtcgaggatgaggatgaggagagtgttgtgcataagaagaaaactgctgaaaagaaaggtactgatggcaagaaaaatgaggaaactggaaataaccatgcccttcggagaagctttacagcaaatgccactctactctaa

SEQ ID NO: 10748 - DNA, 378 bp, Glycine max
  Peptide Sequence Number=SeqID_102433
atgaggcaggtcatggcatcctttagccagcttcagtcacagatgcaatctcagggacctcctgagcctttggttggtcctggtccctccgaagcagatcctgcccgcctggttgccgtagggagagtttatgagggattcactcttgttcataacactcctttgttgcctggccaagtaaaggtgagtgtggacgaggttaaagatgcagatgctgcagttcctgtacccactgctgaggtttccttagtggggcaggcacttcacacatttcttgcttggccgacacatgtgatcaagtctttatcaaaccagttgtgtctccgccaaaaccacctccgaagcccgatccggaggtcgatgatccgctttatctga

SEQ ID NO: 10749 - DNA, 549 bp, Glycine max
  Peptide Sequence Number=SeqID_102434
atgactagagacaatccatctgacttacaaccctttgatcctgagatagataggacatttcatagattagttagacatcattttataccttttgagcatcctcagcattctgttactgaagagtctgtgcattctgttattggtgattttgaacatcctgattttgagcattataattttgaacattctgattctaaacattctgagaacatggcacaacctccaccccgtgagaggactctaagggaaatggctgcacctggtttctcctacgaaagcttgtgcatccaataccctgatgaggatgtctcatatgttcttcaaactggactgatctatttgcttccaaagtttcatggccttgcaagtgaagatccacacaaacacctgaaagaattccatattgtctactccaccatcaaaccaccagatgtccaggaggatcacatatttcataaggcctttcctcattctttagagggagtggcaaaggactggctatattacctttctccaaggtccatcacgagctgggatgacctcaaaaga

SEQ ID NO: 10750 - DNA, 591 bp, Glycine max
  misc_feature (582)..(582): n is a, c, g, or t
  Peptide Sequence Number=SeqID_102435
atgacaccttcgaccgaagatgtgaagaaagcaatgcaaggattgtttgttgtactccaactctctatgtggggctggtttcacacctttttctccaagaaggtaggcccgtctatccgctacaaggaaggaagaatcaggattctatcttcatgtgaaggatgtcccatgagaagagtgccatcagacgaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgagagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaagctaaatctaacggcgactcangagcaaagg

SEQ ID NO: 10751 - DNA, 588 bp, Glycine max
  Peptide Sequence Number=SeqID_102436
cctgactggaacggagttctcgcatgtctgggaaggagatgtgttcccttcaggagatcttccctgatcctcaaatacgagtatattgcgccattgaacaaggctaagtggcgctgccccaagcacaacaaattttcacaaggaacccgccctatgaaacttaatatcaatggcaaggaaaccgaacttaatgtcagtgatgacatgcccatcttatgggcgatccgcgatattgcaggactgacaggtaccaagtttggttgtggtatggcccaatgtggcgcctgtaccgtgcacctggatggtcaggccatccgttcgtgcgtaacaccagtcagtgcggcggtgggtaaaaaaatcaccaccattgaatccatgcaggaagacaaagttggtcaggccgtacaggctgcctggcaacatattgatgtggttcagtgcggttattgccaatctggccagatcatgtcggccacctcattacttaagcagaatcccaaacccagcgatgccgatattgatgccgccatgagtggcaatatctgtcgttgtgggacctatcaacggatacttggcagtcattcatga

SEQ ID NO: 10752 - DNA, 255 bp, Glycine max
  Peptide Sequence Number=SeqID_102437
atgttggtggcgactccgcgtgtattcctttcttggaacacgcacccgcgagtcacgcgtcgccctcctgccgaagggcaccctatggacccggataagtccaacagggccctgggatttccagctttgatcataggactctgccagtcgttcgaagtccccgtcgcacctagtaaggtgattcggccacccatcacccgggcttttattgagaagtattgcacacagagacatgctcagggtcatgcaccatag

SEQ ID NO: 10753 - DNA, 237 bp, Glycine max
  Peptide Sequence Number=SeqID_102438
atgtccaaatgtcctaggtgtagggcgtcacggtacaaagtgaaggatgatgaagacaacaattcagatgaaaactcaaagaagggccctccaacgaaggtgttcccaccaaaccagtctcagaaaaacgacgatctcgaacccgttcaccgttggatcgtcgtgaaatttgagtatcatgttcgcaacacaattccaagcattctcaccgttgggaatttcgatatcatgtcttaa

SEQ ID NO: 10754 - DNA, 342 bp, Glycine max
  Peptide Sequence Number=SeqID_102439
atggcgatttttattgtgctgactggcggaattggcctcgcgaagttccatcatcctgtcgaactattgccggttatcggcacgattgtcagtacctgggcgctattctgctgtaaagggctgaccatgcgctgcgtaatgtggttttcaacgtgttgctgggtgattcacaacttctgggcggggtcgataggcggcacgatgattgagggtagttttctgcttatgaatggcctgaatatcattcgtttctggcggatgcagaaaagatcaagcttatcgataccgtcgacctcgagggggggcccggtaccagcttttgttccctttagtgagggttaa

SEQ ID NO: 10755 - DNA, 335 bp, Glycine max
  Peptide Sequence Number=SeqID_102440
gtgctccagtggcttctgtttctatcagctgtccctcctgttcagctactgacggggtggtgcgtaacggcaaaagcaccgccggacatcagccgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 10756 - DNA, 213 bp, Glycine max
  Peptide Sequence Number=SeqID_102441
atggatgaccctagggctgcaaactcgtcaatcccgtgggtatggcttttgaaaggggggaaaagaacgacgttctccgcttgcttagtgtggagaaaggggcgacgatcagccggtcgtgaccccatcctcacttgcatccgttcctgtgtacctgcaagtaagaaacaacctggtgtggccaatctcgaccgcatcgctgtcttaccttga

SEQ ID NO: 10757 - DNA, 138 bp, Glycine max
  Peptide Sequence Number=SeqID_102442
atggaggcttgggggctgctgctttcgtggttcccgatactaggctgccttgcagcgacgttctctgtttgtccagtgtcgggaagggatgacgatcggttggtcgtgaccctatccttcatttgcgtccgttcctaa

SEQ ID NO: 10758 - DNA, 375 bp, Glycine max
  Peptide Sequence Number=SeqID_102443
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctctaatgagataaccaaaaggcatctcaagaagcttgggatgagatatgttgatcatgaatggattatggccggagagccaccactagcagcaaacatggaccaaatggaagaagaagaagaagaagaaaaagctcaacaagagcctgcacatcaatggaaccgttttgagtctcttatcaagcttatcgataccgtcgacctcgagggggggcccg

SEQ ID NO: 10759 - DNA, 231 bp, Glycine max
  Peptide Sequence Number=SeqID_102444
atggccccgaggaaacttgcctcaaagagatccaggaaagataaagcggccgaaggaactagttccgctcccgaggacgatgagtataccgatttccaggaggagatagttcgccggcggtgggcatcactggttacccctatggccaagtttgatccagacatagtcctcgaattttatgccaatgcttggcctacggaggaaggcgtgcgagatatgaggtcttggtaa

SEQ ID NO: 10760 - DNA, 348 bp, Glycine max
  Peptide Sequence Number=SeqID_102445
atggcggcacaactaatccatgaccgagtggagatggagtgcctagagggagcttgggagaccctcgaaggcaatgcgaggtgccgatttcgaggcacgattcgattcatggctacttcattgccagtccaagtgatcgaggtgacgtcatccgaggaagaccctgaggaggatcctgaggagctacctcctgagcctgctgtggatgctcttgactttctagagggtgatgaggacccactccctgaggtggattctcccgaggacatcatgtcggcatctgaggcagactctacggaggatagtggccctggagagatggcgatcagtggaggctcttcatcatag

SEQ ID NO: 10761 - DNA, 321 bp, Glycine max
  Peptide Sequence Number=SeqID_102446
atggatcaattacgtaataatgtgaatgctaggtcgttgcccggaagcaacgcgctgtatggctcgagtacagtgtcaaaagagaggattcgctttggtacatggaatataggcacacttactggaacatctatggaaatagtggatgttatggtgaggaggaagatcaattttatctgcctacaagaaactaagtggacaagtgaaaaagcgaaagaattagacaactcgggatttaagttgtggtatacgggaaaaatcagatcaagaaatggggtagggattattgtggacaaggagtggaagaaggatgtcgtagat

SEQ ID NO: 10762 - DNA, 360 bp, Glycine max
  Peptide Sequence Number=SeqID_102447
atgaaatttttttcctgtgaccatcactgcgtgtttgacatacatttcataccaccactagagcggcaaacttgtggcagacagaggcattcatccagaaagcatatttggactgttcgatttactcaggaaatgctggatgctcctgaacccctgcagtttatcaattttacttttttctatctccaaaaactgccgcgttgtacagaagttcctcttaaagcttgcggtcaccacatgactgtcttaaggcgatctggtcctccattgcaatggaaagttgaaaccctgaatcctgctattggtggaaaaggcgttgttcaaccatggtatgattttcttgaagaaaatggactttga

SEQ ID NO: 10763 - DNA, 413 bp, Glycine max
  Peptide Sequence Number=SeqID_102448
gctcacttggttaggtaccgaatacttaaggcattacggaccaatgcacctctcccttatcctcaattggtcactctatttctctgtcattttcaaattccttttgatgacgaaccttttgttcaagtcaagcgttcctttgctataggtgctagtgcaatcacttcatttggttaccgtaaggatcgtaatggtcaatggctgaagaaggatgcactccctccacaagatgagcgtactccttctcctcctcctcagcgcgacgattccttagccattatgactaaagttctttcagagttacagggtctccgcacatatgttggtgaacgattcgattccttggatggtcgctttgaaggcatggatacccgcatcacccagcttgaagaagatgtgacttatcttcgtcg

SEQ ID NO: 10764 - DNA, 710 bp, Glycine max
  Peptide Sequence Number=SeqID_102449
atggggacaaggggttgcatcagctacaatctcgttcttgctataagacaacttggctatcctatgagaggagcaccactagaggaagagatcgtgcctgtcatttcacaaggtttcaaagagaccaatgtggagacacttcagaaggtccgcaaggcatgggaggtgttgcaaaagaaagacaaggaactcagaggcagtaacaatgggcccatcagtgactaccgtgagtggttgaaagcccacgtgcaaggtttggattggctcccaagtctaagaaccactaaaagggaggaagatgaggcaccggaggaagacgaagaggtgcaggcccttaggacagaactcaagcaagctcaaacagtcaaagaaagggcccgtagggaagaacatggccgaaacaagttccgaggggctctgtggggcagtaacagcgaacttaaactccgaagagaagaaagggaccaatcgcgagtagacggtttgatcttgaaagatgaattgaaggcttgctcgaggtccaagagaagtttgtctcagcggttgtgcgagacagagaccaacatgttagctatcatcaccaagtatcaagaagaactaagcctagccacagcccacgagcatagggtggcggatgagtatgcccaagtgtacgcagagaaggaggctagaggaagggtgatcgactcgttacaccaagaggcaaccat

SEQ ID NO: 10765 - DNA, 276 bp, Glycine max
  Peptide Sequence Number=SeqID_102450
atggcccgcacgaagaagacaagggagatgacgactgaggccgcaaaggaaatcgttaagaagattgattcgtttgaggagcaggccacacagggatcgttcgtcccccatggacgtcaggatgttctggccgctgctattggacgtccagagcaccctggacgtgtctgtgctgctagagtcggtgtaccatcaagcaatattttgggatcggctccacggacgtcgtacagcgcttcctccctgcctcctaacgaattacagcagttgacttag

SEQ ID NO: 10766 - DNA, 592 bp, Glycine max
  Peptide Sequence Number=SeqID_102451
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatcaagtgaggaagaatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10767 - DNA, 630 bp, Glycine max
  Peptide Sequence Number=SeqID_102452
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10768 - DNA, 438 bp, Glycine max
  Peptide Sequence Number=SeqID_102453
atggccccgaggaagcttgcctcaaagaggtccaggaaggacaaggcggccgaaggaactagttccgccccggagtacgacagtcactgctttaggagcgttgtacaccagcagcgcttcgaagccatcaagggatggtcgtttctccgggagcgacgcgtccagctcagggacgacgagtatactgatttccaggaggaaatagggcgccggcggtgggcaccactggttactcccatggccaatggatcccgttcgatgccgatcgctatcagccagctcctgggatatccgatggtattggaagagggccaggaatgcgagtatggccagaggaggaaccgggaggcgagtgcgaatcatgcgcaccaatatgaccaccctgacccagatatggatgacgttgctcctcagcaacatcctgcccaccgatcataa

SEQ ID NO: 10769 - DNA, 751 bp, Glycine max
  Peptide Sequence Number=SeqID_102454
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttcactagttgtagttggactctacccattcccttactcggacagccagagcactactatagatctatcccggacatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctgggagatgccaggaagatacttaacagggaa

SEQ ID NO: 10770 - DNA, 459 bp, Glycine max
  Peptide Sequence Number=SeqID_102455
atggcctccatcattgcgtccatttgctcttttcatggcctccatgtcggccttcgtctactcttgtacctcctcctctttacccattactctagctctagcacgggttcgattttcaacgtggtccatgacatctccgtcaaggtgaaactggaagtaacagggacatcgatagccctaaatgtgtttggcagtagacgaagcaatgatgtaacacgatccatcttttgccccaattttttttgcaagatggttacttccatacttcaacttgacttgatgaaccttttcgtaaaagcacgagcttggttcaaccccataacccaagaaatggcaattttgatcgccaatacttcatcaaaaattcatagagatgaaagactcgagaattcgcatgctatgcaaggaaaatgtaattatgagattgagatgcccgaagaaacatcctttcttagttaa

SEQ ID NO: 10771 - DNA, 141 bp, Glycine max
  Peptide Sequence Number=SeqID_102456
atggacccaaagagaatggtcattcctgagtggcctactccaccaagtataagggaaatttggggcttcaatatcttaacaaatttttacaaaaaggtgttgaggaaagaatccatgagtttcaaaaacctctggatttga

SEQ ID NO: 10772 - DNA, 243 bp, Glycine max
  Peptide Sequence Number=SeqID_102457
atgacgtgcgaccattctttggtcctcgtgaggtgcttggcacccatcattaggcaatttgtgaaattccaggacatgccgaaaaaaaaccaaaaaatattgatgcacaatccgcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 10773 - DNA, 288 bp, Glycine max
  Peptide Sequence Number=SeqID_102458
atggctccgaaaaagctttccacgaagaggtcgagaagagacaccacagcggaagggtttagtgctacccccgagtttgatagccaccgtttccggagcaccgagcaccagcagtgcttcgaggccatcataggatggtcgttccacaaagagaggagcgtccagctcggggaggatgagtatacagattttcaggaggagatagctcgcaggcattggacgtcgctggtgactcccatggctaagtttgaccctgagatagtcctggagttctatgctaatgcttag

SEQ ID NO: 10774 - DNA, 357 bp, Glycine max
  Peptide Sequence Number=SeqID_102459
atggcgctggaacacaatctgcagctgcagcgtctggcagcggaacgccacgacagccaggcgtttctggcgctcgacgatgagtttcaccggttgattgccgaaggcattgactgcctgctggcgtgggagacggtggagaacattaaagcgacgatggaccgcgtgcgctttctgacgctgagcgaagtgtcgccgccggagagcctgattcagcagcacgaagagatttttgccgcgctgaaagcgcaagatgccgatgcggcggagaaggcgatgcggcgacatctgcaggagatgattctgaccatcacgccgattgccgagcgcaacagcgaatggtttgaagggccgtag

SEQ ID NO: 10775 - DNA, 851 bp, Glycine max
  Peptide Sequence Number=SeqID_102460
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgagaaagctcttaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10776 - DNA, 410 bp, Glycine max
  misc_feature (387)..(387): n is a, c, g, or t
  Peptide Sequence Number=SeqID_102461
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgnctttgccgttacgcaccaccccc

SEQ ID NO: 10777 - DNA, 144 bp, Glycine max
  Peptide Sequence Number=SeqID_102462
atgtctgagtcaaatttggagatggaagtcttctttcgtttctcgatggtgaaccacatggatagtttaatgtgctcatcggcgcctgaccctgagatgtggatcatccaaggcacattagcatggcgtacttctcctgtttga

SEQ ID NO: 10778 - DNA, 120 bp, Glycine max
  Peptide Sequence Number=SeqID_102463
atgtcgctatcgtactgggcctgcagcatgcatcttgctctagtgttcattcatgtcttctcgtatacgcttggtggtgctatcggtctccctatcccgaaccgtactctcggaactctg

SEQ ID NO: 10779 - DNA, 767 bp, Glycine max
  Peptide Sequence Number=SeqID_102464
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgccaggaagacatgaaaataaagaagctaaacaatgcaaaatcccaagtgatatcaagaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10780 - DNA, 273 bp, Glycine max
  Peptide Sequence Number=SeqID_102465
atgccgcggataggattagggtttgggagcgacgcgaggacgggagtgaaacgcagcgttttgaagctggcgtggtttgatttggtttctcaatcattcattcatttccacggctgtgagagaggagcggggttgagggtcaggatccttgccagccggagaacaaatagaaaaatgaaaaagaaattcaaatccataataaatgacaagaaaatgaagttttctagggttcataagctccaagaatggccaacaatggctgcaattgaataa

SEQ ID NO: 10781 - DNA, 345 bp, Glycine max
  Peptide Sequence Number=SeqID_102466
atgggtctagtgactggtcccttcctagggaggattgcatcacgacctgaagtgaagcatgctgtgaattacaagggtgtccgtcagtttccactcttggttaacatgtgccgaattcgggatgaagactctcatgatagagcaagctattataagagtacaggtccaatgaagaacaaaaagaatagacctcaacatcggggaaatccgtactcgacccctcctaagcaaaatggtaaccgccccaacaatcagaggattgttgcaacggggttagcggggggtagtggtagcaaacccaatactttccccactcagatcacttgttacagatcacttggttaa

SEQ ID NO: 10782 - DNA, 198 bp, Glycine max
  Peptide Sequence Number=SeqID_102467
atggctgagtaccatgaagaggctaagaaaatcaaaaatgctcctgccttgtggtttgcctcccgaaagagaagaagattaagaattgccatctggattgcaaatggatcacacagtacagttaatatagcctatgacagtttgttgtaccgtgttatcttatcaaggatacagatgggttgtttgaccttgatctga

SEQ ID NO: 10783 - DNA, 387 bp, Glycine max
  Peptide Sequence Number=SeqID_102468
atgtatgtgtggggacctatcgtgcttgtgtatttatatagagagatgtgcagcgccaccgattacaaagttaaatcaatcggaggtatgtgcatcttaatccaaatgtgggcatgggaacgatgcacgactttggatccaaagaggacgtcttccgtaatagaaaataaaccactcggacacaggtggctgcaacgtgaaaatcaacatattggcaatgacgatcttagagttttccgtcgcaaattggatctcatgaaacgacaagagtttgtctgggagccatacacaacaactgtgatggcagcgttgcctccaatttgtgtggttggaagtgtagcctggttcgcggtgatgccactgatttgtttccatgttgttgagtga

SEQ ID NO: 10784 - DNA, 234 bp, Glycine max
  Peptide Sequence Number=SeqID_102469
atgagtaagggctgggatcctggctttgctgacgcagggtgtattggtaaaagttctcattcagttgcacctgacacctatgattggccgcctgctgatgatgacaaaggtgatgacaaaaagctcaaaggtcaatcaaaggatgagttcaagatgttcaagaaggaattaagaacaattcaagactcaagaggaaaagttcaagaacacttcaagattcaagaagaaggatga

SEQ ID NO: 10785 - DNA, 427 bp, Glycine max
  Peptide Sequence Number=SeqID_102470
ctccttagtcagcagccataggaccagatgtccaacactcgcaaaccttagtccctatgctacaaagcttattcagaggatagcttattatcatgcacagcctgggagagttggctcacaacagaccattgagaaagtagcttggcctgaagctcaacttccattggtgagacccaatgaggctgctcctcctgagtccgcaccggcacaggttgaaccaatgccaactgagccacgaactccagtggtgaatccacctcattctcctgagcttgaagcagttcccccatctccacctctgattatcatctatgatgcatcatcggatgaagcttttgttccccctgattccctagttggaggaattgctaatctttatgatttgtcatctggagaagctgttgctctcactgattccccagtttag

SEQ ID NO: 10786 - DNA, 180 bp, Glycine max
  Peptide Sequence Number=SeqID_102471
atggatgtaccctccactagaactgatccacaagagatgtaccctctcttgttctcagtcaacaacccaagtagatgtaccctctacttgtaccacaaaggatgtaccctccaatgtgttaagacaaagatctcagggaaagggaagaatcaaaagaattctcagattgtgtcgttttga

SEQ ID NO: 10787 - DNA, 342 bp, Glycine max
  Peptide Sequence Number=SeqID_102472
atggaagagaatttaagtcaagtgaataagactaatgaatcctctacaattgaaaaactaagagaggagatcgctcgtctaacaaaagactttaggaagcttttgaaaagctctaacactttaaccatacttttaaaattccatcagcatctccatgacaagtatggtctaggactagaaaaaggagcatcatcttctaagtcagagtctgtctcaagcaaatgtgacttatgtgatatctttggtaggaaaatgtcagggtttaagctagtacttggacagtggatgctcacgacacattatgggggaaaggtctatgttcctcgacctaaagccaattga

SEQ ID NO: 10788 - DNA, 495 bp, Glycine max
  Peptide Sequence Number=SeqID_102473
atggtggctagtggcagcactgagacctttgttgaaaacttgaaatcaatgtgcaaaaaaggttcagggtgctactactgttctaatttggggttaggttggtcaagtactatagggtatttttttctacaccttctgaaattgtttcctgcacttctagctatagcacttcttcccgactccgcccataacaatccagatagattggcctcggccttctcaactatgaggggattccaagcccgtcttttcataatcagtactcacacactttattgcactattggtacgcctttttggggattccctcgatacagtacaagaataatcttaacatgcactacgttccccctcttcactttgcttagcttacagttactgaggagtagtttcttgttaaagaaagttaccggaatgaccattccagaagcaattcgggaagtgcaagaagtaattgccaatactatatatatgacaagcccatgcatgaagtaa

SEQ ID NO: 10789 - DNA, 876 bp, Glycine max
  Peptide Sequence Number=SeqID_102474
atggtagggataccaaggaagcgcttagaggagaaggcaaaagctttggcaaatcaaggggagtggacctcgttcattgacatattagcactgttggtgtttgggactatactatttccgaatgtagacgggctagtggatctagcagggatcgacgcctttcttgcttatcgccacagcaaggaaagcccggtcatcgctgctttggcggatgcatatgatacattcgacttgaggtgcgagaagagtagtgcgagaattgtctattgtacgcctgctctttatatatggttggtatcccacgtttttcatcatgaaggtagacctgtttgtcccctacaaggtcatcatgtgtgttccaaaaagggtaaagcaaattgggaagaactcttggcaggcatgacaaaagcgtccattagttggttcccacggtggaaagaaggagaggcaggagtgttatgctcatgtgaaggattcccaaatgtccctttgatggggacgagaggttgtattaactataatcccatgttggccataagacagttaggctaccctatgagaggtgcaccatcggagaaagtcatcacacctttcatcacgggaggcttcaatgaagctaatgcaaagatacttcagaaaatctctaaagcatggaatagagtgggaagaaaagataaggagcttagaggaagtagcaatgacgtcatcaacggctatcacaagtggttgaagtctagaacacaagggataacttggctcccaaagctaaaaagtttaagtaggaaagaggctgaaattcctgaggaaagtgaaaaagtgcaggctttgaaggcagagctcgaaggtgaaagagaagttgaagacggcagtcactag

SEQ ID NO: 10790 - DNA, 450 bp, Glycine max
  Peptide Sequence Number=SeqID_102475
atgcctctttttgagaggtggcaccaggtgacgtcttccttccacctgcccgtcgaagaaatgaccatcactttggatgatgtgtcttgcctgttgcacttggttgtaataggcaaacccattgatcatgtccccttactctttgacaaagaggcaatggagatcctactgatgactcatttgggcatttcgagagagacaaaggtggcaacggtgacaaatgtaggtgccaaggtgaggttgacatggctggaagacctttatcatcgctatgttgagtcagccacaacctgggcagccactggcaaactatgtaccaggtggagaaactcttgccaggatcattttcgaataacatcagaagctatccagagcttgctggaccttagagctaggctagaggatacaagtcattatcagctcataaagcaagctttgcaactgttgtag

SEQ ID NO: 10791 - DNA, 165 bp, Glycine max
  Peptide Sequence Number=SeqID_102476
atggaggctaagaaaggaatacagattttacctatactaagatgcagcggaaggcaaaggagaagaggagaggggaggcaccatccactagggaataagccaaggaagaaggagcttcaccaccaagaactgccttggataagaagcttgaagaggattctttaa

SEQ ID NO: 10792 - DNA, 474 bp, Glycine max
  Peptide Sequence Number=SeqID_102477
atggcctctaggaagagaaaagaaactgcctcccgacctcaggagccctatggcacgactagatttatttttgagggcgcctgggaaagatataagcagaacgttaactctcggaacatcctttcaaagaggaacgttaatttatatgtcacggagtatgatgagttccaccatgaactcgagaggaggcggtggcataaagccttgactaggcatcctgatggtcacattgatgtggccctggtcaaggagttttatgctaacctttatgatccaaaggataaatcccccaggcagacccccgtggttttggaggcagggaagcgatacactgcctacaccaggttctgcagcatgcacccagaccctcaggagcttgcttccaagctctatattccatggcgcggttttgttcttaacactgaaggagcaccctggaagctcctgaggaaggatttgactactctagcctag

SEQ ID NO: 10793 - DNA, 108 bp, Glycine max
  Peptide Sequence Number=SeqID_102478
atgacaagggaggtgatcaggaaaggtacacagtcttccaatctcaagtgcttaagcatgacaagccttgaagtccttgccaatcagcatgtgacacacaatagttga

SEQ ID NO: 10794 - DNA, 360 bp, Glycine max
  Peptide Sequence Number=SeqID_102479
atggtatcaaggtatgctttaaatgaaattgctgctgagtatgagcgtgtaccttatgctggaaaaaacccttcacattgtggatgtgtcatgaggactacccacggtcttccatgtgcatatcaagggttatgtgaggttgaggtgaccataactgcggagatggaaaccatatcgaaacgatttgagcagctcgatgtttgtggaaaagtacatttaaagataaagcttcaagaaattgcttatcctgatctgaactatatgtgtcctcctccagaaaaggtgaagaccaaaggttactatagacaagtggatgaatattacagatatgggatgtcattgcttcacgatacaatgtga

SEQ ID NO: 10795 - DNA, 216 bp, Glycine max
  Peptide Sequence Number=SeqID_102480
atgataaagacaatacttaccttgaaggagaatgcaaatgaaaaacacgaacgaagaagacccaagaaagaagaagcagcaacgaaggagcaaggcccacgaagggaagaagaagagcaggacccacgaaggaagaagaagaatcaggaacggaggaagaagaagcaggaatgcgaagaggaagaagaagcagaaaaatggtgcagcgaaaagtga

SEQ ID NO: 10796 - DNA, 86 bp, Glycine max
  Peptide Sequence Number=SeqID_102481
atggaggtcgatgacgacgaagatgactatgcaccccttgaccgtaacagttctcctcaacgaaacaacatcctacaacaatggag

SEQ ID NO: 10797 - DNA, 711 bp, Glycine max
  Peptide Sequence Number=SeqID_102482
atggacagggcgatgttagtctacggattggtcacgaagatggacatgggcgtgggctcattcatctctggacaaatatcacagttggcccagtccaactcttcttggcttggcttccccgccctcatcactcccctatgcattgccagaggagctgttccagactcgttgacctttgagtcccttagccctgccattaatttggcatatattaggaagaattgttggaacccgaatgatcccatgatcacttttccggggacctgcaaggctagggctcgaggaccctcaaacatttttgctcctttttcttctgctcctcctgctccagctccaccagcaccaccagttcccatactagtacccttcggcaccttcgctcagagccaagatcagatagtgccgatgctgcaaagcctccaccatggcttatgcctagtgatgcagagtattcacgacttggctcaacattggcccattatgagcatggaggcctttatggcccaggtggcctggccaagagtccatccttctcctttgggggaaggtgaggctcctacagcccaggagccgcagccagaggccgaggcaaatgcagaggagacaccggaggacacccctgctaccacaccatttgaggcacctgaggaggcagacggcgctgtagacacagactatacagcagatatggcagcagcacagagcacctag

SEQ ID NO: 10798 - DNA, 384 bp, Glycine max
  Peptide Sequence Number=SeqID_102483
atggatatccctccgtcagctcctctctacgtcgctcggaggtctctcatgttcacattcatcgttccaaatacagagtcctatataccaaattgcagtggtccaatggaaagcaacgacagcttgtggtggccatcgatggtcgtgggtggtggaagagaagtttttagggtttttggatggagtttagagagaaggggggctgaaattgcacttaacgtgctgatctcgctaagcgaattatctcctcgggttggaattgcgcttaacgcgcttgtctcactaagtgagatgtccaaaactattactttgctaatcccaacggttaaagcacgaagaattgggttacgaacctacagtccaaatttgaaggtgatccaatga

SEQ ID NO: 10799 - DNA, 396 bp, Glycine max
  Peptide Sequence Number=SeqID_102484
atgcacaaattcaaaataaagaaaagaaataacacaactatcctaaaagaaacaaattgcaataaactaaaagagacaaagttagaaatcttgggttgcctcccagtaagcgcttctttaacgtcattagctagacgagtcaaatgccttcaaggtggcatgaaggtcacaaagaacacatcttccttgcattttcgcctcttagctagagacgccatgaaactcatgtatgtcggaaacaccttccatattgttgcaaggaaagtgctggtggttaaggagagaaggacacttaaggggtttatcatgttttccatgtcttccttccttgacaatcacttgatgaggagtggtattgacttggagaatacttttttgttgaatttctacttgtga

SEQ ID NO: 10800 - DNA, 1186 bp, Glycine max
  Peptide Sequence Number=SeqID_102485
atgggtccccctccatgtggctcacgccgtccactagcaccgcccgcgccttcagtgaagcgacgcagtgctcatcgttgccgtagaagcagaggcgaaggacgacgcggcgcacagagaggtcggaggcgacaccgtcgaagaagaggaagtgggattttgtggattctggcaatcaaggagcctgctggcggcttggtgtttgaagtggtcggagtgatgaaggaggtgctcctcggagtcgaggcgctcgaagacggaggggtacttgcgggtgaattcgatggggcgaaaggggagggagagggagcgtctgatgagggagacagggagggacttagaggtttcacgcttgatgaggccacgatcgcggattggtttgacggtgccgtcaaagatggttcggagggtgaggatgcgcgatgctctgggttgaggcattgtcgttgggggtggcaatggagggagaatcaaagaggggtttggggggttttggaattggacctgggtattgacaaatccatattcatcaagcctagaacatttcaccttatagtactgatgcttaagctatggaacaaagatcaaattaagacagcctctgaggtcttgcagagtatctcctcaaaagttatggaagccttggatgatcaacctctctctataagattaaaaggactggaatgcatgaaagattcattggcaaaagctcgtgttctgtactccaagagactggcagtgagtatcgtcttttacgtgtctttcgtgttcatcattgatgcatatgttgaagttggacttgtattagagaatgatgctaaacagaaattgaagctacacaccattgtgatgaacacaaggcataggaaaaccattgatgggcttaacgtgtacaacatactagagccatgctaccatttccccgatgctaccacagccaaagaaaatggaaccttaccaaagagttgcaaacaattaggtgttcctgagaggcctctcctagtgggaaacagaatgtttggtagagcttggccttttagagcaccaatcaaacttggtcttgttacattatggccccaatttggctcaaacgaggcatgtggcatgtgtgagcagagtgatgaagtagcaagttcatggctaaacaacgttgcagtcagtaaagccattcattctggatcggtag

SEQ ID NO: 10801 - DNA, 89 bp, Glycine max
  Peptide Sequence Number=SeqID_102486
atggcggtcgggcaagtatgcccccatcgtctagtggttcaggacatctctctttcaaggaggcagcagggattcgacctcttttgggg

SEQ ID NO: 10802 - DNA, 372 bp, Glycine max
  Peptide Sequence Number=SeqID_102487
atgattagcctcaaaagggcgggaccacctctgatgggaaatgctactacccatagggggaggaaccctaacgtagcaaagggtggcatcctagagtgtcgagagccactagcgatggaagattgggaattgccacccctttgcttcctatcaacggtaggtataacacaaaccatcacaacaaaaaaggggaaaactctagggaaatcaagacaaagaggtaaagaggagaaaagatttgtgtggcattttgcgaaagcaatacattcttcaatagcttttagaaggaagtcagatcttgtcattgaggtagtcgacagcttcaacagagaagcacccgacttgaggaaaattgttttggatgtaatttga

SEQ ID NO: 10803 - DNA, 1173 bp, Glycine max
  Peptide Sequence Number=SeqID_102488
atggtttgtgttatacctaccgttgataggaagcaaaggggtggcaattcccaatcttccatcgctagtggctctcgacactctaggatgccaccctttgctacgttagggttcctccccctatgggcaattttaggaaagaggaggaagaaaccaagtaagtctggatatatgggttgttctccacttgtcgatgtcccaaagtcgtgggaaagagaggacctcgagaagttgttcaaattttgtagggaccgtcttatagagattgtgatagactctaatccaaatgaaattttggaagtggcacgaagcgcaatggattttcctcaatatatggaattttcttcttctaaagattgccccatgggcatgaagaaaagaagttgtcacacactttccaaggatgaatttctgaaacttccaaccaagcggccacaatttgtgaatattgcttcaacaaacaaagccttgtttcaagattcactaaagaccaagccttgccttaaaacaaagtgctttcaagacatgcaaggctctggtaatcgattaccaggaagtgtaatcgattaccagaagacaaggccacaaggtccaacacaattggtgttggcactagtcgagaagttgttgagttttcattcctataaagtgaattcaacttctgacagtgaatgttcttcttcttatagggaaatcggttcaatcatgagtgaagaggcaagtgaaccgacttctaactcaatagttcccaacattccaactggaatggattggatcgggcctaaagataaggatgtagatcaacttgtagatgaagacatgtcagaattccactatgatgactcgtcaaaagaatcttgtagctttttggatagtaaggacgatgttcctaataacaacaattcttctagaaagagaatctcccaacgtctgccttggttccaatatcgggatttccttcccatgtatcatacctttttaaaagatctcgatatgaatttgcccttcatggatttccaactcaaagtccttaacttctatcaaaatttcccttctcaactacacccaaatgaggataaggttactgggaagaaattgaacgacatatccatggctctttcattcgaagcttatgataaatgcaagcttttagaggcttatgagatttcttag

SEQ ID NO: 10804 - DNA, 576 bp, Glycine max
  Peptide Sequence Number=SeqID_102489
atgactgtggatgaagttggtagtagctcccagtggagcaaagaacaggataaagcatttgaaaatgccttggcaattcaccctgaggatgcttcagaccggtgggagaagattgcagctgatgtaccagggaaaaccttggaagagattaaacaccactatgagctcttggttgaagatgttagccagatcgaatctggttatgtgcctttaccatcttataattcttctccagagggctcaacaagccatgctagtgaagaaggagctggcaagaagggaggccactcttggaatagtaataacgaatctaatcatggaactaaggcttcaagatcagatcaggaacgacgaaagggtattgcatggacagaggatgaacacagaaatatcagcttcaatgtggaagaggcaattctgccaggaagcttactagttgtcatgctttgtgatttccaaaagttaaatgctctcgtagtttcttatctaaatgaatcttgtggtcctatcaatagattttttaaccgccaaagaaaattggtaaagggaggccgtctgccgtccttctgccattga

SEQ ID NO: 10805 - DNA, 366 bp, Glycine max
  Peptide Sequence Number=SeqID_102490
atggttgatcagcagctcgcccaggcaagctcagctcccccaggtgagttgttgcttcaacctgaagtaaccttgctcgcccagcctgggcaagccaggggtctgaaaaagcctcaaaatgacccttttgggtattttccgcattctttaccgaaacgtcgaaaaacctcacagattgcgcggcaactggcgacgacgaagaaccaagaagcttacggggttgggatttcgacagccttgaaggttaaggatttgcctcgaagaaaccaaccaggcgacaacgaagaagcaagaagcttacggggttgggattttgacaaccttgaaggttggcgatttgcctcgaaggttttagggatttcatga

SEQ ID NO: 10806 - DNA, 207 bp, Glycine max
  Peptide Sequence Number=SeqID_102491
atgttgatttcaactcgcgaggcagattggctaagtgaggcagattggctaagcgagcctcatccccttagcgaggcagacaacttgcttagcggatgggaaacccaagaagaggataagtcagagatctgcacgctcagcatgcaaccagcccgcccagcgaaaacgttgtctcttttcgcgcttagcgcgcccaagctcgcttag

SEQ ID NO: 10807 - DNA, 369 bp, Glycine max
  Peptide Sequence Number=SeqID_102492
atggcactgtttgagacgggaattgcaccctatgggtcggccatgattgcacacgagcatcaaccacttgctttttccttaaggacgactgctaacctaagggagcctcgccggaacaaaccttgggatcctagaggacctcgatggactcgtaacaccttgaggacaagcgtgtttctgagggcgatgcaagggtttgcttataagattgtggtaatgatgaagagtgagcagatatttgagtctcaggatggccccatcatactctctcagattgagaatgaatatagggcacaaagtaagttgcaagaagttgttggtcaaaactatgtgaattgggctgcaaaatggctgtggaaatgggaatag

SEQ ID NO: 10808 - DNA, 441 bp, Glycine max
  Peptide Sequence Number=SeqID_102493
atgccggaaacttgtcaacacttgttgtttaactgcagtgatattaaaccagtttgggagaaaatattgaattggattggttttaaccatactcctgctatgtgggatgaggagctgaagtggattgtgcaaaacacgaaaggtaaaggctgtaaaagaagtttgttgaagatggcagtggctgaaacgacgtatatgatttggtgtgtgagaaactggatcatatttcaagatggtaggaaagaggagcttcaatatgacaccataaaaaatgtgattcttagaagagtagaaaccaatagaaaactcatgatatggcctcaaggaagagaaaagattccacttctaaacctcaggagccctatgacacatccaaatttgtgtttgagatcgcctaggagcgatacgagcaaaatgtccatagtaggaacatcctcttag

SEQ ID NO: 10809 - DNA, 105 bp, Glycine max
  Peptide Sequence Number=SeqID_102494
atgagggaggagagtgatggactaagggtcgacaaatcgactgtgagcacgagcgacggaggtaatagccacacagatgtgagaattgtatttttagatttgtga

SEQ ID NO: 10810 - DNA, 582 bp, Glycine max
  Peptide Sequence Number=SeqID_102495
atgccttcaaacgatggtgtagttatcgtggtcatgggtgtcagcggtgctggaaaaaccacaataggtcggaagctggaaaaagagtcgaaatataagtatcttgatgctgatgattttcactcagaatcaaacaaagaaaagatgcgtatgggaatcccacttacagatgaagatcggatgccatggtttgaatcgctacgcgatgccataaaagaatacttaaataacaaaaagggtctgattcttggctgttctgctttgaagaaggaatatagagaaattcttagatcaggtgaccttagttataaatgggggacttatgcaagtgctgtcaacttcattctgttggatgctcctgctgaagtgctgagtgttcgagtaaataagagagctgcagaaggaaaacattatatgcctgcatctcttctgcaatcacagttagatttgcttgagattgatgagtctgagggagtacttagagttgacgctactttgagaccccaagccattgtaaacaccattctaaacatgaaccagtttcagggatgtttcaatgttgattttgtggagcctcattga

SEQ ID NO: 10811 - DNA, 390 bp, Glycine max
  Peptide Sequence Number=SeqID_102496
atgccgattgtcaatagtaattttgtgctgctaggtcctactgctggtcttgctggtggtgctgctggtcctgatgttgctggaactgaaggactattgactgaaaaactcacatctcttcttttgattgacacagctcctcccttaggcggcatgttgcccataggcggggatggggaaggtatggatataggtactagggacggtccacgtgcatcaacggaggatggagatggtgtggatgcagtcagaggtggagatggtgtaggtgcaacatcgggaggcctagccgggatagacacagaagatgggaatggggtagatgatgtcagactatctcgaggtggtaatagtctaaccattcatgtgacgggagtcgaggagggttag

SEQ ID NO: 10812 - DNA, 1344 bp, Glycine max
  Peptide Sequence Number=SeqID_102497
atgaagccgaggctctgcgaaatcgcaactgcaatcaatctctacataattcttagttcagtgttcttcgttcgtcattcggaagcgcttggaggagaaggcaaaagccttgataaatcaaggggagtggacctcgagtgtccattagctggttcccccaatggaaagaaggaggggcaggagtgttatgctcgctaccctatgagaggtgcaccgtcagaggaaatcatcgcgaagatacttcagagaatccgtagagcgtggaatatagtggaaagaaaagataagaagcttacgggaagtagcaatggcatcatcgatggctatcacgagtggttgaagtctaggacacaaggaataacttggctcccaaagctgaaagacctaagtgggaaaaaagatgaagtccctaaggaaagcgaagaagtgcaagctttgaaagcagagcttgaaaaaatgagagtggtcaaggagaagctaaagatggcagtcactagggtcaggaaagagtgtgatgagctgagaaatgtcaacatgactacggtcgaagcattagacaacgagctcaagcttagaagggtcgagaaggacgagtcaaggatggaaagcatggtgttagaggataagttaaaggcttgtcaaagggcgaagagaagtttgacgaaacagctgagcagaacggaagagaatatgttgacaattattgatcaatataaggagaaggtgaacctagctgctagtcatggacagaggctagaggatgaacatgtgaaggtttgctctcactctgaatgggagtcaagatcttccaagttgttagccagagccaaggcaatggccaacatgtactcggctcccgatgaagttcacggtcttttcgatggaagccataatgagcatgagaagaatgatggaggtcagggaggagaagcattgggaagtacagacagtccccatgttgtgccaagcaagaattctttcccaccatacgacttgcttcccaactatgcaccacctaatgctgtacatgtgcctgacaagaacgccgaccacttcactcctgttccccttgaaagccagcaaccccatttggggcatgcacattttgctcagcccattggggaggcatgtgaagaaccctgggaccacattctggtcgactttgagccttaccccagatatgccaatgaggggccagcatttggttgcatgccccagcctaacacctcggggggccctcagcatcacccactacaacccttatatttctcggtgggaagactgcctcctaccatggaggaaaaagagaaatttgatctaatagaggaaaggccaaaagaatga

SEQ ID NO: 10813 - DNA, 141 bp, Glycine max
  Peptide Sequence Number=SeqID_102498
atggcgactaagatgaagcgatgcccatttgaagccttgggtttgatggccctgatcacatctatgccccacattcagaatggccaagatgctgccaagatgttcaatggtataggtggagcattaacattatcagtgaag

SEQ ID NO: 10814 - DNA, 501 bp, Glycine max
  Peptide Sequence Number=SeqID_102499
atggctccgaataagcttcttgctaaaagggctaggaaggccaccgcaggggagggatccagtgcagccctgcaagtagagattgagtttgacggacaccgtttccgaagtgaggagcatcaacactgtttcgaagtgatcaagggctggtctttcctcaaagaaagatgggtccaactaagagaaggggagtacatggaattccaaacggaggttgccaggaggcagtggacccaattgacagagcccatggctaagtatgaccctgagatagtcatggagttctatgcaaacgcctggcccattaaagaaggagtcaaggataagcgctcctgggtgagaggccaatggatcccctatgatgaagatgatatcaaccaattcctggggtatccattggtcctagaggaaggtcagcgttgtgagtacacctgtcgcaacctacccttcggcggaggcgcgaaaaggccaaaacagatgggccaaggcgtatgtctctaa

SEQ ID NO: 10815 - DNA, 189 bp, Glycine max
  Peptide Sequence Number=SeqID_102500
atgaagaagaaagatgagaaaaagaagctaaaacgccaccgaatcgcgactgcaatcgatttctacatcgttcttcggtcgttcttcatttgttcttcaccgttcttcatccgttcttcggtcattcttcgttcttcattcggagtgagggcaagacccttgtggatcccaaaaagtcaaaaaacataa

SEQ ID NO: 10816 - DNA, 633 bp, Glycine max
  Peptide Sequence Number=SeqID_102501
atgaacaacgacacctcacgcgactcacactctacgggtttcacttcggctcttgggaatttcataaaccaagtgcctagcataattaccttgaagggttgtggtaattaccagactcagctagggtcaattatgagtagcgttgcaacgtcaatgcacgacgccttcatatttcccatgaaagtaatggttacatttctagatgagaaggaaaaaattgatgtgtggggtgtgagggaaagaaagaaggtcctatttaaaggacatagagatctactcgtggagtttaatttcctcttgccaaagaaatatgaaatcacacttccattggaggatgaacacactactgcaaagggcggacatgtgacaccttctcataagctcagtgcttatattcctctttcgtctttccaacttcaaacttcaaattctaaccccattccaaacctttccctcagcaatggaatccaccaaactcctgcatcaatcttcatttctttagacagagagagagagagagagagagaaagagcgtgcggtgtcggaatcatgttctccgattgcaccgatggttcggtttatggtcatcagagaatcgccgatctcgttgagagttttgaatcgcaccggtga

SEQ ID NO: 10817 - DNA, 456 bp, Glycine max
  Peptide Sequence Number=SeqID_102502
atgaagagtgaatgtgagtggggaagtggtgttggccgtgtgatgttccttgggaaggaagggtggtgttgtgattggtctagatgccatgcatggcgccatcagcactggcgccttcggggaggagatgacacgtggcatgtcgccattgtaattggcgacacaggctgcatgtcgccactcgtattagcgcatcctggaggctgcatggaagcgctgcacctgctgctggttaggcgtagctggatggtgccacccatgttggcgagttgcgtctgggagggtgtcgccaaccgtggtagcgcgttcagcttggtggataaatatccccaagtgcagagagggtggttgcgcttccttgtgaaatacttgtgtcgtgaaggtgaaaaaagagggtgctttgtgtcgagagaggtagctggtggtgctcaaactttgtgttcttctattttctaa

SEQ ID NO: 10818 - DNA, 819 bp, Glycine max
  Peptide Sequence Number=SeqID_102503
atggattatcaactatgtgatgttttatggcaatcagttgagccagatgttttggagatccttagatcattcaaaacatatcgttctttctggaaaaaggcccaagatatctttgccaatggcatccaaagtctgtttgatgcgactatgaaggttacgactctcaagcagaccagccatgacatgattgcacatatgggaaaagctagggctactgtggaagagttgaagaggttccttgtggctgattcattggaggaagtgaacagaaagctggataaattttacatggttcttattttgaggagcctatactcagattttgatcatgtgcatgatcaagttcttgctggagatcaagttccttcaatggaatctctcatcaccagacttcttcgcgtgcctcatgtattgaaggatgaaaatcttgctgatgttgtggaaacctcagccatggttgcatctcgtgggagagggggaggccgcaaaaatagaagaggtcgtggtggaagaggtggacatcctcattgcacttattgcaagaagatgggccacactcaagagaattgttactcattgcatggttttcctgaaaaacttgcatttctcagttcattggaagtcctagtccttggatacttgactcaggtgcctctggtcatatctccgtgtccatataatctaatctcattaagtgatgcaatcctccctaggaagggaccaatcactagaaccatgagcaagaggctccaggaagattgggctagagttgctgaagaaggccctagggttctcatgaaccttaaggtagatttctga

SEQ ID NO: 10819 - DNA, 1008 bp, Glycine max
  Peptide Sequence Number=SeqID_102504
atggtggcgtgttcttgcatacgtgacaatcatggaatgacacgtactagagacatggtggtgtgctcttgcataagtgtcacttgtggaatggcacgtactagagatgtgggagttgtccgtcttgggtttttgagagactcaccatgggtggaccttgggtttgacgagccctttgaagaaacgactagcgacgcgtccgtcctagattttggaaagactcaccaaggatactcgagtaggaaaaagagtacaacatctacatctggttttacattaggtcaactgaagtacaactttaggtgggtggcgttccatgttcttggaattgctttaccatccaggatcttttctggcttcgcctcggactcgccacacgaggttgctgggtcgaaaggttcgtgctctaacctaatgttttcctcgttttgttattgctggaacgacaatctccttgtcgatggttcctcgacttcaacgggaatcatggcatctatgccatatggccccaaggatgactttgttggctgcctctgcctaaccgttggtctgaggatgctcgatagaggtctgagctttgaattgagtgttgttgtcaatgacaatggtgtgtgggaggtcatacttgcatatgaggtttttctaggtgaacttctctacctcattggccataatttctcgcagtggtattgcctcgatccacttgggccaatgggagctcagactgtggagattgttaggagaggtgcatggaatgtctgcaaactcttggcatcgcctgcatctctttgtgaagtcaagggtgtctacactgagtgttggccaatagtagccaacatgcaccacctttattgcaagggatcgtccaactttaaggagtctggtaatgtagctccatgtagaatggcagcagaatggagaaggaggaaagctgattggagaccccacttcaaggagaagatgagtcaagaacaagctcaccaccataggaagcctaggagaagatga

SEQ ID NO: 10820 - DNA, 156 bp, Glycine max
  Peptide Sequence Number=SeqID_102505
atggtgattttcagccatggagttgcaacggaagataaaggagaagagagtgccttggataagaatctgagagcagaagcttcaatagaggaagagaatgagggagagggagaaagagagagagtggcgtggaaattgaaggagaatatgaagtga

SEQ ID NO: 10821 - DNA, 1014 bp, Glycine max
  Peptide Sequence Number=SeqID_102506
atggcaagcttgtggaagataatgctggggtggattcctagcatgtcagatggcttccaagcaaacaagtccgcattcctatgtaggacgtcaatgatgcatctatgctcatggatgtcagggcttggactgaagaccctcatccacactcatgacttgagtaccttcgaccactgtggggaccttggacaccatgaagttggcgattatgatggagacaaccatggggtcgtcttggctagtgaggttgatacccttgaagtttctatcagtgaaagtgataggagggagacttcagggcaatggtgtatcgacatagttgatatctatgccctgaatggcatggaggtggcactttcaggactagttagactattctctgtaagagaatctgcctataatggtgttgatcacccctcttatttgttgggtgggttcctgtttgtgtggaggttattgatcgcatcttggttgattgtgtctctgtcttccacaatcttctgctctgtgtcttcttctatacgccccgtgattcccatgatgctcctcttggtgtcctctggctcttactcctacttggtggttcctgataggtacctcgaagttgaaagcttcctcaaggattatagtgcaattggctgtaaggggtgtgtaaaccccgtacccgggcccttatgggagaggctgtcacttgtccgtccaccgtaccaattcaatgtcgcccctttgagggatgttgggaagtcacgacacaggattgcatcatcattggtgtataagtttgtctgggtcaggaaagcatccaaatgttcatctggattaatggtcccatcatactactccaggttcagtggttttcaacctagagctcctcttcatggcgtcgtccatctctacaatgcggttatggagttgctagagagtatcagtatctgtcatggttgctggaggaggattggagccttcgacaaaggtctggcgtctgacgctagactgtgtgctaaccatgggtga

SEQ ID NO: 10822 - DNA, 177 bp, Glycine max
  Peptide Sequence Number=SeqID_102507
atgtctttccagattcccctttactcgctaagcgcgctggaagatcccttcgagagttctttatcgggttctcgtttgtgggttcaactttttctagcacgtaccttcttcatggcgtggatattccgcagggcttggatagatgattgctctgagacttacacttttgtatattga

SEQ ID NO: 10823 - DNA, 258 bp, Glycine max
  Peptide Sequence Number=SeqID_102508
atggtagaggacgtgtgtttcctctacaaggtatttcctttctacttccttattgctcctttttaccgtcaaacgcagaaggtggaagaacacattaaagctgcgatttttatctcaaaaaatccaagagtacagagaaggtggaagaacacattagagctgcgatttttatctcaaaaaatccaagagtacaggttcgtaaacacaaaagactacagtaacaacggcggtgctgaaggtcaggacggtgttgaataa

SEQ ID NO: 10824 - DNA, 243 bp, Glycine max
  Peptide Sequence Number=SeqID_102509
atgccacattaccttgacattggattggcaccaacccacacatatcaggaggccaataagtgtgcggatgccttagccaacagtggttgtcatatggaggaggactttgtgatgtttcagcagggggcacttttttacgtgaaaagcatgtcatgcagtgatcaactcgccagaaccagtggcgagtttgatctctgtgagaaaatcgctcatgctgctggcgatacatgcattgagggctga

SEQ ID NO: 10825 - DNA, 582 bp, Glycine max
  Peptide Sequence Number=SeqID_102510
atgtcttcaaaaggcaacaatgcctccatttacattttgaagacgacaatgtcttcaaaaggcaacaatgccttcatttatgttttgaagacgacaatgtcttcaaaaggcgacaatgccttcatccacattccgaagacgacaatgtcttcaaaaggcgacaatgccttcatctacattccaaagacgacaatgtcttcagtcatttctgctttcaaaaggcgacaatgtcttcatttactttttgaagacgataataccttcagtcatttcatgctgtcaaaaggcgacaatgccttcatttatgctttcaaagatgacaatgtcttcatttacatttcaaagacgacaatgtcttcaaaaggcgacaatgcctccatttacatttcgaagatgacaatgtcttcaaaaggagacaatgccttcatttacattttgaagacgacaatgtcttcaaaaggcgacaatgccttcatctacatttcgaagatgacaatgtcttcagtcatttatgctttcaaaagggttttactgctaggacttccgctagtggccggttggatggtgagatccctcaaatga

SEQ ID NO: 10826 - DNA, 246 bp, Glycine max
  Peptide Sequence Number=SeqID_102511
atgattaaagcacgtcaaaagggggtacggaaaggaaaagaaggagaagcttgccacccagctcgcccaggcaagctcagctcgccgaggcgagctaggttgcttcctccagaaggcaccgcctactggggaacttcctggaaggcccaacatgttacagaacttcacggattgcctaacgatgggttccaagtacctcgaagtggtcaaacgagggtcgaatcccaacaaacatatggtccctag

SEQ ID NO: 10827 - DNA, 126 bp, Glycine max
  Peptide Sequence Number=SeqID_102512
atggtgacaacagtggcagcaataatggcgacgatcatgataatggtggtgatgactatcaagtccgacgtgggagatcgtgaaacccatcttggctacatcgaccctgaggtcaatcagctctag

SEQ ID NO: 10828 - DNA, 1015 bp, Glycine max
  Peptide Sequence Number=SeqID_102513
ggttcagtctgcacattgggctttaaagagactattgcaaattagtcttgaagacctatgtagtgtttgggaagccatgaacaatataatcactctgcaacacactgaaattaagtcatcttttgagacaagtacacatgtgcgtgtaaattatgctggcattgacagttgtctttgtggatgtataatgagaactagtcatggtcttccatgtgcacaccaaggtttatctgagttcgaagtcagcataatcgaagagatggaagccatatccaagcggtttaaagagcttgatgtatgtggcaaagtgactctaaagaaccctagctcgcccaggctagcatctggctcgcctgggccatggaatagcttcatgcctaagcaaccagctcccctgggcgagctcattccatcagagctaagcatcagctcgcctggagaaaacaaagaggaagaaggaagaaaagagaggtcgagatgctaccgaatcgctaccgtgatcattccctacatcgttctcttgttctgtgtccctcatgcaatagttggagacgaatgtgctttcttttatatgtttttgtcatcccgtcatgaggtaggttgcgacacctaccctgatctaaattctatgtgtgctcctcctaaaaaggagtatgtggatgcattacactctgtccaaagtagcaattctttagtgaaacgttgtgcatcatcatctgaacaaccaaaacctaataggaagatgccaatgttggatcaatttcatccatgcattcatgctttcattgaaaacattgtcgatgtcaaagttgatggtaattttggatatcatgcaattgttggcttattaggtatgggtgaagattcatggtctttggttcataaccatttgttgaaagaacttggacaatggtctgatgagtatatacatctgcttggtggcatggacagatgtgaggagttaaagcggtcactacttgttgatgaaatatccaagtcaaccaccgagaaatag

SEQ ID NO: 10829 - DNA, 459 bp, Glycine max
  Peptide Sequence Number=SeqID_102514
gaagcttgggatagatataatgacattattgttcctaggaagttactcccagagagaaatgtggtaatctaccacactgaatttgatgacttcaaggaagaattggagagaagaagatgggaagaagaattgaccagctttgaggaaggcagcattgatgttgccatagtaaaagaattctatgctaacctctatcatccagaggacaaatcaccaaagcaggtcaaggtcagaggtcatttgataaaatttgataaagatgccctcaacacattcctgaagacccctgtgatcattgaggagggggagacattaccagcttactctagattttcactcttgaggcctaatcctcaagagttggctgctaagctctgcatcccagtgaggggatttgagctgaatgttgatggtcagcctttgaagatcttcaggaagaacatgaccacactcgcttag

SEQ ID NO: 10830 - DNA, 4407 bp, Glycine max
  Peptide Sequence Number=SeqID_102515
atgacgagtggcggtggtcagaaactaaccacaaatgatgccttggcatatctcagggcagtaaaggacatttttcaagataagagggaaaagtatgatgactttctggaagtcatgaaggatttcaaggctcaaagaattgatacatcaggtgtcatagcaagagtgaaggagctgtttaaagggcacaaagatctaattttgggatttaacaccttcttgccaaagggatatgaaattacacttccattggaggatgaacaacctccccaaaagaagcccgttgaatttgcagaagccataaattttgtgggaaagattaaggctcgtttttatgccaatgaccgtgtttataagtcatttctagacatattaaatatgtacagaatggaagccaagtctatcgctgaggtttacaaggaggttgctgcacttttccaggaccatgtggatcttcttagggagtttactcattttcttcctgatacttcaggaacagccaacaattctctccttcacgataggacaacaattaggcaaatgcatgttgaaaagttggtcactaagctgacacttaacctatctttacgccagaaagaaaggaacatagcttcacatggtgatcgtgatctcggtgctgaccatcctgatccagaacttgacagatgtttgattagggctgataaggatcagaggaggcgtgatgagaaggaaaaggacagtagagattatgatcatgatggtatatctcacaagcggaaatctggttgtagggctgaagactctggagctgaaccattgcatgatactgatgaaaattttggcatgcaccgtatttcatatgcttgtgaggacaaaagttctttgaaaagtatgtatagtccagtgcttggttaccttgacaaagtgaaggataaattacgaaatcctgaggattaccaggaatttttgaagtgcctaaatatctacagcaaggaaataattgcccgacacgagttgcaatcattgttttatactagcctatgttttttctatgataacaagcctcatagaaaagtggcttcttcttcaaggtgggcaatttactgggaaaacatgcagatcttatggagggatttgatgaatttttggctcaatgtgagaagaatggtaatgttcaagttcaaactaagttttcactttctacaaaatctagcttttctttttattctttctaatcaaatttgtcacacagaaggattccttgctggtctcctgaaaaaaagacacggaccaaaaccagtgaaggtagaggacagggatcaagatcgtgatagggatgacgggatgaaagaaagggatcgtgaatgccgagaaagggacaaagcaactgctaacaaggatgtttcagttcctaagacgtctctatataccagcaaggataagtatgcagcgaaacctataagtgagctggatctttctaactgtgaacaatgcactcccagttaccgtcttctaccgaaaaattacccaataccaccagctagccagagaacagaacttggtgcagaggtgttgaatgatcactgggtttctgttacttctggcagtgaggactattcctttaaacacatgcgcaaaaatcagtatgaggagagcttgtttagatgtgaagatgacaggtttgaacttgatatgttgttagagtctgtaaatgtggcaactaagcgggttgaagagctcttagaaaaggttaatgctaatataattaaaggagacagtccaatttgtatcgaggagcacttaacagctctaaatcttaggtgcattgaacgattatatggtgatcatgggcttgatgtaatggatgtgctaaagaagaatgcctctttagctttgccagtcatattaactcgcttgaagcagaaacaggatgagtgggcaaggtgtcgtgctgattttaataaagtttgggctgaaatatatgcaaagaattatcacaaatcacttgatcaccgtagtttctactttaagcagcaggatacaaaaagcttgagcactaaagtcttactggcagaaatcaaagaaattagtgagaagaaacgaaaagaagatgatgttcttcttgcaattgctgctggaaacagacagccttttattcctcacttggaatttgtgtatcctgatccagagattcatgaagatctgtatcaactcataaaatattcatgtggagaaatgtgtacaactgaacagttggataaagctatgaagatttggacaacatttttagaacccatgcttggtgttccttctcgaccccaaggtccagaggatacagaagatgttgtcaaggctaataagaataattctagcaaaagtggcactgcaattgatgatggtgatagtagtcctgtaacaaatcctaagaatttaaacactaaaagaaatgaggatgagaactttccatcagagcaaataaattcctgcaaacaatggcaaacaaatggggataataaggttaaagaagataattatcttgattcagaatgcccggcacataagattgaaaccttgggaagtactacacagcaggataaagtgcatataaatgcatccatgcctgatgaagtatcaagagccaataagcaagatcattccattgaacggttggtgaatggtaatgtctcaccatcctcgggtatggagcaaattagtagaataacaaatgtggataatgcatcaggacttgctgctactccatcaagacctggtaatatttctggtgcgggaggacttggtttaccttcattagagggtgctgattctacgagaccagttacatccacaaatggggccatcattgaggacactaaagttcacagatatcgcgaagacgctggacccttcaaaagtgaaagagaagagggtgagttatcacctaatggagactttgaagaggatgagtttgcagtttatggacatgctggtttggaggcagttcataaaggaaaaaatggtaccatttgtcgacaataccaaaatagacatggggaagaagttcgtggtgaagcaggaggagaaaatgatgctgatgatgaagttgaagaaagtccccatagatcaatggaggacagtgaaaatgcttctgaaaatggtgatgtttctggtacggagtctgctgatggtgaggagtgttctcgagaacatgaggaggatggagatcatgaacatgataacaaggctgagagtgaaggtgaagcagaaggaatggctgatgccaatgatgttgaaggagatggtgcctcattgccatattcagagtgctttcttgtcactgtaaagcctctggcaaaacatgttcctcctgtgttgcatgacaaagaaaggactgctcgagtcttttatggaaatgattccttttatgtgctgtttagacttcatcagacattgtatgagaggatccaatctgcaaaggttaactcatcatctgctgaaaagaagtggagggcttcaaatgatacaggctctagtgatcaatatggcaggtttatggatgccctttacaatttactggatggttcttctgatagtacaaaatttgaggatgactgtcgagctattattggaactcagtcatatgtcttattcacattagacaagctgatatataaacttgttaaacagcttcaagctgttgccactgaagagatagataacaagctgcttcaactatatgcatatgaaaattcaagaaaacctggaagatttgttgatttagtttatcacgaaaatgcccgtgttcttctccatgatgagaacatatatcgtattgaatgttctcctgcacctacccaattgtcatctattcaactgatggactatggatatgataagcctgaattgactgctgtgtcaatggaccctaatttttcagcctatctgcacaatgacttcctatctgttgtccctgacaaaatggagaagtctggaatttacctgaagaggaataagcgcaagtatgctattagtgatgaatattcaagccagaccttggatggactagaaattatcaatggtctagagtgtaagatagtttgcaattcatctaagatactgaagactttttacatcgaacaagaagaaaaaggagaaccttgcatcagagcagttcatgccatgaacaggcaaagtcctcaatcatttgttcaagcagagcacaacggttctgcaaattattttcaatttgaagatgatattcattttgaacccgagatggcagagaagccaaatggaaatggcgtcccatccaagaagttgagcaaaggatgtttttctgaaattcatctttcttgcattcctcacatcttctataccagctaccaaataaggcttacacttaagggagatgaggcagagagattgtag

SEQ ID NO: 10831 - DNA, 480 bp, Glycine max
  Peptide Sequence Number=SeqID_102516
atgaaaatcattcattatgatgtccgtgatgatgtgaggatgtgccacatggtcgatcccatcttcgcgcttgatgatcaggatttcatctgtcctgatgtctgcccgcttctactttgtcagcctcagcagaaaattggtgacgcaaatcaacacctaataagtcacccatatcagtcggccatgaaaaatgaggatgtgtttccgcaacaccaccaaacgaatgttcgcttggagaagtatcagtgtggtgaccttcaaaaggatactgatacatctatgaaggatactgagaaaatgttggtgacatgtaatacattccatggccacggtccaccatttgttgggaatattcttccgcttcaacagcctccctttgtctgcctatgccccgagtttcaacacttgactgaagaatatgaaactcttgtactagaaattgatgctctaatgttggaccatgtgacacaggctcagtga

SEQ ID NO: 10832 - DNA, 816 bp, Glycine max
  Peptide Sequence Number=SeqID_102517
atggcctctacaaccccttctacaacttcttctgttggtcccacagtttctttctctgggacacctgtcacaacctcagagaagctgagtggtagtaaaaattatttgttctggtctgcatctgtggaactccgattccttggccaagggcatcaataccacttggagaaagagttcactgaagtaccagcagaaaatcaggaacaatggaaaaggcttgacttccagctttgtgccttgttgtggcagtctgtggagccaaatatcttaggaacctcgaggtccttcaaaacctgttgctccttttggaaaaagcccaaaagatctatgccaatggcattcagagattttgaagaactaaatatgctcttagatgttgactcaatggaggaaatgaaaaggaagcatgacaatctgtacattgtgctggccttacgtgacatgaattcaaattttgatcatattcgtgatcaaattctgactggtcaagaagttccttcaatggatagtctcatgacacgtcttcttcgtgttcccaccccaaggaagattggaaactcacttaagcattttgaatctttagcaatggtgtctactagaggaagaggggatcgtgggaattgtggaggacgtcgtggtggtggtggtagaaacacaaactcagaccttcgatgctcacattgtaagaagtggggccacacccaagacaaatgctactacataattggctggcctgataaaacagcaaatgtcaccaaatcagaaacacttgatcctaagttttatgaagaggagtataaagaatgccttcgatag

SEQ ID NO: 10833 - DNA, 1209 bp, Glycine max
  Peptide Sequence Number=SeqID_102518
atggctctatcgcgcgtggctcaatcgtcgccatcacagtcgaatcttttgaaacccctctcgtcgtacttatccctacgacgccgttcggtgtcgacctcgtcggagcccctcaccgtggagacctcggtgcccttcacctcccacaactgcgatgcgcctccacgcgccgtggagacgtcctcggcggagctcttctcgttcttccgtgacatggcgctgatgcggcggatggagatcgcggcggactcgctctacaaggccaagctcatacgcggcttctgccacctctacgatggccaggaggccgtcgccgtcggcatggaggccgccatcacgcgcaaggattgtatcatcaccgcctaccgcgaccactgcaccttcctcgcccgcggtggaaccctaatcgaggtcttcgctgagctcatgggccgccgcgacggctgctccaaggggaaaggaggatccatgcacttttaccgcaaagaaggtggcttctacggtggccatggaattgttggggcgcaggttccgctggggtgtggcttggcttttgctcagaagtattgtaaggatgagaatgttacgttttctatgtacggcgatggtgctgccaatcaggggcagttgttcgaggcgcttaacatttctgcgctttgggatctcccctccattttggtctgcgagaataatcactatggaatggggacagctgagtggagagctgctaagagtcctagttattacaagcgtggggattatgttcctggattgaagggcatcaatcttgaagaaaatgcagaaatacaacagttagctcttgtcttctctattaaacaagcaagatggaggtatatgaatgctggagaattagaatctgctagagatgggatctgcccttggctgatgatggtgaaattgccaattttgatggatgtgattgtttgggatgtagatggcatggatgctcttgctgtgaaacaagcttgtaaatttgcaaaggagtttgctttaaagaatggtcccattattctcgagatggacacatacagataccatggccactccatgtctgatcctggcagcacataccgtacacgtgatgagatttctggtgtaagacaggagcgtgatccaattgagagagtaagaaagctactattgactcacgagattgctactgaaaaggagctaaaggtgattgaatga

SEQ ID NO: 10834 - DNA, 456 bp, Glycine max
  Peptide Sequence Number=SeqID_102519
atggatgggattggaacttgccatgggagaagaaagctagggttcaaaaaacaattaggattctccacaagaatacgtggctctggataccatattagagaaactgagatagagagaatttcagagagtggagttctacctacagaagagaccttgggtcatagagattttattgcgaaccatgaagaagaacccaattttgattggagaacagggtgggaaaaaaccgctattgttagaaggttggtgcgaaggatccaggaagccaatgttcctagggatctttgtctggacattgaaaaggaaataagaaaagaagtagatgaagccattgccaaagctaaggaaagtcaaatgccagagccatctgatttatttaccaatgtatatgtaaaaggcttcggtgtcgaggcttgtggcgcggataggaaagaacttagggctactttgccctga

SEQ ID NO: 10835 - DNA, 204 bp, Glycine max
  Peptide Sequence Number=SeqID_102520
atggtgatggagatatggttcttgatgttggcgatagcaagagttgggtggaatttgttggaatcggtcatggtggctaacgtgagaagagagatgacgactagaaggagaagaagagaagttagggcacgacaaaaaaccaaaggtggagccggtgaaaaggtgttgcagatcatcattaagacaaatgtgaagggacattaa

SEQ ID NO: 10836 - DNA, 1389 bp, Glycine max
  Peptide Sequence Number=SeqID_102521
atgggggagacagcagcttccaatcctgctttgcaagtgtctgtttcatttggtagatttgagaatgattccttgtcttgggagaaatggtctgctttctcaccaaacaagtacttggaagaagttgagaagtgcgccactcctggatcagttgctcaaaagaaagcttactttgaagctcattacaagaatgttgcggctcggaaagccgaattgctggctcaagcgaagcagacggagaaagattctcctagatcacaacatcaaaatggggaagatctgagttgtaacacttgttggactgatgcagaatgtgatgatactcaaggttctagggaaggggttaaggttaagcaagaaaccaattcaattggtgagattgttaggaccgatgagagtaatttggaggaggatgttgcagtttcaagagattatcaaggttcatctgttgaaggagagaaagagaatgaagaactagaaagcagatcaggtagttcccagatagagaaacttgaagaagttgtctgcattgaacaaggggaaagtaaagaagaaagtcgtaatgttgaagctgaagatgttaaggaaattccacacaatgtaaacaaagagcctgcacaggcttcagaaattgaagcaaaatatgtggcattggatcatccaaagtttggacaggttacccctgtgaacagagaaagcaatgcgacaaagacgaagaaaaaatcgatgctatccacatctaagcctaaggcatcccaattttccacccctagaagttcaaatcctacaacaactcccaccaaaacattggcatctgcctcttcaactaaaaggggaaattctccatcaatatcttggaggaaaattacttccacagcagagaacagaaaagttccaaataaatctttgcacatgtcccatagtttggctcctagccaaccagatcctgctccacatactacaatgaggaaatctttgattatggagaaaatgggggataaggacatagtcaaacgagcattcaagacttttcagaacaatttcaatcagcgaaaaacttctgctgaaaacaaatctttggtaaaagaaaaggttccttcagaggtgacagagacaaggaatccaacatccatagctttgcgaaaggaaaatggacaccttaacttgcatttgctggaggctgattctatgactcgaacatgtgacgttcaggagggtccacgaagatgggcccaggggaattctgctggagtccccacaaggaagggggtgtggactgcattgcttgatttgaacctatgcactcttcttgcatgtcacgtgactcactcaactgagctatgtcaaccggactatttaagtaaaaactttgagtctttgataatatag

SEQ ID NO: 10837 - DNA, 894 bp, Glycine max
  Peptide Sequence Number=SeqID_102522
atgacatatattcaagttgttggcttgagtctacatggtaagggtaatttttctttgaatggcttgggatgcgacacacagaacatcactttggtcgacctggttctcggatatctatttcggtgtgaatacgagatgagacagatgttgcaagctgggttttcagatgttgcaaagctcaaacaagctaaaatcgatgattctttagttactactttggttgaaaggtggagacctgagtcacacatgtttcatcttcttgttggtgaatgcataatcaccttggaagatgttgctcttcaattgggtttacatgttgatggaagactagttactggtccaacatattatgattgggaacaaatggttgattggtggggtgttggtgccagacatgtcaaggaacagagttcactagatgtctctgcccctgcatgttatcgcatgtcgttcattcaaccaagggttaagcgtcagccatcatatccacttgcaactagtggagggctacagttttttggaatcccacgcggtgatgtgataggttataggtcaagattcaacaagatgcgtaacgaggaggaaagacacaaagtccaccatcgacatctttcatcattgtcacatctcgtcgaagcatcgcgtctccgtcagtgtatggaaaagacgcttcatccatctctctctctctctcttatcttctctctctatctgctgggaagacgtcgtcggtttggaggagcagtagtgaccccacctccaaaggctccacacaaagggagtgctctagaagccactgtcggaggaggaggactcatcatcgtcattgtcatcctcaaccctcagatctgttgtcttgcaacactctcatggcagcgaggacttcgccgatag

SEQ ID NO: 10838 - DNA, 447 bp, Glycine max
  Peptide Sequence Number=SeqID_102523
atggccactgttcaacacctaatgattgccaataggaagaggaagcctattatttgcaaaatcaatccagaccttaacaaagattccaaggaaactaccaaggctatagaggcccttctaacaactcttatgcagatctttcaaataggggtccacaacaacaacgacaacaagctcagtcggatattcaggttggataactttcaacacaactctctgagcatgaaagtggatctttctcagcaaacacacaggataatggtgagaaaaaataataaaaaaggagttgaaaaagaaaaggagaaaaatgatgaagtggagactagtgaaaaagtggaagagaaagtggaggaggaagagcaaatgaggatgaagacatggcagaccccattgattattacattggaggagactaagctcctcagccatgatcttcaaggagattga

SEQ ID NO: 10839 - DNA, 306 bp, Glycine max
  Peptide Sequence Number=SeqID_102524
atgtcaccagaacccccaattggttttctatacgatgtcattggggggctggtggtgctgcctagggtgttcgtgaaagggaggtgcttgggtgggttggaggtgttggtggagctgaacgagacaggtcaactcgggaggatattgaatgcgacgtgtgtggagatggggattaggaggcaaacgtgtggagggtgtggtggggctaggttatttccttgcttcgattgtgctgggagttgcaagattgtatggagaggagatgaaagggtagtggcgaagggaagagggagaaagacatgctag

SEQ ID NO: 10840 - DNA, 321 bp, Glycine max
  Peptide Sequence Number=SeqID_102525
atgtcacatcctatcagagcgttgtgtcccgacgtccttcagcacatggttcctttgagcaattcacctagtcatctgctcccccgaacacaaatgaaaaaccaccctggggcacttaggagtacacaacaagacacaccacacaatgggtttgtcaggtcactctcactaagtaagatcatagggagaccagtcagggtcacgatgttttgcgagaatgctccaaccatatgggatcagcataggcttaaaggagcactcaaactcggtgacccccaaggcctacactccgaagagtctgtcagggcctctccctcctga

SEQ ID NO: 10841 - DNA, 231 bp, Glycine max
  Peptide Sequence Number=SeqID_102526
atggaatgggccaaagataagagagaagataagcgatcaaattgtgctgatataggaagaatggaatgggccaaagacaagagagaagagaagccttgtggtgagcttggaaaagaaatgagttggaatgaaccagtcactagagtcatgagcaaaaggctccaagaggattgggttaaagctgctgaagaagatcctagggttctcatgaacctcagggtagatttctga

SEQ ID NO: 10842 - DNA, 1749 bp, Glycine max
  Peptide Sequence Number=SeqID_102527
atgcctcctcgcattcaattccacgctctggtggcatcatcatcatggatcgtggtaataacaacaataacggcgttgttgttgttgtcgtttgggtgcgaacggggacacgctctgaaggtgccgtttagagtaaacgacgtgctccccgtgctgccgcgcgagatctcgtggccggttctgaacaacctgcacagcgccgtcgacctgctcccttatttcgttgggtccctcactcctgccaatgcctccgtcaagtggaaaggggcatgcttcttcgataacaccgccaagattgagttcgcaccctctttggagggtgccactctctatctcaagacagaggctgcacatagctggacctgcatggatttgtatgtttttgcaacaccctacaggattacttgggactactacttctcttcacgagaacataccttgaagtttgactcgtgggaagagcctgcagagttggaatatgtgaagcagcatggggtttctgtgtttctcatgccatccgggatgcttggaactctgctttctctgattgatgttttgcctttgttctcgaacactggttggggtcagaaagccaacctggattttctgaagaaacacatgggagctacatttgagaagcgcagccagccttggcgtgcatatatagatcctgcagatgttcattcaggagacttcttagctgtgtcgaagatccggggtaggtggggaggttttgagacgctagaaaagtgggttactggttcattcgctggtcatactgcggtttgcttgaaggatgaatggggcaatttatgggttggtgaatcagggcacgagaatgaaaagggtgaagaaataatagtggtaattccctgggaagaatggtgggaattggctcttaaggatgattccaatccacagatagccttacttcccctgcatccagaaatacgagcaaaatttaactccactgcagcatgggaatatgcccggagcatgtctggcaagccatatggttatcacaatatgatattcagttggattgacactgtagcagacaactatcctccacctcttgatgctcacttggtaatttctgtcatgtctatgtggactagattgcagccagcttattcggcaaatatgtggaatgaagcattgaataagcggttagggactgagaagggattctttaagacaggaaaatttataaagagatgggacatgggaggaaaagtaatcctccaagaaaaaaacgtgcttaaaattcttacagcattttgccaatcaaatgaaccaaagtgtagtctttctttcggatttggatcttctatgggtttggatttgcatgatattttagtagagactgagaagcgtgggataccttttgatgaattactcaccattccagaacaagatgaatgggtatacagtgatggaaagtcgacaacttgtgttgcctttatcctttctatgtataaagaggctgaagtttttggtcccattgctaattccattcaagtaaccgagttcaccattcgcgatgcatacatgctcagaattttcgaggacaaccaaacacgcctaccaagttggtgcaacaatgagaatgaccggattccattctgtcagattcttggtgaatacaagatggaactgcctggctataacaccttggagccatatgccaacatgaatgagtattgcccttctcttcctccaacttatgataggccttctcgatgttag

SEQ ID NO: 10843 - DNA, 555 bp, Glycine max
  Peptide Sequence Number=SeqID_102528
atggaaaatctctttcagttctatcatactgttgattatcaaagagtcctcaaaggcggtccatggagttttgataagaatgttctgatattgggagccattaaagaaagagaagatccaaaagtcgtgcctctcttctacatgattggtgagggacttggaaactacatgggccaattccttgagtatgatgagaagaacaatgtcaatttcttgagatcattcatgcgcatcaaagtccttttggatgtgcgaaagcctctcttgagatcaaagaaaattataaagccagatggagaactcaaattttgtggaatccatggccatacaaaagatcattgtcgtacagtgttgttcttacccaaagatgatggaaaacgtgcatggagtccaaaattagggtgcaagaggatcttgatacctccaggatgctggagatgcaaactcatggcggtttcaaacaatgggggagacaagaaaatgatgatattaaatgcaccgacaagacaatcaattccaataataaggcagaccgtgacaattagaaatttatag

SEQ ID NO: 10844 - DNA, 108 bp, Glycine max
  Peptide Sequence Number=SeqID_102529
atgatgagactcaagcctgatgcagctacggctagggaggagaatagggcactgtattggatagggaaatcagaaatcacatgcatgtatggcagcttaaagagctag

SEQ ID NO: 10845 - DNA, 297 bp, Glycine max
  Peptide Sequence Number=SeqID_102530
atgaaagtagggttgagagcttgtttctctattgaatccttaaggtggattatgaggatttcacttagattaaagcgttcctcttcgtgcagtggtctggtgacaagcaacgacaactcgtgggtggtggagaaggagatctcgcttagtgagctcgtctcgctaagcgaaacttcacttttggcgctgagtcgcactggtctcgctaagcaattttccttcttgggtttgggaattgcacttagtgtggtcgtctcactaagtgaatttccctcttgggttgggaattgcgcttag

SEQ ID NO: 10846 - DNA, 221 bp, Glycine max
  Peptide Sequence Number=SeqID_102531
atgacttccggcatgtcacagaacttcacggattgtcaacaatgcttccttttgacttccgacatgtcacggaacttcacggattgtgcaacaatgctcccttttgacttccggcatgttacggaacttcacagattgcctaacgatgggtgccaagtacctcgaagtggtcaaacgagggtcgcatcccaacaaatagatggtccccagacgaaattagg

SEQ ID NO: 10847 - DNA, 291 bp, Glycine max
  Peptide Sequence Number=SeqID_102532
atggttggatgtcggcacaggaggcgacgccagggcactcaagctagagggcgccttggcgcgcgccactgtgtcaaacccgtcccccgagagggggaggttgacggctgcgtcacgctccgccttgttgaaggtgttggaggtgacgaggatggaagtgtcgcagccgccaaccatacagttgtggaagaagaggcggagcatggcgccagcagtggttggcgtcgacagttgcttgtgggtgacggcttttcggacgatgtcgaagaatttgggacagttttttggtag

SEQ ID NO: 10848 - DNA, 942 bp, Glycine max
  Peptide Sequence Number=SeqID_102533
atgggttggcctattaagcccatggactatgcaaatgacttgttaggaatgaatgtgacgttaaagaattacttggatgcacagtactgtggtgaaatagctataggaactcctcctcaaaactcttcatctgaaggatcaagcagtggcgaagcaagcgaagaagagtcaagtagtaatggtgctgaaatccgcaccactgcttatgttggaaacccaaggaggtcttcatttgtgtggctggccttgttgctgatcatcacttatttctgttcatccatttatcattatcagtttcagagcatgcctgtgcctcttactgcagaagaggccggcaagagggggttttcggagattgaaacattcaaacatgtcagggccttaactcagttggggcctcatcctgttggttctgaagctctgcaggggagaggggatgatttcctagtggggagtattgttggagccctgatttttatggagaaaggtgttatgctggaacttgctcgtggaatttctcaatggcctgacggattggagagagctgttatattcttatttaatactggtgaggaggagggtctcaatggtgctcatagcttcataacccagcatccttggagcaaaactattcgtgtggctattgatttggaggccatgggcattggagggaagtctattatttttcagatgtcgttgtatgtcgacaacaacgacatcgatcacccaaggacccgtctttgtaataacccgtcgttgttggggtccatttcaacgttgggtacgcctaagacccgtcgttgttgtggtccatttcaacgtcgggtacgcctaacacccgtctttgttgggtttccatttcaacatcggtggcgggctcacccgtcgttgtttgacagtatgtcaacgtcggttggtgagtacaccgtcgttgttctttga

SEQ ID NO: 10849 - DNA, 657 bp, Glycine max
  Peptide Sequence Number=SeqID_102534
atggtcaaatctgaaagacttagctacatcagaaacaaccaaaagaagcttagagttgataagtattctagcttacaaagttcattggacactggaacagctaaaagcttaaccaagggaaaaagagtcatcttaccttcaacgtttgttgggagcccacgttatatgaatcaactttactttgatggtatggcaatatgcagtcatgttggttttccaaatctttttattactctaacctgtaatccaaattggcttgaaattcatagattactttcaactttgaatctcaaaccaacagacagaccagacattgtatcacaaattttcagattaaaatatgaacacatgctgtcaaacttaacaaagggtcaattactgggaaaagtggttgcatatatgcatactatagagtttcaaaagcgaggactccctcacgtgcatttattgctatttctacatccagacaataaatatccatcttcaactgacattgacgagataatatcagcagaaatatcttcccatgaagatgacccagaactctacagattggtggaaaaccatatgatacatggcccatgcggaattttacaacccaactctccatgtatgaaagaaggcaaatgcagtcgtttttatcctaaacaattttag

SEQ ID NO: 10850 - DNA, 672 bp, Glycine max
  Peptide Sequence Number=SeqID_102535
atggacactactgttgctatacgcactcttgaagcaacttataagtcattagcggatgcagctgctgttgaaacttttctgaataccgagaaggtcagtgtgactggtggaaatagtgaggttgaagcagcaaaagttgggcgtttagttgcatcatcttcacttgctactatatatggtatagaccccaattggggacgcattgctgctgcagcttgttactcgggggtttcattccatcaagatttacttaggaagttggggaaaacagaagccctatcgacaaaagagggtaggacgccagctacaaattcaaacacccaaacagcacaggtgaaaacggcagctgaaacgacgacggtgcttgcaacgaaaccatcgattgttgctgttgttgttcttgttgaggctgaacctgaggcgatggaggcggagatgggtgactcagtaggcacgtggacgatggggaacgacagcagaggagataacagcgtggggggtttggaaaagatggagaagttgttaaaggtaacgacgacagaggaagttgcatggaagcttgagatgttaactttgtggtccttgtgcgaccgtgagctggtggccaaggcaagagtcaaaggaaggctagggatttcaaagtatatacacgcgacagtgacaattatgtaa

SEQ ID NO: 10851 - DNA, 255 bp, Glycine max
  Peptide Sequence Number=SeqID_102536
atggaaaaatccgacaagaggaatttcaaagaaaagaaagaaaagaaagcatacatcacttgggaagataatgacatggattcttcaagtgattcagaaaatgaaatcataaatctaggtctcatgacgaaagactatgaaagtgaagaagagataaagaccaatcatctacaaaatgcttacaacaagaaaacattaaagcatctcattcatgtgaatgttgtgataaattcaaagaagaaattgaagatttaa

SEQ ID NO: 10852 - DNA, 423 bp, Glycine max
  Peptide Sequence Number=SeqID_102537
atgcccaatggacaatgtgcgagtgaattgatcaaacaattcgagtcacaaacaaagttttaccaatctatgcatttgtgttctggtaagactactactcgtgatattgatcaacaagccactacccttgggggtcaagtaggcgcaaatggttatgctaaccaagtttttcctgcaaagataggtttagccaaaaggcctcaaaatgttattggccacattgttaatgttgatcaagaaaacggggaggcctttgacgaggaagttgagagtatggttactaagatattaataggaaaaccttatttgtgttcagctttgaagcaagggaagaatacaggtattgttggggatggaaaatttgagtatgataaaggactagcaaatttggctgaaagaggaacacaagatcatatctcctga

SEQ ID NO: 10853 - DNA, 517 bp, Glycine max
  Peptide Sequence Number=SeqID_102538
tgaagggaacaagacatggggattggatgcaagggacaatcatgattataagtggaatataaagaaggttgatggtgggcataaagatttgaatgagtataacaaatgtccgaagatcagggtgactgatgaagaactcgtgaataagtgggccaagtgggggtgcatggttatcaaagataacatgtatgagaataaagaaagtgaggaggaacgtaaaaatacagggggatcaagaggtggctatgtcaaatataggaggatcaatgcctcaaatatagtagaagatggaggggtatatggtgcctgtggaggtcataattctgtcatgcacgttgagattatcaacagtgatgagcaacttgtttatttgagggcttgggcgatagtgggtgattttaacactattctcaactctcatgatcctagtggagtttctactaatccttcttggaggggtgcacaagatttccaaagaatgatacaagagtgtgatctagttgatgctggtttctag

SEQ ID NO: 10854 - DNA, 90 bp, Glycine max
  Peptide Sequence Number=SeqID_102539
atgttgtgtttcggaagattgtggagcgaggtgcagggtgaggcacttacgggaacagagagatgtgtggcaagtgttacactgacatga

SEQ ID NO: 10855 - DNA, 500 bp, Glycine max
  Peptide Sequence Number=SeqID_102540
atggctgattcagagatttgcaaacagatatacactcctcaacaatatcataaagaaattaggagaaaaagaccccagtacaaacctcctagtaaacaaccttccaggaaaaagaacccaacccgaaggtattcaattagagcctctaactccagaaaacctactctcaacaaagagagacatgttaggaaacttagagataacaaaagatacacgaagcaattagaatgttatgctcgtcaccaaccaagacattactcgagagattgtccaaataaaactaatctgtttacaagagaagtagaactgataaaaagttgtaggatgaatcttattcctatagatgagacagtctctactgactcagaaatatattcaatagttagttggtctgactatacctctaaagaagaagaacttaataaagattataaaatcttaaacgaattcactaaaaatgaatacataaacctatacccagtagatgataaatacaatca

SEQ ID NO: 10856 - DNA, 396 bp, Glycine max
  Peptide Sequence Number=SeqID_102541
atgaaactcttaccagaggatcatagaaactaccctgtctattcaatgatgaatacgaaagttgggaagtacaggggttaccaatggttcttcttagaatcagataaacatgagtttgatctaataaaagaaactcatgacacaaagcttttcctgcccttatacaatgggaagtttttcattcctttcccggttgatcacaacaacaaactggttcaattcttccagaaagagaaaaaagataaggagatttacgaagccagcggatgtaatggacaacaaacccctcatttcccatccaccgacctctcaatggaagactcatccgacatcttctgttctgggaatatccaagacgaagaagatgttactatcacaaaatcaaccaagaattaa

SEQ ID NO: 10857 - DNA, 456 bp, Glycine max
  Peptide Sequence Number=SeqID_102542
atgggggggggggggagttgcctgtgcacggcggggtggcctcgacaattactgcctagttttttcctaagtgggagtgttgtgtggacacacttaggctatttccttgaggaaggtaccatattgcatctgagagttgaggtcaggtgcatgcattatactgagcatgattgtttggaacgatggactgatgatgattgttgttggggagtgatggctggatggaatgattgtgcgataatgggtgctcttcaacccttagctcaggctatagggaattcaaatagtggagaagttgttggagctgttgaggaaattgagaaaattttccgagtgatggcatgtccagaagggcaaaaagttgcttttggtacatatactctggtggaagaagctgagtattggtgggagaatactcgccaatgcctagatgctgaaggtcaagaggcaacctag

SEQ ID NO: 10858 - DNA, 249 bp, Glycine max
  Peptide Sequence Number=SeqID_102543
atggcgaaagcatgcaagtcgcaagaagaaattgcgagtgaagctaccaaacatgatttgaaggctctaaagaagcgccatttgcttgaggaagctgctcatgctcccgtctttaacaattggaatgcttttattgagtttagtgttgtatgtatttatatctttgaagggctcttagtggaaagagaaagtagagaatcttcaagtggaactgtagcaatgctacaaagctcaatctcgactgtttaa

SEQ ID NO: 10859 - DNA, 414 bp, Glycine max
  Peptide Sequence Number=SeqID_102544
atgacatcacaagggtacaagtatgctggttcaaagtggggatgcaaggtatacaaggggatacacttggcgttgcaaggacaaaaaaataaagataacctttgttatttggatggtcaagccttgaagaggagccatgatagcaaagtgaagaagaaagtgaagttttctaatgttgaggaagtgttgggagatacttcctttggagggggagtttggaagaattgtagagtttcaagccaaaagataagtcattcgggccatgtcgtggaagggaaatattggtttaataccatgagccaagacctcgacatctcaccaaggatggcacattatatatgcatggttgacctcctcgaccgagcaggaaatttggatgaagcatactcctttattcaaaaagatgccatttga

SEQ ID NO: 10860 - DNA, 381 bp, Glycine max
  Peptide Sequence Number=SeqID_102545
atggatgaagagcactggatgtatgataatatcatgtctgaagaagttgatatgaatgttgaaaatgaagaagatgctggcgttaaagtagaacacattgattgctctgatgcctttaatacttctcagttgtttgctagccatgatgaagttttacaatgggctcgatcagtggctcatgacattggatttgttgtcgtgataatgaggtcagacaccaatattggtgttcaaggaagggcctcatttctgttgatagcttgcgaaaagagtggtgagtataggcctaagaagaatgatttggtaagaacatgcactggcagtagaaaatgtggatgcccgtttaagttgcgtgcgaagtcagttttggaaggagaatga

SEQ ID NO: 10861 - DNA, 834 bp, Glycine max
  Peptide Sequence Number=SeqID_102546
atggctaagattgggaggcttgctctagagattgaaggccttgtggctgttagtggactaagtcctttgatcgcatgctcccaagatacgggcgatcggggactagtgtcaacttttgtggaacgctggcataaggaaactagaagattccatttgcccgtcgaagaggtgattatcaccttggatgacatcgcgtcgttgctacatctgcctatcgtaggggcattccacagcttcgagcaacttcatgttgacaacactgttgatatgttggtggaattactcaaggttagcactgcaaaggcgaagatcaaggcatgtcactggattgtagcagcgcaagcgtatttgttgctttttcttggatgcacactttttcctaacaagagtgttacacatgtgcacgtggtattcttggatgcactacgtgacttgacgcagagtgggagttacactcggggcgctgctgcactttgttggatctacaagcatttctcgtccgttggttctgccctagttgtcgaggattatgatgagaggagactgcatgcatgccgatggacctctggcaagacactgcccatgtccatgtctcgcaggcgtctggacagactgacccctgacatggtgtgctggattacgtatggtgaccaccgttcatctagagaatttgaggtcatctcattatttttcggccatctcaaatggggtcccttgacggtcattcaccgaccggagagggttgtacgacagtttggatacatccagactattctgccacatcctactacatttgcggtctctgttgaagaaattgatgatagttggatgtag

SEQ ID NO: 10862 - DNA, 288 bp, Glycine max
  Peptide Sequence Number=SeqID_102547
atgacgactctttgcaaatctagaagaaagagattccttacaatccaaaccataagcccaaatgagaagttcattttcatggggaatgaagtgaaagttccagtggaaatagttgagacttattgtttaaaacgcaacattggacatcgtttagatttactggaaactccttatggaaaacaaacaaaacacacaaagaaaggagtcacaagaagcactcagcttcttgaaattgtgcatacagatatttgtggaccttttgatgttagttctttcggaaaggaatga

SEQ ID NO: 10863 - DNA, 477 bp, Glycine max
  Peptide Sequence Number=SeqID_102548
atggtagagcaatttaatgaatgggtagcctggccaaggactcagcctcctcttcacagggaagatgaagatcctgccactcaggtaccctatcagtcggaggatgagtcatcagagtcttccactcctaagccattgatcaagaagaggaggataccacttctccacaacaaacaacagacaacagacccttccacgcctgaggatcaaaccaccccagtcttgtctccaaaaacctctcctgtagctactcttgtacttcatttgtcggaagaggaggaggctttcgctaagcgtgacactcagtggctaagtacgaggaagaatccagaagaagatgagctgtcaggttcgctgagcgcaccgctccaggtcatcaagcgcaccgcttcagcttatccgctgagtgagagaagcgcgctaagccacaatccacttatgcgcactaagcgatccagatttgcgctaagcgcatga

SEQ ID NO: 10864 - DNA, 429 bp, Glycine max
  Peptide Sequence Number=SeqID_102549
atgttgttgtcaatgtttagaacaagttggacgagatcatcctcatccattggtataggattcagcaaaggaggacttcgtggcaagatggtgttcttggcacaaactgtcctattcctgcaaagtgcttttcctacttcccttcatcttcagagagttgctggtggatttgggaatttcatcataaatagtagacccatcattctgattccttttgataccctacacggggacattgttgttttcattggaaattggtttacccgcaatcatacggatttgaggaaggctcttgatgatggaaaagatctttccatgctagatggtgttctcatcaatgagaaaggtccttaccgatataatgacacacatgttcctgatgatggaaaaggttcattcctttctctcaatttaactcttcgccaatga

SEQ ID NO: 10865 - DNA, 231 bp, Glycine max
  Peptide Sequence Number=SeqID_102550
atggcagcggaatggagaaggaagagagagaggagacgccacttcaaggagaatatgagtctagaagaagctcaccaccataggaggtcttggataagagcttggaggaagaaggagatgaatgaagggagaggaagagaagagcacgaaattttatgctctaaaagagctctgaaatctgaacccactaatccaagatcaatttcaagattctctactaagtgtgcttag

SEQ ID NO: 10866 - DNA, 423 bp, Glycine max
  Peptide Sequence Number=SeqID_102551
atgaagaaaagagatagaggccatcaaagtgtgtcattggagaataagacaggagattcaattgtggtcaagataagtgagaaaaataataatgttgataccggcgactgcatgattcttcatgaccatgaaggagaagagcattgttgtggcaaaggaacaaatgcgaggagtatttcttttttgccaagaagccaagagaagaaaggagattcggctaaagttgtgataaaacaagacatgaagggaggagagcataaatatgggtttaacaacaataaatgtgagaaggcagagaaggtaagggtggtggatgatgaaactggcgacaaacatgagttgtatgaagtcctaaggatgccatctagatgtgtaaaaactgatgcctcaagttttttactgagggcaggaggggtattataa

SEQ ID NO: 10867 - DNA, 158 bp, Glycine max
  Peptide Sequence Number=SeqID_102552
gtggccttgttggtgcttccgcgcttagcgcaactttggcatgcttagcaagcattagtgaattccggcttagcacgcgtcttctcgctcaacggatggactcaagcggtgcacttagcaggatggtccctcgcttagcaaacatgcacaacgcataa

SEQ ID NO: 10868 - DNA, 468 bp, Glycine max
  Peptide Sequence Number=SeqID_102553
atgaccatgattacgccaagctcgaaattaaccctcactaaagggaacaaaagctggtaccgggccccccctcgaggtcgacgatatgcctcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10869 - DNA, 649 bp, Glycine max
  Peptide Sequence Number=SeqID_102554
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctagtttggggcattatatttgccgcagttatgggactgttcgtaaatttgtatcggttacagatcgttcagggaaaagagctatctaaaaaagctcaaaaccagcaaaaaccccggcacaagtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10870 - DNA, 510 bp, Glycine max
  Peptide Sequence Number=SeqID_102555
atgcgtgccggagcggctggacatcaagcaggcgctgttcgccgagctggtgcgccgcgcgcggcccgacgccatcctggcgagcaacagttccagtttcccgatcagcgccatcggccaggggctggccacgcgcgagcgcatgctgggcctgcacttcttcatgccggcgcacctggtgccgctggtcgaggtggtgatggccgagaccagcgacgaggcccgcgccgacgcgctgatcgccttcatgcgccgctgcggcagcgtgccggtgaaggtgcggcaggacctgccgggtttcctggccaaccgcctgcagcacgcgctgtcgcgcgaggcgttcaacctgatcgaccgcggcatcgcctcgcccgaggacgtggacgcggcggtgcgcttcggtttcggtttccgcttcctggcggccggcccggtgatgcagcgcgaccacgccggcatcgacgtgcacgcggcggcgggcgcgaccatgtacccgacgttctgcaatga

SEQ ID NO: 10871 - DNA, 264 bp, Glycine max
  Peptide Sequence Number=SeqID_102556
atggcttccatgatggaggccatgttgggaatgaggcaactcatggagaaaaacgtggccaccgctgccgctgtcagttcggctgctgaagcagacccaactctcctagctaccgcgcaccattctcccccaaacgtagtaggacgagagaagagcacacaggggcacaacagaaacccccatttgggatacaatcgggtggcttacccttatggattgccgcctaattacacgccgccagtcatgcacgatgacgcgggccat

SEQ ID NO: 10872 - DNA, 528 bp, Glycine max
  Peptide Sequence Number=SeqID_102557
atgaccatgattacgccaagctcgaaattaaccctcactaaagggaacaaaagctggtaccgggccccccctcgaggactcaattgttttgatgaggaagttgcttcagaagcaactttcgggctcaaagaaagtttgatggtttggaagccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10873 - DNA, 288 bp, Glycine max
  Peptide Sequence Number=SeqID_102558
atgatggcctctaggaaaacaaaatcaaccgcctcccgacctcaagaaccctacaacacgatgagatttttttctgaggtcgcatgggaacgttatgagcagaacgttcactctaggagaaacctcccgaagaggaacgttacattatatgtgacagagtacgacgagttccgacgggagctcgagaggcgcagatggcataaagccttgactaggcagcctgatggtcacattgatgtggccctggtcaaggagttttatgcaaacttgtatgaccccagaggataa

SEQ ID NO: 10874 - DNA, 285 bp, Glycine max
  Peptide Sequence Number=SeqID_102559
atgaaaaagaagaagattgcaagttacgggagtcgatttgatgaagaaatgagtaagataggaaggttaggaggtttgggaatggaggaacgtcgcaagggagaagaggctgcgcaggggtttttgaaaaacgtgatatttatagaccaggatgcattgtggaggcagcctactggtaatcgattacatgaatactgtaatcgattacaggccatctgttctagtgtaatcgattactgtattcatgtaatcgattaccagaacaaaacaatagccttttcctaa

SEQ ID NO: 10875 - DNA, 384 bp, Glycine max
  Peptide Sequence Number=SeqID_102560
atgcatcacgagttcccggatgaagacgtcatggcctcatttgaagaaacgctagatatggacagggacaagtggatcgtgtggttcgatggggcgtcaaatgttctaggccatggcgttggggcagcattggtctctctggacaatcaatgtatacctttcacaggtggtggatatggggaatgggaacttagagttgaaatggaagagataggtaaggaagacgtcagtattcttgagacaccacaaactttgctggaaaaagccatgggagaagccaatttcgagacgctagagaaggaagttccgttcgagaagaagaagatagagttgaagatattgcccaatcatctgaagtatgtgttcttggaggaagataagcct

SEQ ID NO: 10876 - DNA, 472 bp, Glycine max
  Peptide Sequence Number=SeqID_102561
cggagaaaccgctgataagcgggttaccgttacccgaggagaaagagctgcagaaaaagagtggatccaaagggagatagaacaaaaaaacctccctcacagcggattcaattgcgaaaaccgctccttcttccacaaccgattgacgcacaagatccaagacctcatcgacagtgaccagtttaagttccgtattgtacctccagctggaccgaacattgctgggaatccactaccagctcatggggagagaaaggtgaatgccattagagaaggaagacgccttgtgcgaagggtggaacacataagcactcccttggagatagtctttgcagaattgagaaggcgcaatttgatcattactgtacgtctgccagtctcccagaggattactgatgatcccacaagaggttgcccatatcaccaaggaatagttggacacactctctatcaatgcactgcctttatttaa

SEQ ID NO: 10877 - DNA, 129 bp, Glycine max
  Peptide Sequence Number=SeqID_102562
atggataagagcttgaaggaaggagaagatgagtggaaggagagggagagaaggggcacgaaattttgtgcctcaaatgagcccactaatccaagatcaagtctaagattctccactaagagtgcttag

SEQ ID NO: 10878 - DNA, 647 bp, Glycine max
  Peptide Sequence Number=SeqID_102563
ggcctagatgtcaccggccttaaggagttgggacggttgatgggacccctccaaaggcaagccttccgcaaagtgtacggaaagattttagatttgaccacaacagaggtatttacagaagccattgtatccctcgcccaatactatgaccagccgttgagatgcttcacctgtggtcggagattcggcgagagagttggatcgtatgaagcaaacttgaaacggcgtagtgggcctaccacggaaatacttggaaggcaaggcaagggatatggcgagtcaagaaagaggtgggtcccatttgcgaatatactagctttgctaatctttggggttgtcctctttccaaacgtggacggtttcgtggacctatccgtgattgatgctttccttgcatatcaccatagcaaggagagcccagtggaaggaaaggagggagttctcttctcatgtggggactacccaaacgttccgttgatagggacgaggggttgtattaactacaatcccgcacttgctataagacagttagggtaccccatgaggggagtaccgacggaagagagcctctcgcctttccttgtgagagatttcagcgcgcaaagtttcaagattgtacaaagagtccacaaggcgtgggaaagccc

SEQ ID NO: 10879 - DNA, 378 bp, Glycine max
  Peptide Sequence Number=SeqID_102564
atgcagatcgatggcgatgcccaggccggcaccgacgcgttcaacatcggcgccggccagggcaagggcatggccggcggcggaggagggcgcggtggcaacggcacctacaaccagtacgtcgcctacgcgctgcagaagatcctgagccaggacgaccgcacccgcaatctgagtttccgcacgtacgtggacatctggttcgacgccgacggaaagatcacgcgcgtggcgctgggtcgcgccggcgccgacgccgagatcgatgcccgcgtggtggagacgttgcgcgccgtgccccgtatcgacgagcggccgcccgcctccatgggcatgccgatgcgaatcctggtgacgggtcgccgtccctctccctga

SEQ ID NO: 10880 - DNA, 120 bp, Glycine max
  Peptide Sequence Number=SeqID_102565
atggatacctcaaagccctacactggggcaatgaggggcaccatgcatgaacctcaaccctacactggggcattgaggggcaccgtgcatgagcctcaagtgaacctagtggcagattaa

SEQ ID NO: 10881 - DNA, 354 bp, Glycine max
  Peptide Sequence Number=SeqID_102566
ggtggacccttgggtacttgtacctatcacctttagaggactacacgtcctcgccttgagaggactacatgtcctcgccttgagaggactacatgtcctcgccatcagaggacttcatgtccttgccatcagagggctgcacgccctcacctccagaggactacctgtcctcgccttgagagggctacacgccctcaccttgggtactagttaccctcaccaaggactacctgtcctcgccttgagagggctacacgccctcaccttgggtactagttaccctcaccaaggactacctgtcctcgccttgagagggctacacgccctcaccttgggtactagttaccctcacca

SEQ ID NO: 10882 - DNA, 782 bp, Glycine max
  Peptide Sequence Number=SeqID_102567
ccctcgacgaaggtcgacacgctcagcgccaccaccgggaacaacacggtgcaataggcggcgcgcgccgggcccatgcgtcccaccagcgtcaggtaggcggtgaagccgatcaccgaccccggaatcgccaggtagagcagggcgccgacataggccgcggaggtgtcgaaacggaacggcacgcccgcgaccaggcagccggccagcaacacggcggcgccgtacagcatgctgtaggcgttgccggtgagcgggcggatgccggcgcgctgctgcagcgacgacagcatgttgccggtggaaaagcagaacgtgcccagcagcgcgaagcccagtccgagcagcgtctcgcggctggcctcctggcccgcgagctcgggccagaacagcagcaccaagccggtgaagccgatcacccccgccaccatcacgcgcggcgcgatgcgggtgccgaaccacagccgcgcattcaatgcgttccacagcgtggcggccgagaacaccaccgacaccaggccgctcggaatccactgcgtggccgtgtagaagcacaggaagttcaggcagaacaggcacagcccctggcccaggcacaacgcatgcccgcggcgatccaggcgttgcaatttgcggggcagcagcaacgcggcgaacagcaccaggccggccagcgcaaagcggtagaagatggacacgggaatcgccaccaccccaagctgcagcttgatggcgatccaggtggtgccccagatgacgacggtcaggaaatacaggaatag

SEQ ID NO: 10883 - DNA, 222 bp, Glycine max
  Peptide Sequence Number=SeqID_102568
atgatatgtccattacgatgccatgaagagaagcttgatgagataaaggaacaagccagaataatacattgtggcgatagggactatcaacaacaatgcatcaacaaaaagaggaaaactctagatgaggcttcactgttatcaagcgagttggagacccagcatgaccataaattgacctccactccttatggctcacataaacctgggtatagggcctaa

SEQ ID NO: 10884 - DNA, 330 bp, Glycine max
  Peptide Sequence Number=SeqID_102569
atgtcaaagatgatgaaccatttgtttaaagtcaaatgttattttcctaatagtgctggtgttgttgcctcctttggataccgaaaggatgtggatggccaatcggtgcggaaacaagaccttccaccttcgattcctgatgaacaaacaccctccccaccaccacaaagggattcctcatcttcactgctgaatgatgttctcactgaacttagggatcttcgggcctttgttggcgattgtttcgatgctatggattcatgcatcacgcgtcttgaggatgatataagcttcattcgacgatgctttgatcctccggcggatccataa

SEQ ID NO: 10885 - DNA, 201 bp, Glycine max
  Peptide Sequence Number=SeqID_102570
atggtcatccaggcttacgggagtgatgacctccctttcttgagagcgacgtcgagaacacttgaacgctgccccttcccaacttcacccgagcagttggaccatgatgaagcggcaagattggtcctggctactgatgtcgtggctgatggtttgccacttatgttcaacaaggatggggagcctcgcttcccattctaa

SEQ ID NO: 10886 - DNA, 504 bp, Glycine max
  Peptide Sequence Number=SeqID_102571
atgggaagcgaggctccccatccttggacccaaccaatcttgccgcttcatctggaagaagaacaggaagattggcacactaggctaaatgttgaagaaaggacacaaaatttcaaaggcactcaccatggtccaactgctcgggtgaagttgggaaggggcagcgttcaagtgctcaagaagaacacaatgaaaagtggtcaagggaagaatgaggtcatcactcccgtaagcctggatgaccatcttgtaggaatcctcagggttttcatgttttatctagcatttcagagcaaaaacactcgccgtagagaagagggaaaacttatacttcagaacattgtccctcacccactcatagcagcaacgacaagtggggacgatgccgaaggggggagaatcattgtgaccgggacagacttcttggtcggggaagcagtagaaggggttcctaaatcgaaccctggaatcactgctaccgatatggatggagaaatcaaatag

SEQ ID NO: 10887 - DNA, 168 bp, Glycine max
  Peptide Sequence Number=SeqID_102572
atggcattaggggtcatggcaactcgcccgggcgagttgttgcttcaacctgaagtaaccttgctcgcccaggcgagctgggcaccacttcagctcccgccagttattgaagagtttgcctctattttaaatggagggacgtttgatttcggggcaccgtcactatga

SEQ ID NO: 10888 - DNA, 1221 bp, Glycine max
  Peptide Sequence Number=SeqID_102573
gatatcagtggagctgccttggtcgatgatgaccttggacaccatgaagtttgcgatgatgatggagacaaccatcgggtcatcctggttgatggggttgttgcttgcaccgctgcttctagtgtctctgtctacctcgatcttccgctctatctctttgtctttttgtatcgtgattcctatgttgctcctcttggtacctccaatttgaaagcttcctctaggattgtagtgcgattggtcgtcagggtcgatcttggtgcttccttctctcttgctgcacttctattcggcttatctgacttcgttcctgaatctacacatttctaccagggtggtgagaagcatggaatgcaacgctacctctgggttaagatttcagatctaaatggtcatgaggtgagatctgctggttgcgtattgcacactgaagcactccacgagggtgtcaaagctgtctatggatcttggtgggagtccactataccaggaatccatatgctcatctggatttgcggtcccatcataccgctccaggttgagggtttccaacctaagggtatgttagctttcatgatgcggggtgtgattccccttggcggcgctcatcctctagctgatcatggtcagcctttagctttctcatctcttccttatggcatccctccatctctgcgagccttcgaaaggggtctcgcgtttgaggctagactgagtgctaaccatgggccaaagcgagctctcagacttcacacatcgactttgagaggtgcctttgttaagattacaagaagggggacttacaaaacaatggactatgatgctcaagagctggaagcattgcccaaaggattaagcaaattgattagtcttcggcatttggagataactacaaagcaacctgtgttgccttacagtgagattaccaatttgatctcgcttgcacttctgtctattgatacaagccataatatggagtctatctttggaggggtgaagttccctactcttaaaacattgtgtgttgttgactgtcatagtctgaagtctttgccactggatgttacaaactttctagaattagaaattctggttgttgaaaactgtgttaatctggacttggatctgtggaaggaacaccatgaagaacaaaaccccaagttgaagttaaaatttgttggattctgggatttaccacaactggtggccttacctcaatga

SEQ ID NO: 10889 - DNA, 663 bp, Glycine max
  Peptide Sequence Number=SeqID_102574
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtcattcatagtgatcatcaatcacttaagtacattagagggaaacgagttaaacaagaggcatgcaaaatggatgaacatttctcttccatttatgagagttgtgggaaaaaggcccaagatggattctatttggctgagggaaagctttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 10890 - DNA, 399 bp, Glycine max
  Peptide Sequence Number=SeqID_102575
atggcagcgcagttgatccatgatcgtgttgggatggagtgcctagagggtgtttgggagaccctcgaaggcaatgagaggtgccgattctgtggcacaattcgactcactgctacttcattagtacatcctgaggaacccgcacgcacacttcagcagcctgtggaatggatattacctacacctactccatatcgactagcggagccagttcaagtgatagaggtgtcatcctctgaagatgatcttgaagaggacccagaagagttacctcctgaacctgctgtggatgcccttgacttcccagaggatgatgaggacccactccctgatgttgattctcagaggatgttatgtcagcatctgaggcagactccacagaggagagcggccctgtag

SEQ ID NO: 10891 - DNA, 330 bp, Glycine max
  Peptide Sequence Number=SeqID_102576
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactg

SEQ ID NO: 10892 - DNA, 534 bp, Glycine max
  Peptide Sequence Number=SeqID_102577
atgacagacccttatgtaagaatgtcaacaagagaactaagggctaacttgcaggttgtaccaatgaatgacctgagagtagatgtaagtgtattacataattataataggaatttttctcaatcagggttcaataatagactgaatcttggtagggctaatcatgattatacttttgcaaatgatctgattacctattctaattcagtaatacttttaaaaacttctttcaaagatggtgcagcggtatatcaatcgatcagacagaatgccagagccatttctcagcaaataggggatatctctactataggaaatgatggatttactgcagggtatggtattgcgaatgcttatgttttaattcctgcgttcagggcagctgttgaaggaaaatcacctaaaggaattggcgacgccaaaaaagcgggcttgcctataccaaactggaaagttacttattctggtttaagaaatgaatacagtcaagtattgattatttcaatgcaatttcaacaggtggtagtctattag

SEQ ID NO: 10893 - DNA, 252 bp, Glycine max
  Peptide Sequence Number=SeqID_102578
atgttgctaagtagcaacgtcatccatatctgtgtaagagtggtcatgttggtgcgcataatccgcactcgtctctttgcagcggcccaggcaaaatcttgtcccggtatgcagagtagctatgcgatagcctcctcctctggttgtgctcgtatagttggccctcctccaatatcagggggtggcccaggaactgataaaagcaaactactagcccctcaccagggagtgcaagcctcgattaaccattaa

SEQ ID NO: 10894 - DNA, 93 bp, Glycine max
  Peptide Sequence Number=SeqID_102579
atgaacagcagaaaccaacccaaggtacttaggaacggttgcaattggggatggggtcacgaccgactgatcgtctccccttctctgtgctaa

SEQ ID NO: 10895 - DNA, 288 bp, Glycine max
  Peptide Sequence Number=SeqID_102580
atggatatggaagctgagatacagcctatgagggagattggtctgaagtcattaatagcttgggggtcctttactttaggaatgagagcaatgaaggaagaattgcttcctttaggaaaagaggcattaacaaagaattctgcaatgaatctaaggaaatcaggtttgagctccttccaaaagtgcttaatgaatctgaaattaaatccatcaggccctggacttttatcatttccgcagctccacacagcacaagtcacctcctcttccttgaaaggttcaccatga

SEQ ID NO: 10896 - DNA, 278 bp, Glycine max
  Peptide Sequence Number=SeqID_102581
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcaaggatttggaagtagaacttgaaactaccaaactgaaaaataaggagaacttgcagcaggctattctaattgtgagagaaaggtttacccaaatgcagtgggatatggaggaacttagacgacaatcattggaaatg

SEQ ID NO: 10897 - DNA, 231 bp, Glycine max
  Peptide Sequence Number=SeqID_102582
atgtcgagcgtctcgatatattacgggactcaatccgacatccgaggtaaaagttatcatcgtttgaatttgctcaaagcttctgttctgaatctcgagcgtctcgatatactacaggactcaatcggacatccgaataaaaagttattatgggttgaatttgctacgagcttccgttttctattacgagcgtctcaatatattatgggactcaatcgaacatccaagtaa

SEQ ID NO: 10898 - DNA, 477 bp, Glycine max
  Peptide Sequence Number=SeqID_102583
atgccatttatctatttgcagtcgttcggagtccccgtcgcacctagtaaggtgattcggccacccatcactcgagcttttattgagaagtattgcacgcagagacaggcacagggtggcgaccctcatgccccagatgcaccgcctccacctcctcaggctgacccagttgggtcatttgatacagagcggtatttatggcatttggttcgccagcaagcggccaaccacagggcgcacgtgcaggcccatgactctctatatcagcttagcctcagcctgcatagccagggttttgcttcttttccatgccctactccatatcagttcacggcagaggtcgcatggcccgaagattggcctgaggcccaggctgcagaggcacccgcagagactcccggcgagccagatgaggcccgcgaggatgaggagatgtcagatttgctcgacttcttgggagggagtggagccacatga

SEQ ID NO: 10899 - DNA, 323 bp, Glycine max
  Peptide Sequence Number=SeqID_102584
atggtgggctacatgccttcaagctttgcagatttagtgtttgctggcgagaggattgaagtgggtctgagaagaggcaagtttgattatgccgcttcgatgaataggaagcttagggcaaacgaagagaataagaaggagggagaaacccatgttgtgactgccattcctacagggcaaaattttccactagctcaacaatataaatactcatccaatatcagtccttctcattacccaccaccctaccaaccaagaacactcagtcatccacaaaggtcacccctaaatcaaccacaaaacccgcctgttgcacatccaag

SEQ ID NO: 10900 - DNA, 465 bp, Glycine max
  Peptide Sequence Number=SeqID_102585
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgggtcgaggctgtgccgttgtggtgtgtcacgtgaccgcgtgagcatgagtcgtgttatgttttccttgaaagggaaagagtcgtatgattgcgcgcgtcacgtgagtgcatgtggagaagaaatgttttgcttcaaccgtgaggagaaaaggatgagaagaagtgttgttagcctggaaccatga

SEQ ID NO: 10901 - DNA, 525 bp, Glycine max
  Peptide Sequence Number=SeqID_102586
atgaattcctcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataataataccaactgttgccactggtatggagtcctctgccacaaccttacttcccatcttcttcagcttcacctcagctcttcagattatgctttctacgatgaggaagcttatcggagatggagctttggtggagagataagtccttgtttggctgatttaaagcatttgaattacttggacttgagcggcaatgattttgaaggtatgtcaattccttctttccttgggacaatgacttccttgactcacctcaacctctctgatagtggattccatgggaagattcctcctcagattggaaatctctcaaatttgtaccctctcagatcgggaatctctctaagcttcgatatcttgacttga

SEQ ID NO: 10902 - DNA, 174 bp, Glycine max
  Peptide Sequence Number=SeqID_102587
atggaagatgcacccgtgagcctcgcctcactcacccgcaaaagggataatgatggaagaggactacaagccaatccgacaactccaaaggcggctgaatccaacaatgaaggaagaggtaagaaaggaagtgctcaagctattggaggttgggctcatataccccatttctga

SEQ ID NO: 10903 - DNA, 324 bp, Glycine max
  Peptide Sequence Number=SeqID_102588
atgaagaagcagctgaggaagaaggagaagcagctgaagaagaagaagaagcagctgaggaagaaggagaagcagctgaagaagaagaagaagctgctgaggaagaggaagatgcagcagaagagacagaatcagatgatgattctgaagccaccccatgatcatcagacctttaattttgttttttcactgttactagatataggggcatgtccctttgaacaattcattgttactgtaggaaacgatgtatgcatgattcatgattttgagggggagctgtatgacgttgagggggagactgctgctgctgatgatgactga

SEQ ID NO: 10904 - DNA, 925 bp, Glycine max
  Peptide Sequence Number=SeqID_102589
atgccttcagaggactacacgtcctcaccttcagatggctacacgccctcacctttagagggttgcacgcccacaccagcagagggctacacgccctcatcttcagaggaccacacggcgacacgccctcgccttcatagggttacatggcctcaccttcgaggactattcgccctcgccgctaaaggactacacgtcctcaccttcagagagctgcactcccttgccttcagagcactatccgtcttcgcttttagaggactacacgtcctccccttcagaggtttgcacgccctcaccttcagaaggctacactctctcgccttcagaggactacacatcctcgcctttagagggctacacgtcctcaccttcagaggactacactttttcccctctagagggctgcacgccctcgccttcagaggactacacgtcctcctcttcagagggctacacgccctcacctttagaggactacatgtccttgccttcagagggctacacgccctcacattcagaggactacacatcctccttttcagagggctacacgccctcgccttcagaaagctacacgtcctcatcttaagaggactaaacgaccttgccttagaggactacacatcctcgccttcagagagctacacgccttcgccttcagagggctacataaagctagacaccctcgcctttagaggactacacgtccttcccttccgagggctacccgcccgcgagttcaatggactgcacgtcttcctcttcagaaggctacacgcctgcgctttcagagtactgcatgtcctcacattcagaggactaaacgtcctcaccttcagagggctacacgccctcgccatcagaggactacacatcctcgtcttcagaggactacacgtcctctcctgcggaggatcaacac

SEQ ID NO: 10905 - DNA, 349 bp, Glycine max
  Peptide Sequence Number=SeqID_102590
atgggccgcgtctacacgctggcgatggccgacgtggatcatttcaaggccttctacgacacccatggccatgacgtgggcgaccaggtgctgcgcatggtggcggcgcagttgcgccgcgtgccgggcggcggctacgcctatcgctacggcggcgaggaattcacgctcggtgttcccgggcaagaccgcggtcgaggccatgccgcacctggagaccgtgcggcgcgccatcgaggcctaccagatgcgcttgcgcgacaagccggcgcgtcccaaggccgaccagatcggcttgcgccggcgcggcgcgcgcggcggccgcaatgcgcgcccgttgcgggtgacg

SEQ ID NO: 10906 - DNA, 507 bp, Glycine max
  Peptide Sequence Number=SeqID_102591
atgcatcatcaaccatcatttgttgaaacacccagggagataccatacaacgattggtatagagcagagaatgctgggaaattcccaaaaatatcacatacccagaaacaagttggtggcagttattatgttatccgggaaatcgttttggagctagaatatgagtctaaaatgaattcttcaaacagtgtggataagttttttgtgggaaagaaatttgatgagagtaaactacttaccactgaatctgtgaatgttccatctggtaatattgagattgaaaaagaaagccctgtcaaagatgattctcaatcggtagttttagatgacaatgagagtgttaacactggatatgagcatcttgaagaaaacagacagcaacagacttcctatttggagaggaggttgtctgacaaacttgaaattatgtctacaccagtaatcattgcattagcatcacttttagttatgaatatagtaaatatagtagttacagataagcagtga

SEQ ID NO: 10907 - DNA, 212 bp, Glycine max
  misc_feature (185)..(185): n is a, c, g, or t
  Peptide Sequence Number=SeqID_102592
atggtgaaagttggaacctcttacgtgccgatcaacgtctcattttcgccaaaagttggcccagggcttcccggtatcaatattgtctccgtcacgattctcatcacaatcttttgtaagaggttgtcacaacctatccttcgacgggagggcgacgtgagactcacggatgcgtcttccaaganaggaaaatgcgtggagtcgccaccaac

SEQ ID NO: 10908 - DNA, 219 bp, Glycine max
  Peptide Sequence Number=SeqID_102593
atgcaaggcaaaattgattgcaataacataaatgagataagggaagagagaatgcaaacacggttttatactggttcgaccacttcccgtgcctacatccagtactcaagagtttcgttgctggtaattgattatagacatatggtaatcgattacatgttaaaaattcaaattcaaaacctttttcaacagctatttctcaaccctgtcttctggtaa

SEQ ID NO: 10909 - DNA, 332 bp, Glycine max
  Peptide Sequence Number=SeqID_102594
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttacaattatgaacatatggataaagaagaagcaattatcgtgcttgtggagctacttggaggtgcatatgaggaaatgtgtgaagaagagagatgggatgaggcagcaaaagcctatttgtttcatctagttggttgtaccttatttgctaataaaaatgcaacctatgtggag

SEQ ID NO: 10910 - DNA, 450 bp, Glycine max
  Peptide Sequence Number=SeqID_102595
atggtggttcgggccttcgacggcactcgccgagagctgcctgttggggcgcccttggcccgagttatgttggggaacggttatgaacccgggatgggtttaggcaaagacaatggcggcataactagcctgataaaaacccaaggaaatcgtgggaagtatggtttaggctataagcccactcaggcggacatgaaaagaagcaccgcgggagggaaggacagtggtcagagctcgcgttggagacaagaaagtgaaggaagcccgccctgccacataagtagaagctttataagtgcgggtctgggagacgaaggtcaagggttcgcgatatgtgaagatgatgttccaagtacttcggatttggtccgaccatgccctcctgatttccagctgggaaattggcgagtggaggaacgccccggcatttacgcaacgagcataatgtaa

SEQ ID NO: 10911 - DNA, 186 bp, Glycine max
  Peptide Sequence Number=SeqID_102596
atggggaccaccacggtgaatacgaagtgccaagaaggccgaaccctttccttcttcactcctccctctatttatagcaaaataggggaggagcttgccacccagctcgcccaggcgagccaggttgcttcctccagaagcaaccgccttctggaggaagaatctggaaggcccaagtgggcctga

SEQ ID NO: 10912 - DNA, 604 bp, Glycine max
  Peptide Sequence Number=SeqID_102597
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgaagtgattgtccaagtggatgtcacttgcagcagagtggagagtgggtgtggtgtgaaggattggactgtgaaagcctttcgtggttgtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10913 - DNA, 902 bp, Glycine max
  misc_feature (44)..(44): n is a, c, g, or t
  Peptide Sequence Number=SeqID_102598
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgcggcgcctttcattgacggcgcggctaaccgcatatttctccttgtcgtcagcggccgtgttgttgggcctcggcattctgattgccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10914 - DNA, 318 bp, Glycine max
  Peptide Sequence Number=SeqID_102599
acttatcaaggtaatccttgtggcgtctaccctgacttatcttccttcaccggaagtggcgtctaccttgacttatcttccttcaccggaagtggcgtcatccaaaccttcgtagcctgtatcaaacgatccgctcctactcaggttcacatcaactccctacaccctgccactgtcattctgctcccacgaacaagatgcaatgtggtgcgtaccaacaacaaccaaatctcaggaaatagcctaagcgtgtccacacgacactctcacttagggaactgtgctgagtttgtcgagaccacccggttgtgcacgtaa

SEQ ID NO: 10915 - DNA, 225 bp, Glycine max
  Peptide Sequence Number=SeqID_102600
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaacatttctcttcttacaccccttgccctagcaacaagaaaatatccacagcagatggctctctgatgactgcagcag

SEQ ID NO: 10916 - DNA, 396 bp, Glycine max
  Peptide Sequence Number=SeqID_102601
ggcctctgtcagtcctacagggtgcccatccccccagcaaggtcatgccatcgtgacataaggatcgcgcccgcaagacaccccaatggacccagagaagttcaacagggtcctgggatttccaacattgattatgggcctctgtcagttctacagagtgcccgtcgcccccaaccaaggtcatcaggcccccctactaaccgagctttcatcaagaagtacttcgcccctaggcaggcgcaaggcgagacaccacagcagcttggggatggccagcagcgggcaatagatgcatcactgccatcttcagagcccctcagctcatctacaaaggttggagcgttgcctacgacccgtggccaaccagcaggagaccaagtccaaagccaaaggtag

SEQ ID NO: 10917 - DNA, 291 bp, Glycine max
  Peptide Sequence Number=SeqID_102602
atgaggaaaggggagggggggagagcggaaaaggcgaaaaaagcggagttacttattgaaaaaagaaatgaagggccaacccttatttctgaaattgcggaacataagaagattccgcttaaatttctggaaaatattctgcttgaactcaagaaatctgatatccttgatagcaagaaaggcaagggtggtggatacttctttaaagaaaatcctgccgatgtaaaactggcgaagatcattcgcctggttaatggtcctattgcaatgcttccttgtgatgccaaatga

SEQ ID NO: 10918 - DNA, 504 bp, Glycine max
  Peptide Sequence Number=SeqID_102603
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaaatgaactaaaggctaagtgggaagatgagaaggtacaactagagaagtctaggaatgatgctgagaagaaatacaatgaaatcaatgaacagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 10919 - DNA, 282 bp, Glycine max
  Peptide Sequence Number=SeqID_102604
atgggtttaggcaaaaacaacggcggtagaaccagcctgataagcaccagaggaaaccgtgggaagtttggattatgctataaacccacgcaagcagagataaggaaaagtgttgcgggaaggaagagcggaagccaaggacatgaaggccaagtcgttgtggtatacgaggatgactctccgagtgggtcagatttggtacgatcatgccctcctggtttccgactaggaaattggcaagtggaggagcgcccggacatttacgcgacaagcataatgtaa

SEQ ID NO: 10920 - DNA, 201 bp, Glycine max
  Peptide Sequence Number=SeqID_102605
atgtatgaagttgtctctagtggtgtcgatggatctactactactgggggagtggggagagcgaggatgcaggttgccggtaatcgatcatcaggcatgcagtccaacctggctttatgctgttatagtgggttgcctgtgtggcttctaaggatgggtcattctcgtcgtatcgaactagctcaccagagaagaagctag

SEQ ID NO: 10921 - DNA, 234 bp, Glycine max
  Peptide Sequence Number=SeqID_102606
atgaccaggagtaaaaggtttgtggaggctgaggatgaggatagtgttgtgcataagaaggaaactgctgacaagaaaggtactgatggcaagaaaaatgaggaaaacatcatagtggaaggaaactgcagtgctgtgatccaaaagatccttccacctaagcataaagatcctgggagtaagattgggagagttggaaataatgcccactcaaatgactttacaattagttga

SEQ ID NO: 10922 - DNA, 84 bp, Glycine max
  Peptide Sequence Number=SeqID_102607
atgacaggagatgcattaaaatctactcatatatctcccaagaaaagtggacatgcgacttatgaagacaacaacaaagcatag

SEQ ID NO: 10923 - DNA, 1170 bp, Glycine max
  Peptide Sequence Number=SeqID_102608
atgggtgttgaagtattggccatcaaaatttctattcttgtgaacatgcggtcttttaagaaaaggttctatcatgtcaaagtcaaaagtctagaagtagccagcttacgaaagctggggcagcggatggatcaagatctggcgatgatagaagtgtcagttgatgccattgcatctctcactcaatacgatgaccaatcgctcagatgcttcagttttggggactttcagttagcaccaaccatagaggagttcgaagggatcttaggatgcccgataggaggaaggaagccatacctcttttctgggaacgaagtaacgggaatactaaggaagtgcttggaggagaaggcaaaaactctagcaagccaaggagagtgggtatcatttatcgacgtattagcactactagtgtttgggacagttctatttccaaatctagacgggctggtggatctagcagcgatcaacacttttcttgcttatcaccacagcaaggaaagctcggtcattgctgttttagcagaagcatatgatacattcgacttaagatgcgagaagagcaatgcgagaattgtctgttgtacgcttgctctttatgtatggttggtatcctgtgtctttaatcatagaggtagatctgtctgtctccaacaaggtcatcacatgtgctcgggaaaggacaaagcaaattgggaagaactcttggcaggcatgataggagcgtccgttagttggttcccacggtggaaaggagggttaggataccctatgagaggtgcaccatcagaggaaaccatcacgcctttcatcgcacaagggttcaatgaagctaatacaaagatacttcagaggattcgtaaggcatggaataaagtcactagagttaggaaagaatgtgatgagctgaaagatatcaaaatgaccacagatgaagcactagagcgggaaacaaaaaaagccagaaaggaagagtgtagcaggaacaagttccgaggggctttcttaggcagcagtaatgagatcaaacttagaaaggctgagagggataaatcaaggatggagagcatgatgttagaggataagttaaagagttgtcagagggtgaagagaagtttgaaaaagcagttgaacaagacggaagagaatatgttgataatcattgattaa

SEQ ID NO: 10924 - DNA, 384 bp, Glycine max
  Peptide Sequence Number=SeqID_102609
atggacaaagatcagtggatgtatgaaagtataatgtctgaagaagtggatatgaattatgaaaatgaagaagaatgtggtatgaatgaaccacatgttgattgttcagatgcgctcaatacttctcaggtgtttgacaaccgaaaggatgttttgcggtgggctcgatccatttcttatgaaaatggatttgtggcggagattgtaaggtctgacacaagcacaggtagtagaggaaggacttcgtttgtgttaattggctgtgaaaggagtggcaagtataggtgtaggaagaaagaatttgttagaagagacactgggactaggaaatgtgggtgtcccttcaagcttcgtggcaagccagtgattggaggacaaggctag

SEQ ID NO: 10925 - DNA, 540 bp, Glycine max
  Peptide Sequence Number=SeqID_102610
atgttactttgggctttgagtagtggtactaccgggttttataaccttgctgcctctaacaccttaagaaaaagcaaaatgcgaggactaagacagtctgtgggtctaataatgaaaaagagcctagttaagaaaaatagccttagattttatcgtgattggaaaaagattgaagtatttgttgtatcaaaggcagtcatccagggttataagtgcttgttctcagtttgtcatcctcctctcaattctaatccttcttcctcatcctccattgactcagtttgtcatcctcctctcaattctaatccttcttcctcatcctctattgagggtccccactcttcaccttctgttaaggcttccaagtctgatactattgtctcccaacattttggtcctgcacagtcttctaatttggcttcttctgcctctgttacagtgttgtctcatgtccctcctcagttgtctgcaactgaatctcccaatcctcctcaaccagctcttgtcaaaccaaacaatctgcatcctatggttacatga

SEQ ID NO: 10926 - DNA, 264 bp, Glycine max
  Peptide Sequence Number=SeqID_102611
atggtgattttccactatggagatgtagcagacgataaaggagaagaggttagaggagggctaaaaccctatactgctagaatgaccaaaatacaaggcccaaaagaaggaaaaacctattctattatttacaaagaagagtggacccaaccttggcccatggactcagaaatctaccctgaggttcatgagaaccctagggccttctttagtagctctagcccaatcctcttggagtcttctatccaatacccttgggggtag

SEQ ID NO: 10927 - DNA, 339 bp, Glycine max
  Peptide Sequence Number=SeqID_102612
atggtgacaaaaagggtacaggatgcttcctccgagaccaccattccagagccattcactcttcatcctgaggcaggggaagaacaggtgagaccagagactgttgctactcctgagagatcccttgagggcatatcagagcctcctacaccagtggtaaacctctcctcaccacagcctgcagatgacccttccactactttacttgacataccagaggatcagaccacaccagtcctggcactgaacacttctcctttagctactccaatacttcatctgacaaatgaggaggatgctcatactcgggatacacaagatctgtctcaagaattttaa

SEQ ID NO: 10928 - DNA, 222 bp, Glycine max
  Peptide Sequence Number=SeqID_102613
atgggtcaatcatttgcttcattggtttcaacggtggcagctgcggaatccgctattgggttagccattttcgttatcactttccgagtccgagggactattgctgtagaatttattaatagcattcaagggtcagggcctttctcgctgggcgagcgcatccgattgattcgaaagtcctttcctaaaccacttcccgttcagttgctgaaagatagatag

SEQ ID NO: 10929 - DNA, 483 bp, Glycine max
  Peptide Sequence Number=SeqID_102614
atggagcggtatctacggcacttggttcgccaacaggcgaccaaccaccgggggcaagtgcagatacatgagtgtctctaccagctcagccttaatcagcagggccagggtttcgctccttttgtgtgccctactccagatcagtttagggctgaggtcgcatggcccggagattggcccgaggcccaggcaatggaggtgcctgcaggagctcccggcgatgtagaggaggcccgcatggatgaggagatgacggacttgatcggtttcttgggaggaagcggagccactaactgtcgcaacctacccttcggcgggagggcgacgcgtgactcgcgggatgcgtgttccatgaaaggaatacgcgcggagtcgccacaacgtttatttgaggaaaacgtcggaaaaaccagaaaagacgcgatctacgaacttttaagtgaaaggttcgggagttgtatttacgcacggggaagctattag

SEQ ID NO: 10930 - DNA, 240 bp, Glycine max
  Peptide Sequence Number=SeqID_102615
atgccgaggcacacggcttcgataaaggacattcagcccccactggccattggcgaccatatactcgccggagaaccagatcagcgccacgaagaacagcgcgccgaccagattgccgagataaacgttcagccagttggcgcccagctggccccagctgatgcggccgctggccttggcgatgacgatgagcacggtagaggtgaacaggtcggcgcccgacaccaccaccagcattaa

SEQ ID NO: 10931 - DNA, 171 bp, Glycine max
  Peptide Sequence Number=SeqID_102616
atgaccgaacttaacgagaaattagccaacgcttgggaaggtttcagcaagggtgactggcagaatgaagtcaacgttcgtgacttcatccagaaaaactacacgccttatgaaggtgacgagtccttcctggctggggcaactcaggccaccaccaccttgtgggacaag

SEQ ID NO: 10932 - DNA, 237 bp, Glycine max
  Peptide Sequence Number=SeqID_102617
atggagatggcaaggaagggggaagtggtgttgtgggtgcttcagatggtccgtggtgtggatgggcagcagcggcagtggaagtggatgagccctttcattttttcgatgattcatccatttgatgaattttttgcagatttcaatcggttgaatcaaaggaggattgaaaatgatgaagtttgggctttgtgggatgtgatttggttaagaattgagggagttatgaagatttga

SEQ ID NO: 10933 - DNA, 517 bp, Glycine max
  Peptide Sequence Number=SeqID_102618
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatctttgtgcttcgggggaaggatgcgttgaatgaccgcactacagttaccttccactataatagtatcactatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10934 - DNA, 729 bp, Glycine max
  Peptide Sequence Number=SeqID_102619
atggcaccgaagatgaaatatagagtccctatatccttgtggttagtggagaacagccatcggaccggatttgtcataaaatgggagattctttcgtttccttccttatcagagagggggccccttcttagggagcggggcttatttcttgaaaaaggggggagtgagaggggaaggaagaatggaaagagggggggggaaggtccggaaagccctcactttattgatgggatggaaatttggatccccttttcttttcctctcccccccccggttctggggtcaggaaaggggtcaacgcaaggatcttacttcgaagcaatctctggagttttcccttatccgaacgggtcttgcaagaaaataggatttcatattgagctccaaatattcgctattgggataggatggttcctactagctctcccccctaagaaccgcacgtgcgagttcccccgcatacggctcaagtggcgaaggcgcgcatcctcttgctgggagaggaacgaatccttcgcgcttggtaagcgcttcgctgtagccaagcttactgctagcctatcgcctagagccaagcttcgaccgcgactgctcgtagcttctgggcgccttattccgtcacccgagatccaagtcagcaccggcaaagatctcttcctcgcggccgggccggcttggaagcaagctacctgtcgcctatctcaccccctttcttattgcgagacctag

SEQ ID NO: 10935 - DNA, 282 bp, Glycine max
  Peptide Sequence Number=SeqID_102620
atggagggagccaaaatatccaaggaaaacacatttgatggctcaagcagcaagcttatcaagacctggagacaaaggaagaaggcatccgatttatcaaaaaacaggctgtcaaaactgcatcaccccaatgccagccaggtacattggcatgaagtaataatgtccgagcaatctcaaaaagatgcctattattcctttcggcaatgccattctgttgaggagtatgaggacaagaggactgatggagaatgtcatgcactgacaaaaaagaagaaatag

SEQ ID NO: 10936 - DNA, 510 bp, Glycine max
  Peptide Sequence Number=SeqID_102621
atgaaaatcggacgccctcggcgtccgaattgtagtctggacgaaatttaccgcccgattggggctgcattctcaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgcctttaaaaaggaaatccttgttagtttcttttcctccgcttatcgatacaacaaaaacacagcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggag

SEQ ID NO: 10937 - DNA, 222 bp, Glycine max
  Peptide Sequence Number=SeqID_102622
atggcgattcaagcagaggacagtagaactaatcagaaggtggagggatttaaaccacagttggttgatgaattggcattggaaccggttgatgatttagttgagcttgaagaaattattgaggaagcagaagagaaggttgttgagactgaaaagaagaagggcaagagtgaggctaacatagaaaagaagaaagaggctactcctattgaatgcaaggag

SEQ ID NO: 10938 - DNA, 207 bp, Glycine max
  Peptide Sequence Number=SeqID_102623
atgggagttcaaatagcaactaggcccacttgggccttccaggatgttcctctagaaggcggttgctcctggaggaagcaacctagctcgccaggaaaatcaaagccaaggcgcttctgtaacgtttccatgggtgatttcgcgaagattttcaaccgttcttcgacgttcttcgttcgttcttcgtcattcttcggtcttcaaccg

SEQ ID NO: 10939 - DNA, 196 bp, Glycine max
  Peptide Sequence Number=SeqID_102624
catcccttatatagaggcactagccaagggtgccgctacgaaaacaaaaggtgctagaatgcgaaaagaaaataacagaaaagtggaaaatgatgacaatgcagtgctgcacgatggtaagcaacatgccaacagcatatttcctatgaaccagtatcctcctgacagctcagcaccttctaacagattctgttaa

SEQ ID NO: 10940 - DNA, 135 bp, Glycine max
  Peptide Sequence Number=SeqID_102625
atgatcatcttaaggctagatccaagaccagaaaaccaaagacctcaagctggcataactggtacaaacacaaacatatggggaccttcaaaagaggttcaggctatggaagaaagctacggtttagccgtttag

SEQ ID NO: 10941 - DNA, 519 bp, Glycine max
  Peptide Sequence Number=SeqID_102626
atgatggttaagaaccatcatcaaatgtatcctttaaccgacgtaggaagtgttttgtctagtattgggttgaaggactactctaagtttagcctttcaaagcataagaattatgtatggcgatattggcacatccccactttacgtgtttttagacatcttcaccaatggtattcatcacaacgaagacattatggggggttttgtctcataatctacaccattatgatcatacccatgattaagcatgtcttcattgtactacatgctaatgaccatggcaatgttctttctgcaatgagtgggatcagtacctccttaggtcaaggaattggtatctacaatttatttaaacatgacattggagtattacgtgctttcaatccaaaatttgattatttgaaatggaacagtaaacaaggatggttatcattcgatggagtcttactatacatcacaggtaggcttggtcctacaaggctcctccattgtatgagactgataggtgttgctgagtga

SEQ ID NO: 10942 - DNA, 891 bp, Glycine max
  Peptide Sequence Number=SeqID_102627
atggattgtttaaaaaaaaattggtttgctactctcgtggacggcgtgtcccgtgggacagtccatggtcccgagcccgcttacccacccctatcaacggtgaagcgtccactgccaccatcagcgagtgatgacgatatagaggacaggaagatgaagaagaaggtgaagccagtggaaaacaatgacgacgtggagcgcgtggagtggctagcgcgtttcgacgataaccttttgtttgaggtgttgaagcatgtggacgtgcggaccctgacaatgtcgggtggacaaatgttgactgcggggagcaacaactactatccgtggtcctcacttggtgtcgcctccatgcattttatctcttccctctctccaagcctcaacaaacatcatattcttcctcaacactggctaaggttatattgcagtgctgagaccattaaggcagatctatcgtcgaacaaagtgaagaaacctgacatcatctcagctctggggaaaaaagaagccactgccgccgaaaaaccaccaaagaagaaggttgaaaagaagaaacctggggagaaaaaaccagaagaaaaacctaagaagcaagaacttggtgacaatgaagggaacaatggatgtgaaggagatggtgatgtacctaaatccaaacgacatcatttttggttgggttttgtttgttcaagcaatcaaatctgtagggatggtggattttttggttgggttgctggtgttttggaggtgtgtgaggtggttgatggtgacgcatatggtgtggagttagtggaggagttggtcggggactcgtgggggtggtttgggcaattggagggtagagtagaggtggtagagggagaggatgttggtggcaaccatggccattag

SEQ ID NO: 10943 - DNA, 207 bp, Glycine max
  Peptide Sequence Number=SeqID_102628
atggtggaggatagacgaacaacgactttgaatggcaatcccaaaggaagaactacttcaaaaatgggttttcctttgccagcggtcatttaccctgccgaaaaatttatctgcattcgttattcgctctcccttgaggagattctgctgtccttttcttcgggggaaaggatgaggattcttttcatgggccaaggttcaaagtag

SEQ ID NO: 10944 - DNA, 597 bp, Glycine max
  Peptide Sequence Number=SeqID_102629
atggggaatcaacctagaggcaatttcaatataggtggatttctaggatttcagaacaaccaacagtatcaacaacaaagacagtggcaaaatcaccttggtaaccaattcaacagagaccagggtgctggaagagactctagctcaattcatgcaagtgtcaagtctaaccaaaagagcactgagtctgcaattaagaatttggaagtccaggtgggccaacttgcaaagcaattagctgaaagatcatcaaacgaatttacaacaaacacggagaaaaatcctaaagaagagtgcaaagctgtgatgactaagcagaggaaagtagagctgctggctgatgaactggtgctggaatcggttgatgatttagttgaacttgaagaaatttttgaggaagcagaaggtgatgaagaaggagagatgccaataagagactgtcaagagaaaataaagaaggaggaagaaaaagaaaaacaaagagaagaagaaacaaaagaaaaagaagaaaaagaaaaaaagttgaaaaatgaaaaacaaaaagagaaggttattgagattgataaaaagaagggcaagagtgaggctaacttataa

SEQ ID NO: 10945 - DNA, 370 bp, Glycine max
  Peptide Sequence Number=SeqID_102630
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaagagttggtagctcagagaaccttcgaaaaaccgccctgcaaggcg

SEQ ID NO: 10946 - DNA, 135 bp, Glycine max
  Peptide Sequence Number=SeqID_102631
accccattgttccttcttccgaggacagggatggaaattctcatcctgggtcaaggtttatggtggactggtggtttgaggtcttgggtcaaaaggcttgcagaatagccagacatgatgtatgtcagggtgttg

SEQ ID NO: 10947 - DNA, 537 bp, Glycine max
  Peptide Sequence Number=SeqID_102632
atggagctatgtcaggacctagcggcaatcgatgccttccttgcttatcaccatagcaaggaaagtccactcgttgttgttttggccgatgcctatgacacatttgacagaagatgcgaaaagagcggtgcaaggatcatctgttgcacacttactctttatgtatggctggtctcacacctctttcttcatgaaagtagacctgtctgtcccctgcaaggtcaccgcacatgcactgagaaagggaaggccaattgggagcaactcctggctagtatagtggggacatctgttaattggttcccccgatggaaggaaggaagagttggggttctgtcctcatgtgagggattctcaaatgtcccattgatgggaacgaggggttgtatcaattataatcccatccttgccataagacaacttggttaccccatgagaggagcaccgttggaagaaagtaccacgcgcttcatcgcacggggtttcagagaccccaatgcaaggatatttcagagggtccaaaaggcatggagcacg

SEQ ID NO: 10948 - DNA, 58 bp, Glycine max
  Peptide Sequence Number=SeqID_102633
atttgaccgtgactagaaaaagattgaagcatttgttggataaaagacagtcatccag

SEQ ID NO: 10949 - DNA, 429 bp, Glycine max
  misc_feature (401)..(401): n is a, c, g, or t
  Peptide Sequence Number=SeqID_102634
atgaagcacttcactgacaccctcatcagtgccaacatagctcatcctcaaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgctnttgccgttacgcaccaccccgtcagtag

SEQ ID NO: 10950 - DNA, 650 bp, Glycine max
  Peptide Sequence Number=SeqID_102635
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaaagctgcttatgctgctttgatacgtgagttcagtctcagtcctaaccttactacttctaaactacctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10951 - DNA, 252 bp, Glycine max
  Peptide Sequence Number=SeqID_102636
atggctagtttatcgtattatcacgagggatcagggattaggcttgactatcacgagggatcggggtttagcatttcaggagacaccatagaacatgtgaaaaataggctaagttttgaattgccaaaaagtagcagttgggctaagcacatatccaccactaagcgcagcttcaacacacttagcgcaaaggagaatctggcagagcatcagcatcaaagttgcatgctaagtgcaagatcaatgcgctaa

SEQ ID NO: 10952 - DNA, 211 bp, Glycine max
  Peptide Sequence Number=SeqID_102637
atgaaagataaaagcgaggactttgagtcctactgtcgcaacctacccttttgcgggcgagcgaggcgaggctcacaggtgcgtcgtccaaaggaggaaaatgcgcggagtcgccaccaacgtttatttgtggaaaacgttggaaaaaatggaaggaaactggtcataaagaacattccaagttcaggagttgtatttacgtttgaggaag

SEQ ID NO: 10953 - DNA, 478 bp, Glycine max
  Peptide Sequence Number=SeqID_102638
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggccttttcgttattacgccagctggcgaaagggggatgtgctgcaaggcgattaagttggcttatcgataccgtccacctccagggggggcccggtaccagcttttgttccctttagtgagggttaatttccagcttggcgtaatcatggtcatagctgtttccttccggaaacctgtcgtgccagctgcattaatgaatccgccaacgcgcggggagaggcggtttgcgtattgggcgctagcggaatgtatactggcttactatgttggcactgatgagggtgtcagtgaagtgcttcatgtggcaagagaaaaaaggctgcaccg

SEQ ID NO: 10954 - DNA, 672 bp, Glycine max
  Peptide Sequence Number=SeqID_102639
atgtcgttcaccaaaggaaagatgtgtgtaaatgggatgactccaaagaaactctccatgaagaggtctagaagggacgccgctggagaaggctccaacgccgcctcagagtttgatagtcaccgtttccggagtgccgagcaccagcaacgctttgaggccagcaagggatggtcattccatagggaaaggcgtgtccaactcagggaagacgagtaccctgacttccagggagagatagctcgtaggcattgggcacgactagtgacccctatggctaaattcgacctggagatagtcatagaattttatgccaatgtctggcccactgaggagggtgttcgggacatgcgctcatgggtgaggggtcactgggtcccctttgatgcagatgccatcagccagttcttgggtgacccgctgattttggaggaagaccagcagtgtgaatttagccagaggaggagccaagcagacggtttcgatgaggaagccatcgcccagctgctgtgcataccagggcaggattttgcctggacagctgcagggaggcgggtgcggatcatgcgcaccaacatgactaccttgacccagatatggatgacactgctgctcagtaatgtcttgcctagcgaccacaactccgacctccctttgcctaagtgccagttg

SEQ ID NO: 10955 - DNA, 55 bp, Glycine max
  Peptide Sequence Number=SeqID_102640
atgtcggctattgagtttcaaattcagatccgtgaacgaaatttgcatgatgtcg

SEQ ID NO: 10956 - DNA, 282 bp, Glycine max
  Peptide Sequence Number=SeqID_102641
atgcatgaagatcagtggatgtatgatagtatgatgtctgaagaagttgatatgaatgttgaaaatgaggaagatgctggtgttaaagtagaacacgttgattgttctgatgcctttaatacttctcagttgtttgctagccatgatgaaattttacaatgggctcgattgttagctcatgacattggatttgttgtcgttataataaggtcatacaccaatatcggtgttcaaggaagagcctcatttctattgatagcttgtgaaagaagtgagaagtaa

SEQ ID NO: 10957 - DNA, 485 bp, Glycine max
  Peptide Sequence Number=SeqID_102642
atgaagcacttcactgacaccctcatcagtgccaacatagaaacagctatgaccatgattacgccaagctcgaaattaaccctcactaaagggaacaaaagctggtaccgggccccccctcgaggtcgacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccc

SEQ ID NO: 10958 - DNA, 174 bp, Glycine max
  Peptide Sequence Number=SeqID_102643
atgggtgccaagcacctcacgaggaccaaagaatggtcgcatgtcatcaagcaaagtagtgatgaccgaagggaggagtgtcatcgtcgttgcaacgatgagaaagaaaaaggtggtgaagagtggttagaaatcacagttgatgcaatcctaccccccaagggcattggatag

SEQ ID NO: 10959 - DNA, 303 bp, Glycine max
  Peptide Sequence Number=SeqID_102644
atggcttctccacctgtctcgcctactcctcctcctcctgctccttccgacgcatcggcttcgccgtctgccgtgaagcggacacgcaaagcctcacgtctacgatcgttgtctactagaccacctggtgctgagagaccaatggtccatgttgatcttgctaccggcaaggccgacggtccccacaagaagaaattaagaacatatttggggattgtggcgcgtgaaaaggtggacgtcacctacgagaactggaagaaggtccctactgctcagaaggacttgatttgggaggatattcgg

SEQ ID NO: 10960 - DNA, 366 bp, Glycine max
  Peptide Sequence Number=SeqID_102645
atggttacctcgaagaaaccacgaagggaggactatggtattcaaaagggaagtgagactaggcatattggaggctccattctctaccgaatctttgagttgagttttgaagattctgctccagtaaaattgttcttcttcgtgcaatggttcggcgacaagcaaaggaggctcatggaggtcactggtggtggaggaggagctgatccagctcaaatatgcctaggcaacatttggctcgcctgggcgaattctgctccaacaaattttactgcttcgaattcggttgcaagcctacagtccatatttgaagagcatccaacggttaaggaatctaatatggcggttttagtgaaacaaatttag

SEQ ID NO: 10961 - DNA, 1833 bp, Glycine max
  Peptide Sequence Number=SeqID_102646
cagatccgcatccgcgatctgcagctgacgcatgagtttatcaatcccggctggcctgctgccacgctcacccacatgacgcgccgcatgcagcaggcgctgcgtgccaccggcgtgcgcgtcacctccggcatgaccggcccgtatggccgcctcaaccattttggtcatccggatgcggcggtacgtcgctactacattgactggttcaagacctttgccgacatcaccgcggaactgggcggcgtcgcggtgggctcgcagtttgccatcttcactcaacgggattttaacgatgcggcgcggcgtgaagcgctgattgccatcgccattgactgctgggcggaagtggcggaacacgccaaagcggccggtctgcattaccttttctgggaaccaatgagcgtcgggcgcgaatttggcgaaaccattcccgcctgtatggcgctgcaacagcggctgagcgcggcacagtttgccctgccgatgtggatgatggcggatatcgatcatggcgatgtcacctctgacgatccgcgtgactacgatccttacgcgtgggctgaagcggtgccgcgcttttcgcccatcatccatataaagcagagcatgatggataaaggcgggcacaggccctttacattgcagtacaatgccggcggtcgcattcagccgcagccgctgcttgaggcgctggcgcgcggcggcgcgcaggataacgagatttgcctcgagctaagcttcaaagagcgcgaacccaccgacagcaatgtggtggcggagattgccgaaagcgtggcgttctgggccgaccatattgataccggggtgcaggatttgcatctcgccacccctcaaccagacagggacaacccgatgaaatccgcaccgacttccgctgaacgcgatgactctctggccctgcgggcggcctggctgcactatgttggcggcctgacgcaggctgaagtagccaaacggctcggcctgccgtcggtgaaaacccatcggctgattgcgcgcatggtggccgaaggcgcggtgaaagtcaccatcgacggcgcgattgtcgcctgcgtgacgctggaagagcagttgcgcagccgctacggcctgaacttttgtcaggtggcacccgatctcggtgaagaaggcctgccggtgcgcgcgctgggcatggccggtgccgactatttgcgtaatctgctggcctccacgccggcaatcacgctgggtctcggccatggccggacgctgtcggcagcgattcaccagctggcacgtatcgacgcgccgcacctgcgctttgtctccctgctcggctgtctgacgcgcaactacgcgctcaatccgcatgacgtgatgcatcgcatcgccgaaaaaaccggtgcgcaggcctacatgatgccggtaccgttttttgccaacaccgaagaggatcgcgatgtgctgctggcgcagcgtggtgtcagcgaagtatttagcatggccgcgcacagtgaagtgaagctggtgggcattggcaccgtggaaccagccgcccagctggtggaagccgggatgatcgatgcagccgagatccgcgccctgtcggaagccggtgcggtgggcgaactgctggggcactttttcgctgccgacgggcagatgattcacaactcgctgacggcacgcacgctgtcggtaccgctggatctggcgcagcgcgcagagatcgtggcgctgaccggcggaccgagcaaagtggcggcgatccgcgcggtgctggccagcggactcgtcaccggtttgatcaccgacgagctgacggcgcaggcgctgctcagcgcatga

SEQ ID NO: 10962 - DNA, 439 bp, Glycine max
  Peptide Sequence Number=SeqID_102647
atgcatagatttcccataggcaatttagttcatctggacttagaaattgaagctacattgagaaggaacagggtcaggaggagaaggaaacttctgcaagacagaacagttgcatccattcttgaggaagaaactcatttttctgattcatcatcacttgattcaccatcatcaagggaatccgctactcaattgcctgaaaccactatcatggcagacgagcagcaccaaaaggtcacccttgaggattattcaagcagcttagtaccgcaattctttactagcattgcacgtcctgaagcgcaagctcacaacatcaactacccgcattctttaattcatttaatacaggggaatttattccaaggattacctaatgaagacccttatgcacatttggcaacgttcattgaaatatgcaacgctgttaagatttcta

SEQ ID NO: 10963 - DNA, 435 bp, Glycine max
  Peptide Sequence Number=SeqID_102648
atggggatcgcacccacaaagacacccagtggacccggaaaagtccaacagggccctggggtttccagctctggttacgggcctctatcaatcctacagggtgcccgtaccccccccggcaagggatcgcgcttgcaagacacccagtggacccgaagaagtccaacagggtcttggagttgtcaagctctaattacgggtctctgtcagttctacagagtacctgtcacctccagcaagggcatcaggccccctactgatcgagctttcatcaagaagtgctgcgtctccaggcaggcgcagggcgaaacaccacagcagcctggggatggccggcagcgggcaacagacgcaccgccatcacctctagagttcacctcagctcatccacaaaaaaggttagagcgttgcttacgacccatggccgaccaataa

SEQ ID NO: 10964 - DNA, 912 bp, Glycine max
  Peptide Sequence Number=SeqID_102649
atggagtcgggcaaagccgcggtcgacgtcgcgctttacaccctgattcccatcatggtggtgatgctattcatcatgaaataccctgaagtgaaaggcgtgctggattttgtcgtgcgccacgccacgccgttactgaagccgctggggattaccggcctggcgctgttcgcactcatccagttaaattttgtcagttttgccgcaccgctcgccgcgctggcgatcatggagaagcgcggcacgtcagaccgccacatggcggccacgctggcgatgctgttcgcgatgggccaggccaacgccttttatccgctgattcctgacgggctcaactggagcgccgcgctgctgttctctatcagcggcggcgtgctggcggccgcctcaacctatcacttttttgcccgcaaactttccgatgtcgcgctgcgcgatgaagaccagggcgtggagaacagcgacacgaagccggggctgatcgccatcatcaacacctcgggtgccgacgccattcgcctcgcgctcggttcgctgccgatgctgatcctttcgctgtcggtggtgggcatcctgaagagtgccggcgccattgagctgctgacgcagctgctggcaccgctgttacacaaactgcatatcgccgaggtgtatgtgctgcccgcgctgaccaaatgcctggccggcggcaccgcctattacggcgtggttgccggtctggtcgaacaggggcagtacagtgcgcacaacatcaacgcctcggcaggcctgctgattcagaccttcgacctgcccggcatcggcattttcctcgggctctccagccgttttccgcgcctgttccgcttcgccgtgcccggcattttgctcggcattgcgctgcgcgccacggcgcacagcctgctgttctga

SEQ ID NO: 10965 - DNA, 1131 bp, Glycine max
  Peptide Sequence Number=SeqID_102650
atgacacagcgtcatctgctggcggtgctgattagcgcggccttactgctacccggacaggccgcttcagcggctgatgatgacatgctgcgcgcgttcagcgaagcagcgcgcaccctgccgccggcaccggcagcaaaaccacagccacctgcaaaaccggccgctaaaccggcggcgaaaaccgtcagcaaggcagagaaaaaagccgcaacagtgcccgatcacaatgcggaactgacgcgtctgcgcgcccgtgtggcggagctggaaaagctgtctgcggcacctgcggcggccacccagagcgccgacgcgctgaaggcgctgaaagcggaaaacgagaaaacgctggcggcgctgcaggcagacagcaaaaagcagctcagcgcccagcaggccgggaacgatagaaaactggcagcgctcagcgcggagaagcagcagcaggagaaaaacatcgccacgctgcagcaggcgctgaaagaggcacagcagcagcaaagcgccggcagcgcccaactgacgaaacagctcagtgacgcgcgcgcagcggccacccagagcgccgacgcgctgaaggcgctgaaagcggaaaacgagaaaacgctggcggcgctgcaggctgaaagcaaacagcagctcagcgcccagcaggcggcaagcgacaaaaagctggcggccttacaggcagaaaacgagaaggtgctggcggcgctgcaggctgagagcaaaaagcagctcagcgcccagcaggcggaaagcgataaaaagctggcggcattacaggctgaaagcaaacagcagctcagcgcacaacaggctgagagcgcccaaaaactggccgcgcagcagactgcaagcgacaagcagctgaaagcgttacagtctcagcagacggaaagcgagaagaagctcaccgcactgcagacgcagcaggccgagcgtgaaaaacaactcgctgcgctggatagcgaaaaacagcagcaggcgcacaatctggcgcagctgacgcgggaactggaggcagcgaagcagcaaccggccgccgcgccgaaactttctgccccgaaaagcgatgccgaacgcgatggttatacgctgggtcagttcatcgccagcaatgcggtg

SEQ ID NO: 10966 - DNA, 228 bp, Glycine max
  Peptide Sequence Number=SeqID_102651
gaatcatcacgggtcaagggcatgatcttgaaggacgagctaaaggctttccttaggtcgaaaagaaatttgtcccaacagttaagcgagactgaagggaatatgtgggccatcatcgatgagtgcaaagagaagctaaatctagcggcgactcacgagcaaaggctagaggatgagtacgccaagatatcagcagaaaggaaagaacatgctttatggcgcccttga

SEQ ID NO: 10967 - DNA, 210 bp, Glycine max
  Peptide Sequence Number=SeqID_102652
atggctccaacagtccggtctaacttagacatattccagagaaatgattatttgaaaggaattctgattgacataagttccaactgtccagttgagcacagtggaaatttaatgaatttagagaatctgagacatttgattgtttggataaatctaaagaaattcgagaacctcgcagaaatggtggacaggaagcccaaattgatttga

SEQ ID NO: 10968 - DNA, 386 bp, Glycine max
  Peptide Sequence Number=SeqID_102653
aggcgtcgtttgagctgaacgatgcaaataagaccattaaggtgctgagcgagtctgattttcaggtgaaccagctgctcgacattctgcgcgctaagctgttaaaacgcggcattgaagggacgtctctggatgtgccggaagactttgtccatagcggtaaaacctggtttgtggaagccaaactgaagcagggcattgagagcgcggtgcagaagaagatcgttaagcttatcaaagacagcaagctgaaggtgcaggcgcagatccagggcgaagaaattcgtgttaccggaaagtcacgcgatgacctgcagtccgtgatggcgctggtgcgtggcggtgatctgggacaaccgttccagtttaaaaacttccgcgattaa

SEQ ID NO: 10969 - DNA, 402 bp, Glycine max
  Peptide Sequence Number=SeqID_102654
atcgcgtcttttccggtttttccgacgttttcctcaaataaacgttggtggcgactccgcgcgtattcctttcgtggaacacgcatcccgcgagtcacgcgtcgccctcccaccgaaggaaaacaccgagaccttttcaagtttcacaagttatccagaactacgtaggtctgaattcctcattggaggatatgtaggagcaagagcctcgcttttgtcgaccgcaccgctttttgttaccatgacccaagagctggtagcccgcggagacaccttacggttatccgcacctcgtcattcagtgaccccaagtgtgattgatgagcaaaggccagtgtggtcatttgcaccctttccggggatgtcaacatcttccggtggagactttttcaagtctcacaa

SEQ ID NO: 10970 - DNA, 420 bp, Glycine max
  Peptide Sequence Number=SeqID_102655
atgaagcacttcactgacaccctcatcagtgccaacataagaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10971 - DNA, 377 bp, Glycine max
  Peptide Sequence Number=SeqID_102656
ggcgatgcggggctcacgggtgcatcttccaagaaaggaaaatgcacgaagtcgccaccaatgtttatttggggaaaacgtattagcaccccacacgtccatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 10972 - DNA, 318 bp, Glycine max
  Peptide Sequence Number=SeqID_102657
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataatgatggtggaatcatgtgcgacaatggaaatagaagag

SEQ ID NO: 10973 - DNA, 189 bp, Glycine max
  Peptide Sequence Number=SeqID_102658
atgccttttagaggcttgaaaagtgcgagaaaacgagctgtgttttctagaaaacgtgatgaactcgctaagcaagcatgctgcgctaagcgacttcatcaatactcattccacgcgctaagccgagcattcctgagccaagcacaattccttgcggcatttgctgagctgagcggccctgttcactaa

SEQ ID NO: 10974 - DNA, 459 bp, Glycine max
  Peptide Sequence Number=SeqID_102659
atggcagaagatcatccacagaggatgacgctagaggactactctagctctgttactccgctgtacttcaccaacatagccagattggacattcaagtgaccaacatcacatatccatattccctcatccatctgatccaggggaatctattccatggcctgacaagtgaagatccatacgcacaccttgccatatacatcgagatttgcaacatggtgaagatagcaggagttccagaagatgccatctgcctcaacctattctctttctccttggccgagtccaagaccgctgagggaaaggtggaaatctcatccttccaccaacaccctaatgaatcactgagtgaagcacttgaccgcttccatgggttactctggaagactcctacaaatgggttcaacgagctggtccagctcaacatcttcattgatgccttgcgaccccattccaagtag

SEQ ID NO: 10975 - DNA, 324 bp, Glycine max
  Peptide Sequence Number=SeqID_102660
atgggtccgaaatctaccctaaggctcatgagaaccctagggccttctcttgcatctctggcccaatcttcttggagtcttctatccaatgcccttgcggggattgtcatcatcaaaaagggggagattgtggaagcaaagctttccaagtttattttgatgatgccaaagactcaagtcaagaatcaagagtcaaacaagtttcaagaatcaaagagtcgttcaatcaagaatcaagattcaagtgaagtttcaagagaagactcaagatatgcaagaacttcaagaatcattaagtataaaaagattttttcaaaatattga

SEQ ID NO: 10976 - DNA, 270 bp, Glycine max
  Peptide Sequence Number=SeqID_102661
atgtccgacgccgcgatgatggtggcccgtatgatgttaggacatgggtataagcctagaatgggtttaggatggaacaacgatggaatggccagcttgatagaattcaaggaaaaccgcgggaggtttggactaggctataggcccatgcgtgctgatgtgagaagaagcgccctagagaggagaagcaggggcatgggccaacagcaaaggccacaagtgaaagaggcccatccatgtcacatcagcaagagtttcatgagtgcgtga

SEQ ID NO: 10977 - DNA, 112 bp, Glycine max
  misc_feature (4)..(4): n is a, c, g, or t
  Peptide Sequence Number=SeqID_102662
atgnggttgatcacgagccggaatatggttagagcccttatgtgtcttgaacttatactgaatgcacatgctgaagcagctatcggaccggctattgtttcctcaatttatc

SEQ ID NO: 10978 - DNA, 453 bp, Glycine max
  Peptide Sequence Number=SeqID_102663
atgaagcacttcactgacaccctcatcagtgccaacatagctaagtctctagcattgttttctcttgaggatcaagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10979 - DNA, 480 bp, Glycine max
  Peptide Sequence Number=SeqID_102664
atgaagcacttcactgacaccctcatcagtgccaacataggaacaaaagctggtaccgggccccccctcgaggtcgacggtatcgataagcttgatggaagaacaaaactgtctttcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10980 - DNA, 363 bp, Glycine max
  Peptide Sequence Number=SeqID_102665
atggaagcttgcttgtggagcttcctctctctccttactttttcctacacccttaagcttttttttttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 10981 - DNA, 755 bp, Glycine max
  Peptide Sequence Number=SeqID_102666
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtgggaggcactagctatggagcttaaggactatttggataggcatgttactaggtcggtggtgttattgttaagtatggctaaaatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 10982 - DNA, 177 bp, Glycine max
  Peptide Sequence Number=SeqID_102667
atggctagcagactccaggaagattggattaaggtttcatttgattcaatccgcccaatgaggggacccatcactagagccatggctaggaaactccaggaagtttggaccaagaataaaggaaaaggccttagggttctcatgagccttagggtagattttgggcccatgtgctaa

SEQ ID NO: 10983 - DNA, 438 bp, Glycine max
  Peptide Sequence Number=SeqID_102668
atgtctaaaacgaatgtgagaagacatgctcttgagaagtgcaggagtgtgaaagagacacagaaaatattgaaccacagttttttcaccagaaacctcaagaaagtgtaccctatagggcttcagaaaagcacttcatctttgtctctgtcttcaatttcattgtctttgtcacaaaactcaaatgactcttcccaggctgattctttgactccactggatgaaaagatttcgctggcattgcgtttgatttcgccacgggaaagaagagaacctacaatagctgcttctaataagcctcttcagcagcaacaccaacaaccaccacacactactgagcctggggaattgaaaagatgtaactggatcacaaagagctgtggtgctgatagcattgcagcactatggtcaacaacatcagaagattattttgagtag

SEQ ID NO: 10984 - DNA, 264 bp, Glycine max
  Peptide Sequence Number=SeqID_102669
atggctttgaaagaggaaaagtggatactactttgttctgcaaaaactatgacgttcattctagtccaaatagagtttgagatgagtgtggtgagagaattgaagttcttcctaggtcttcagattaaacaaacaagcagaggcatttacatacaccagaccaagttaattaggcaagctttggaaagtgttgtttttcaccttcgcgctaagctaatatgctggcttagcgagcatccgctaagcacaacactcctaggctaa

SEQ ID NO: 10985 - DNA, 519 bp, Glycine max
  Peptide Sequence Number=SeqID_102670
atgccatatgtggaagccgaggaggagtcattggaaatagccttccaatcttttgaggtagtaagcattgcctccgtagattccttctctgggcaaccttgtctgtccgatacgacaatgatggtggcctgggtgatgttggagaatggttacgagcccggaatgggtttaggcaagaacaacggcggcagaaccagcctgataagcaccaaaggaaaccgcgggaagtttggattaggctataaactcacgcaagcggacataagcaaaagtgtcgcgggaaggaagagcagaagccaaggttcgcaattaggacgacaagtcaaagggggcccgccctgccacatcagtaggaggtttataagtgctggtctaggacttgaaggccaagtcattgcgatatacgaggatgactctccgagtgggtcatatttggaacgaccatgccctcctagtttccgactaggaaattggcgagtggaggagcgcccgggcatttacgcgacaagcataatgtaa

SEQ ID NO: 10986 - DNA, 330 bp, Glycine max
  Peptide Sequence Number=SeqID_102671
atgaccatgattacgccaagctcgaaattaaccctcactaaagggaacaaaagctgcccgggggatccactagttctagagcggccgccaccgcggtggagctccaattcgccctatacacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10987 - DNA, 296 bp, Glycine max
  Peptide Sequence Number=SeqID_102672
taaaatgggtggaacatgagatagacatggtagctagagccatggtactacagtccccacttgaaaaaacactgactaatactatggagtgtctgacaacggaggaagaaaaagaagtgcagagttgtttagaggaattagaaggagaaaatgaagtcaatccgatgatcatcagtaattctctaagaaaggaagaggaatctcagctactgaaagttttgaagaaacataaagtggctattgaatggcatatttctaacttgaaagggatcaacccttcttactgtatgcattag

SEQ ID NO: 10988 - DNA, 492 bp, Glycine max
  Peptide Sequence Number=SeqID_102673
atgggtgaccaagaggagacacaggaacagatgaaagccgacatgtcggctttgaaagaacaaatggcttctatgatggtggccatgctaggaatgaggcaactcatggagaagaacgtggccaccgctgacgctgtcagttcggctgccgatgcagatccaactttcctagccaccgcgcaccatcctcccccaaatacggtaggacgaggaaggaacacactggggcacaacaacaacccccatttgggatacaaccgagcggcttacctttatggattgccgcctaattacacgccgccaatcatgcaagatgatgcgggtcatatctcttctcccatccttgaaggggagcctcctcgacagcccgacgaggtccacgaagatcatcaagagtatgcccaaggggatgtcgagttctaccccccgattcccgtcgagggaccggcacccacactttgcctcaacccaacctcactgcacagccaataa

SEQ ID NO: 10989 - DNA, 276 bp, Glycine max
  Peptide Sequence Number=SeqID_102674
tacatctggaggaacccacacgcaacgcttcagcagcctgtggagtggatactacctacacctactccatatcgactagtggagccatttcaagtgatagaggtgtcatcctctgaagaggatcctgaagaggacccagaagagttacctcctgaacctgttgtggatgcccttgactttccaaaggatgatgaggacccactccctgaggtggattctccagaggatatcatgtcagcatctgaggcagactctacagaggagagcgacccttga

SEQ ID NO: 10990 - DNA, 561 bp, Glycine max
  Peptide Sequence Number=SeqID_102675
atgactatccgctgtaagcgctgtgagaagaagaacgttcgttgcttcgtggacactgcgtccgggcagtgtgctggttgtatcgctgtaaaggctgagtgtagtttgtttgtaactgaagaagagtgggaaaaggtggaggcagagaagcgtcaaaagcgtctcgagcttgctcgttctgaggagcagaccgcgcgacttcgtcgcgagctcctagaagttgaagagcgggagcgggcgtacgctgatcgtgatcacgctcttctgagtcttcagaatcgtgagaaagaggaagctgaggggacctctgcccctggtatgggttctccgacaaccgaaccatcgctacccgcacagtcgactgaccctggctggttacaggctgattattcctcttcttacgaccctttcttgtcccttgattacttcctttcccttgaggacccggtcctctcttctctggatgctgcctgtgatacgctcgtatcaattccttgcagttcgttaaatttccttctggttcccaagtgttctggctatccggccatccttgccacttga

SEQ ID NO: 10991 - DNA, 171 bp, Glycine max
  Peptide Sequence Number=SeqID_102676
atggagacagtatgttgtggaggcctctggttttatgttctgaagctgtgtaactcgactttggtctctggtaatcgattaccaatgctgtgtaatcgattaccagaggagaaaagccttgaggcacaccttttaattgcatatcgtgatggcagcgcagttgatccatga

SEQ ID NO: 10992 - DNA, 480 bp, Glycine max
  Peptide Sequence Number=SeqID_102677
atggccgcctccggtttcgacgggcgagggcagctgcagatccagggtgtgccggtcgacctgacccggccgttcggctaccgcatggcgttccaggccgaggattacgccgacttcagcgtggccggcggcatggccgtgccggacccgccgggtggcgagtcggtgcgtggcttgtacgccaccgcctcggcgccggccaacgagacgccgttctactgcaatgccagcctgcgcgaggagacctaccgcctgcagttcccggccaacgcgccgatcatcgccatcccggccagccagcgattcgccaacgccgccggcgagtaccgcgtggactggagccgcgaagggcaggaggtgatcgtgcaccaccggttgcagcagaatgcggtgcgcggcccggaggcattgtgccagccgcgggattatccggcgttccgcgcgctgtatcgcgaagtgcggcgcggcttccgtggccag

SEQ ID NO: 10993 - DNA, 579 bp, Glycine max
  Peptide Sequence Number=SeqID_102678
atgtctcagccgctgccgcagcacgcggttgagtttgcgcacggctacacctattcggcgcatccggtggcctgcgcggccgcgctggcgacgctggacgtgctggaaaacgaggcgctgattagccagtcggccgaactggcaccgcattttgaacgcgcgctgcacgggctgcgcgattgtccgcaggtggtggatatccgcaactgcgggctggtcggtgccattcagctggcaccccgtgaaggcgacgcgaccgtgcggccgtttgaagcgggcatggcgctgtggaaagccggcttttacgcgaagccctgcacggcctcagataatctcagtgctgtagctgaccggctgcggcggaataaatgcctgcaccggcgtcagttcgccgcggtatttgcgcagctgcaccacggtgatttgtccgctacaccctgcgccagcgatgaagtgccgatatccagcgtcagcacattcggattgccgtggcggcacagcggtcgcagcgcggtgggatcgaccggatcgtaccaggcgccggtcggcaactgcaccacacccggcataatgctttcg

SEQ ID NO: 10994 - DNA, 136 bp, Glycine max
  Peptide Sequence Number=SeqID_102679
atgggggtgcaaatagcacctaggcatcaagcttatcgataccgtcgacctcgagggggggcccggtaccagcttttgttccctttagtgagggttaatttcgagcttggcgtaatcatggtcatagctgtttcct

SEQ ID NO: 10995 - DNA, 401 bp, Glycine max
  Peptide Sequence Number=SeqID_102680
gttcatggatgagtggagctcaagcttgggtcatggttcggtgtatggattccttaagccttagtccatacacaatgcaaaggattgacgtgttgaatgtcaacattacattgaaacatggcttaaggaatcccaacgagagggcccattggaaactggttgttttctgtcctatgatggatgttgtcgttgggtttggtttgttgcgtaagaagcttgatgttcatatcaaagctgcaattaacaatgcaatgaagacattaaagactactttggatggtcaaactaatcaagttgcacctcagtggattgaagtaaagagtcacgttcaaagtggaggctataagtgtgactattatgtcatggatgtggaacatagtaagcggggagttgaagaatga

SEQ ID NO: 10996 - DNA, 405 bp, Glycine max
  Peptide Sequence Number=SeqID_102681
atgttcttggcactcgtacttgtaccacttgtcgctttaacagatatcggcggagtagacactgctgtcaactctgccacgacgatcaatgctgatttgtttgatgtcttcaaagggacgtcaacacttgggatcatcggtcttcttgcatggggacttggttacttcggtcaaccacacatcatcgttcgcttcatggcgatccgtgatgagaaatcattgaagacggctcgtcgaatcgggatgagctggatgaccgtgtcactcctcggtgcagacatgactggtttcgtcgagagtcgctgtatttccgcggacaaggaaatccactcggggacccggaaacagtcttcattcgattctctgaagtcttgttccacccgttcatcactggattcttgttag

SEQ ID NO: 10997 - DNA, 447 bp, Glycine max
  Peptide Sequence Number=SeqID_102682
atgggtgaagtagaggaggtgcaaaagcagatgaaggccgacatggaggccatgaaagagcaaatggccacaatgatgagcatgaagaagataatggaagtcaatgcggttgaagttgccgctaccagcgctgttgctaaggtgaacctgatgccctcatctagcctcaaccaaatgaatcatccaacctcagctatggtaggcaaagatttgggaagtaagagcggcccctattatgtgcaaattcaaaacaagcacgcctttccaccatatggcttgcctcccaactatacaccacccaatgtggcatacactccaagtgaggatgtcaataactctgctcccatactcattgaaagccgacaaccccaaacttatcatgcacatgtctctcaaaccatgggggagacacatgaaattccccaccacaatctagccgacttctag

SEQ ID NO: 10998 - DNA, 144 bp, Glycine max
  Peptide Sequence Number=SeqID_102683
atggcaattctgatcgccaatacttcaacaatatttcataaagatgaaagactcgggaatacgtatgctatgcatggaaaattttatgatcccaacatggttggctcatggtaccgaacatatgcaactaagaatgcatcgtga

SEQ ID NO: 10999 - DNA, 273 bp, Glycine max
  Peptide Sequence Number=SeqID_102684
atgcgtcatcagaactggcacccggccgatatcattgccgcactaaagaaacatggaacaagcctggcagccctgtcccgaagagctgggctttcatcatccacactggcaaacgcgcttacgcgcccatggcctaaaggtgaattgcttatcgcacaggagctggatattccgccgtatgtgatatggccggaaagatactttgatgaaaagggagcgccagtatttcgtcagatgaggaataccaaaaagagaaatctttcttcaacatga

SEQ ID NO: 11000 - DNA, 543 bp, Glycine max
  Peptide Sequence Number=SeqID_102685
atgttaaaactccagaaaaccatagaggataaagccaccgcaactgcctccagtacagttagggaagcagagccggtgctgcagcccgccttgaatccgggcctagacaaaaacacggtcgtgttcggtcgaaggtatagtccgcaagcttatccttatggcctgcctccggacttcaccccccgtgccaccccggaagatttaagccaagcccctacttttgaggggcaactcccaccttatgaagactatcccgggcaagacgatggggaaggagatacccatcttggccccctgctccacctcaaagatccatccccacatgaactaccccagccgaacatagttcgccatatcccggcctcacccacgcccgtaaaagaatctgttcccttcgcggaagataggggaaagattgaggcacttgaagagaggttgagggcagtcgagggcctcggcaattacccattctcggatttggcagatttatgtcttgtgcccaacatcgtcatccctcccaagttcaaaagtaccagactttga

SEQ ID NO: 11001 - DNA, 204 bp, Glycine max
  Peptide Sequence Number=SeqID_102686
atgggatcgaatcaagcacccttgctaaggaaaaggttctatcacgtcaaaattaaaagcctaaaggttgctagtttgcaagaattggggcagttgatggatcaactccagcatcaagctttctgcaagacatatggaaagatctgggacctgactatgatagaagtctctgttgaagccattatgtccctcactcaggattaa

SEQ ID NO: 11002 - DNA, 291 bp, Glycine max
  Peptide Sequence Number=SeqID_102687
atggctccgaagaaactctccacgaagaggtctagaagagacgccacaggcgaaggatccagtgccgccccagaggaaaggcgtgtccagctcagtgaggatgagtatacgaaccttcaggaggagatagctcgcagacgttggacaccgctagtgactcccatggccaagtttgaccctgagatagtcctagagttctatgctaatgcttggcccacggaggagagagttcgggacatgcgttcgtgggtaaggggtgatgcaatcctatcccgcaagggtattggatag

SEQ ID NO: 11003 - DNA, 384 bp, Glycine max
  Peptide Sequence Number=SeqID_102688
ggtacatcctatgtggtccaagtagaggatacatctacttgggttgttgtaactgagaacaagagagggtacatctcttgtggatcagttcaagtggagggtacatccacttggttgttcaaagagaacaagggagggtacatcccttgtggatctttgcttgtaaaggattttacaaggttgaaagaaatctcaagaaccggtggttgcttggggactggatgtaggcacgggccttggatcttcttcatcaatggagtcctttgcttcttgaagatgaatgcaagtggaatggagaaagaagatgattggagatgccacttcaaggagaagatgagtcaagaagaagctcaccatcataggaaaccatggataagagcttga

SEQ ID NO: 11004 - DNA, 1002 bp, Glycine max
  Peptide Sequence Number=SeqID_102689
atggatgcaaccaaattcatgcaaatttcagtgttcatgaaaggaaccaccaacaattgtaggaggatgatcaatgcatcaaccagaggaaactatctcgataaaatcaccactcaagtgaataccataattgatgatttggtgactagtgacaaaaccatagaaataaatcagttggatcccccaaaaggtatgtatgatcttaattctcaagataaccttttagctcttaaacaaaagatgcaggtgcaaatagaagcaatgactaaggcaatccaacaaattccgcaacaactccaaggggccatctcaaagaaaccccaacaagcgttcatgtgcgaagaatacggaggaggccatcaaacatcaaaatgtaccgaggtaccaactgaggaggatttccaatacattcatggaaactacaaccaagcaggagacaacaaaccacaacaaagacataatttgtgggaccacaccacaatgtttgaagaagccttgaccaaactcaccaaagtggctattatctccaccatagagtgtgacatgggagttaaagaagaagaagaaagcaccatgctagaggaagagatgaaagcaaagtctacccttcaacccaagctaagcatccataagcaaggagacgatgagaggatggccaaatacaagaaatacatggagatgctacaagggaagaagcacaaaccaattactgaaaaactcacatatgatgtgctacatcaccccaccaatatgaatctacaatttgtcgatggttctaaaaagaaagcactatggaaagcggtaaacgtgacaacaaaggaccaacaagttccaaccattctaggaagatccttcatgagaaccgctcatgtaaccatcagtgtttgtaaaggagtccacacacttagagagggcaagaaacaaatgttctactacattcaaggcattgaagattttcccaacgaattgcctcaccaagaacaccatcatgcaacaccttaa

SEQ ID NO: 11005 - DNA, 216 bp, Glycine max
  Peptide Sequence Number=SeqID_102690
atggcgcccgacgcagctacacgggaggaactaaaaggttttttagtgataattcccaaggtggtcacatctttcttgatggtttctagaggtatcatccccttcgaagaacatattgcggcagtaggtgtgaatgtatgtatacatgattttgatgatgtcaaagaagaatctaacaaggctacttcaaaggataagcatttgcttcaagaataa

SEQ ID NO: 11006 - DNA, 285 bp, Glycine max
  Peptide Sequence Number=SeqID_102691
atgtattgggattcgcaattgatggccaggtatgccactttggttgaagtttctagagaagtttgtgcagccgcatatcgtgatgaagaggagtatgacaaaatgttgcatttcctatccaatgaggctacaaggctgaagtcgaagcaaaacagcgaacatttaaaggatgcggacaggtcggaatggatgaaattggcagacaaaggagaatccaaaagtgtcggcaatgtggtggaattggccacaacaagcattcttgcaccaaccgtcctcgaaatgtaa

SEQ ID NO: 11007 - DNA, 147 bp, Glycine max
  Peptide Sequence Number=SeqID_102692
atgttgatgcacaatccgcccatttgggccctccagaagattcctccagaaggcggttgcttctggaggaagcaaccctgctcgcctaggcgagctgagctcgcctgggcgagctgggcggcaaccacctcccctattttgctataa

SEQ ID NO: 11008 - DNA, 444 bp, Glycine max
  Peptide Sequence Number=SeqID_102693
aggaatacacgtcctcgccatcagaggactacacgtcctcgccttcagagcacttcacgtcctcaccttaagagggttacacactcctcatcttcagaggacttcacatcctcagccttcagagggttacacaccctcatctgcagaggactcatgcgtcctccccttgagagggccacacgcctgcacttcatagggttacacagcctcatcttcagaggactatacgtcctcccctttagagagtactacacgtcctcacctttcggagggctacacgccctcgcctttagaggactacacgtcctcaccatcacaggactacacgtcctcgcctttcagaggacttcacatgtcctcgaccttcagaggacttcacgtcctcaccttaagagggttacacatcctcgtcttcagaggactgcacgtcctcaccttcagagg

SEQ ID NO: 11009 - DNA, 159 bp, Glycine max
  Peptide Sequence Number=SeqID_102694
atgggagaaagaaaaaagagaaaagaaggaaagaaagctcctgatcaaggatcgaaagaaaatagaagaaatgtgcagaaaggaaataatttgcaaagtcaagtcatgacatatctatggttcggaattaggatgaaacacttacctgtgcgagattga

SEQ ID NO: 11010 - DNA, 279 bp, Glycine max
  Peptide Sequence Number=SeqID_102695
atggctgaagagcaacctcgacgagtgaccctagaagattactcaagtacatatgtgccgcagttctttactagcattgcgcggccgaaggctaaaagatggcttcattcatttaaaggtaacaatcttaagacttgggatgaagtggttgaaaaattcttgaagaaatacttcctagagtccaagactgctgaaggaaaagctaccatctcatcctttcatcaatttccagacgagtccttgagtgaggctttggaaagatttcatggattactatga

SEQ ID NO: 11011 - DNA, 519 bp, Glycine max
  Peptide Sequence Number=SeqID_102696
atgtgctgcaaggcgattaagttgggtaacgccagggttttcccagtcacgacgttggcgaattggagctccaccgcggtggcggccgctctagaactagtggatcccccgggctgcaggaattcgatccaacggacgtgggtcaacttgaaccatcataactacttcaatctcggcggacgcccgaccatccacgaccatgagctgacgctaccagccgatttggtcggggtgctcgatgcagagtcactaccgacaggcgagttgcgggatgtgagcggaacaccgttcgacttccgagacggaaaaacggtccgagaggcgctcgtgtcgggagacgaggcgattgaaagggcgagcggtctcgatcatccgtttatcttgaaggatgaaccgattcgattgcatgacccggtgagcggacggacgatgacggtcgaaacgaatcaaccggtcatcaagcttatcgataccgtcgacctcgagggggggcccggtaccagcttttgttccctttag

SEQ ID NO: 11012 - DNA, 264 bp, Glycine max
  Peptide Sequence Number=SeqID_102697
atgagtgaaatagaggaggcacaagagcatatgatggctgacatggaggccatgaaagagaaaatgaccacaatgatggaagccatgatgagtatgagaaggatgatgggggtcaatgcggctacaattgttcccacaagtaccaccacagaagtggacccgacccacccacttggcttcaatcaagtaaatcatccaacctcggatgtggtaggtcaaggaggcaaagcgttaggaagtgggggtggcccccattttgtgtag

SEQ ID NO: 11013 - DNA, 732 bp, Glycine max
  Peptide Sequence Number=SeqID_102698
tcgactctagaggatcccacgtcgagcaattttgccccgggtgatacttcgctggcaaccgtttatggggtcatttcaaactatggacaaggtgtgaccaaacgctttaccggagatgctgcagaggtattcgataacagtcatttttacaataacgtcgtggataacagtggcaagattgctgctaggattcagttgtctgagttaaatactgcagcgacaggggctgcgccaacaccatttacatctggtgtctatggtatccggacctctgtggccggggattactttgtcgacaataagcaaacggggattatcagcgtcagtactgctggtaccggaaccatgatcggtgtcgaggctggcggaacagtttcccgtatggatattcagaacgcaggcctgattgcggcggagagaactcaggcaattactttggcaactgtctctgcaaccggcaatccaacggggacttctgcaggattttcttacaatgcggccactattaatcaaggtaacgcaattcagacgcaagaagaactggaagagttgaatgttttaaatacgcagactggcgtgattcgcactcagggggactatacgggcagtatctacatgcgtgctgatgagaaagttattgtgaacaatggcttgattgagcatctgtcacacgcaggtgggactgactacagcaagggttttgccattggcgctgtttctgatggtggcgag

SEQ ID NO: 11014 - DNA, 267 bp, Glycine max
  Peptide Sequence Number=SeqID_102699
atggatggccctaggcctatccttgatcctattgtaggttggcatgtcatgttgttctccattcctcatttttacatgcttaaacatgcgcccaccaaccgttcggtatgtaaactaactatgaaaaaggaaaatcaccctaatcctgatcaagcatcgaccgcagattcctcttgttgtactaaactcggcaaggaccgcattaacacaaacatacaacaactaggttattgtaccccgatccctcgtgatagtacaacaaactag

SEQ ID NO: 11015 - DNA, 636 bp, Glycine max
  misc_feature (635)..(635): n is a, c, g, or t
  Peptide Sequence Number=SeqID_102700
atggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaaagtagaatttggagcattccaaaaacttggagatccaactacaaaaaaaacagttgttgcgagggttgcccaaaggcaatatataaggcatacccagtaaaacttacaagtaaaccagatatagagatggcagggagggttggtgggatcctctna

SEQ ID NO: 11016 - DNA, 679 bp, Glycine max
  Peptide Sequence Number=SeqID_102701
tcaaggtgcaccttttgagggcaccattgttgatgactggaaatttgattattctagtcatgatgctcgtcgtatgatttgcactgaccaggctgaaatggccggtagattgttggccggatcattaacatttgataattgcatcatgcactatataattgttagaattttgcttccctggtcttcaaatttggctcaaacctctaaggaggatttgattttgatgtgggctttccttaccggtcgtcagatcgactgggctcacttggttcggtaccgaatgcataaggcattacgggccaatacacctctcccttaccctcaattggtcactctatttctccgtcattttcaaattccgcttgatgatgaaccatttgttcaagtcaagcgttcctttgctattggtgctggatcggaatggtcaatggctgaagaaagatgcacttcccctcttcaagatgagcatactccttctcttcctcctcagcgagatgattcagccctcatgactgaagttctttctgagttacggggtcttcgttcttatgttggtgaacgtttcgactcactggatactcgttttgccggaatggatattcgcctcacacagcttgaagaagatgtgggttacatttgtcagagtttcgatcttccaccaccacctccaccttcttag

SEQ ID NO: 11017 - DNA, 246 bp, Glycine max
  Peptide Sequence Number=SeqID_102702
atgacaaagtcatttgttgggcatccatatgcgggtcgactgactaaagatgagaagattgttgttgttgatatgacaaagtccatggtgaagccaagaaatattcttttgacgttgaagaatacctacaaaacaaatagatacaaattgttgttgcttgatatttttggtgttacatcaacaagaatgacattctccgatgcttttgcttacttggagggagaacgtcttaataatgttgtttag

SEQ ID NO: 11018 - DNA, 316 bp, Glycine max
  Peptide Sequence Number=SeqID_102703
atgtctgcagatgtaaccttctttgaagacacacccttctcaccctccgtagaccatacttcttctctccaggaagttcttcctattccttctccttgtcctctaggtaactcagaccaaaatgtcagtgttgtcccacctgaagttgtctctccacctcttattacagatcaacacaggacaaggcagattggatctccagtacctgaagcttctcctcgtccttcctcaaccagtcctcaactcatggatccttcctctccttccacttcttctcatcattctgactcacattggcccattaccatcaggaaag

SEQ ID NO: 11019 - DNA, 700 bp, Glycine max
  misc_feature (694)..(694): n is a, c, g, or t
  Peptide Sequence Number=SeqID_102704
atggccaggacggtgaccgaccagctgaccggctacggtcagtgggagtaccaggcagcgctgaacaccgcagaatcgcagggcaccgccaacagctacacccgtgttggcttcgccggtctgaaattcggtgatgcgggctcgttcgactacggtcgtaactacggcgtactgtatgacatcggcgcctggactgacgtgctgccagagtttggtggtgacacctacggcgcggacaacttcatgttccagcgcagcaacggcctggcgacttaccgcaacagcaacttcttcggcctggtggatggctggaactttgccgtgcagtatcagggcaaaaacgacaacccaaccgaatcctcttccggtcgtgatgtcctgggtgagaacggcgacggctggggtctgagcaccacctacgatctgggctccggcttcggtctgggtgcggcgatgttccagtctgaccgtactaacaatcagaacggcaacgcgccaggcattctcggtcgcggtgataaagccgaagcctacaccggcggtctgaaatatgacgctaacaacgtgtatctggcggcgatgtacacccgttcttacaacgcaacccgcttcggcgcggtggattctgctgcgtacggctatgccaacaaagcggacaactgggaactggtggcacagtatcagtttgacttcngtctgc

SEQ ID NO: 11020 - DNA, 558 bp, Glycine max
  Peptide Sequence Number=SeqID_102705
cggctatcgtaagtggttgagagtttggacacaagagttggattggctcccaaggctaaaggctacaagaaaggaagaggttgaaactctggaggagagtgaggaattgcaaaccctaaaagcggaacttgaaagagcccaagcagttaaaaagaagttcaattcaacggccattaaagtccagaaatatgagcttaagctccgaagagccgaaagggatcggtcgtgggtcgaaggcatgatcttgaaagatgagttaaaagcttgccataggtcaaaaagaagtttgtccaagcagctgagcaagactgaaggaaatatgtgggccatcatcgaccagtacaaggaaaagctaagcctagcagcgactcatgagcaaaggctagaggacgagtacgccaaggtatcaaccctacaagcggaaagggaggcaagggaaagggtgatcgattcattgcacagagaagcaatgatgcggatggacagtttcacctttactttgaatgggagtcaagagcttccccgactactagccaaggccaaggcaatggcggatgt

SEQ ID NO: 11021 - DNA, 565 bp, Glycine max
  Peptide Sequence Number=SeqID_102706
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctttcccttgagattaagaaacaccaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11022 - DNA, 624 bp, Glycine max
  Peptide Sequence Number=SeqID_102707
atgagaagaagcaggctattgttggaggaggcatggttggcatggctttatcttgtttcttgggtagcaagtaatccaatgacaaagcagttgagtgttgcaattattgatagcaatccagctcttggtagtagcttgcacatcaagaaggaagatccccctgatccaagagtcagtacagtaactcttgcttctatttcttttctccaagaagaattggaggcaactaggaaaaaattagctttggttagagaagaaggtttccagtttatggcctctttggatgtcataagaaatgagttgaagcatgtcactgctgagacagataggttgaagaagaagaaagggaaagtagacccaaccgttcaaaatctcaatttcaagattttgagagcaaagtctaaattagaacctgtgtctgctactaaggaaaaggccaaatccatagtcatgagtcaatctcatactcttgaaaagctgaagacagaaacagaagaagcaaaaaaggaaaatgaggatgtaagccaggaggttgtaaggcaagagctagaagtaggcaaagcatctgaagctctagccttagagaagctgaaaactcttactgagagtaccatgagagaatga

SEQ ID NO: 11023 - DNA, 369 bp, Glycine max
  Peptide Sequence Number=SeqID_102708
atgtcttgcaaaaaggataaaaacaacttaaccaaacactttgttcacaaagaactacgtaggttgtcgtctcttgtgatggacgcgtggggtgctaataccttcccctttttccgacgttttcctcaaataaatgttggtggcaactccgcgcgtattcctttcttggaacacgcacccgcgagtcatgcgtcgccctccctccgaagggtaggttgcgacaatgagtatctaagaaatcatgcagcctcagcagaaggtaagttaagaaactggctgattgatcatgaacaagtcaggtgtcttagcttgagtgagcaagagcttgaagatatcgccaaaaatcatgaaactgacattgtcaggtga

SEQ ID NO: 11024 - DNA, 186 bp, Glycine max
  Peptide Sequence Number=SeqID_102709
atggaagagcgcttatgtgcatattctcgagctgtagcccactttcccatgacagttaaggagttcaaatggagaaatggttggttttgttctctctctaagaaggctactgcccaaggcaagccagacccatgccctttgcattccccatggctaaaagagttgagaattgttaacagcttctaa

SEQ ID NO: 11025 - DNA, 285 bp, Glycine max
  Peptide Sequence Number=SeqID_102710
atggacgaagatgagtggatgtatgaaataatgtctgaacgagcggatatggattatgaaaatgcaaaagcatgtggtgcgaatgaatcacatgttgattgttcatattcgttcaacacttctcaggtgtttgagtgccgagaggatgttttgcggtgggctcgatccgtggctcgtgaaaatggatttgtggtggtgattttaaggtcggacacaaacacaggtagtagaggaaggactaagtttgtgttaattggctgtgaaaggagtggcgagtataggtga

SEQ ID NO: 11026 - DNA, 294 bp, Glycine max
  Peptide Sequence Number=SeqID_102711
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgtacgttgtgttctgaagtttgcgatgccgtgtcgtattattgggggttaatcgacccgtttactcagcgataa

SEQ ID NO: 11027 - DNA, 270 bp, Glycine max
  Peptide Sequence Number=SeqID_102712
atgatcaagggtaccatgatggaagctgaccaagggtttagggtggaagtgaaaaggggcacaaagatacccaatttaaggccttacaaatacccccattaccagaagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11028 - DNA, 735 bp, Glycine max
  Peptide Sequence Number=SeqID_102713
atgattcgaagcactttacactattttggaaacccaaggactcaatcgtatggatatgtaaaatacaggatttccaatcctagcaggaaaagggggggaacggatactcaatttcaaccgtattcgatgaaaagtcgtatgtacggcttggagggagatctttcatatctttcgagatccacccctacaatatggggccaaaaagccaaaataaatgattttagcccttataaaagttataaaaaaacggatcctcctttcacgctcatgtcacggcgaggtactgcagaagaaaaaaccgcaaaatccgatccaatttatcgtaatcgattagttaacatgttggttaaccgtattctgaaacacggaaaaaaatcattggcttatcaaattatctatcgagctatgaaaaagattcaacaaaagacagaaacaaatccactatctgttttacgtcaagcaatacgtggagtaactcccgatatagcagtaaaagcaagacgcgtaggcggatcaactcatcaagttcccgttgaaataggatccacacaaggaaaagcacttgccattcgttggttattgggggcatcccgaaaacgtccgggtcgaaatatggctttcaaattaagttccgaattagtggatgctgccaaaggtagtggcgatgccatacgcaaaaaggaagagactcatagaatggcagaggcaaatagagcttttgcacattttcgttaa

SEQ ID NO: 11029 - DNA, 534 bp, Glycine max
  Peptide Sequence Number=SeqID_102714
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccctcatgatttgacagaggattcccagactctaatgagcaaagatgttgtgaggaatttatcatttgaaagttctgatgatgaagacaatgctttgtttggactaaaagcagaaaggctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 11030 - DNA, 642 bp, Glycine max
  Peptide Sequence Number=SeqID_102715
atgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccctcagattgggccataattcagatgatcaagcaccaaaatcttccatttatgattccatgcctgagaattcttggaccccgagctaggaattggaaaaggtggtcaaacacattgccacagttcaacttcctgagcttctgcatccaatatgacaagccattaaagtgtgggaaaattctaaaattccggggcattgacatggggatgaagaagaacaggtgtaggacacgcgtaaaatttcccagccaattgaaatcgcttgtggttcaagaaatgggtaccgagctcgaattcgtaatcatggtcatagctgtttcctgtgtgaaattgttatccgctcacaattccacacaacatacgagccggaagcataaagtgtaa

SEQ ID NO: 11031 - DNA, 676 bp, Glycine max
  Peptide Sequence Number=SeqID_102716
cagcaaaacgtactactccatcggcggtggtttcatcgtggatgaagagcattttggcaaagatagcgtcggcgacgtcagcgttccgtatccgtttaaatccgctaccgagatgctcggttactgcaaacagaccggtctgtcgctgtccggcatggtgatgcagaacgaactggcgctgcacagcaaaaaagagattgaagactattttgcgaacgtatggcaaaccatgcgcgcctgtatcgatcgcgggatgaacaccgaaggcgtgctgccgggtccactgcgcgtaccgcgtcgtgcctctgccctgcgccgtatgctggtgacgacggacaagttctccaacgacccgatgaacgtggtcgactgggtgaatatgtttgccctggcggttaacgaagagaacgccgccggtggccgcgtcgtgacggcgccgaccaacggcgcgtgcggaattgttccggccgtgctggcctattacgaccactttattgaacccgtgacgccagacatctatatccgttatttcctggcggcaggggccattggtgccctgtacaagatgaacgcgtctatttctggcgctgaagtcggctgtcagggtgaagtgggtgtcgcctgttctatggcggcggcgggtcttgcagagctgctgggtgcaagccctgagcag

SEQ ID NO: 11032 - DNA, 408 bp, Glycine max
  Peptide Sequence Number=SeqID_102717
atgctcagtggcagaggacctgctacagggtttgatggacaaaggcctgattggggtttatggcacgagaaaggagggaaaggatgcttccaacctatcccagtcaagaaacctgcactgttcccctacaaaagtgacaaggcggtaccatggaggtacaccacacaaggacccgatgaaaggaaggacgcgtccgttatacacgctaaagatgatctatccttcgctaaggtcactaacatctttggcacaagtagcatgacccgtagcgggcagatcttcgtggcacccgaactattggtgccatccaaggacccaagggggaaggcaaaggcgggcatggaagagagcgataaggcagacttgttcgacggccggcaagtgcaccagatcgagcaagtagtataa

SEQ ID NO: 11033 - DNA, 354 bp, Glycine max
  Peptide Sequence Number=SeqID_102718
atggacaaatatgctgaacgaagcaagcgtaggcaaagtattttacaagaacggaaaaaacagcgttcaactactaatgatgaacatcaaacaccaactaacactacacagcatgatcaatttgtcggcgatgacatctcatattccactgatgatgatgtaaatatgacacaggaaaacattgatatagaatactcattaaatgacccaacaatagatgatcttgatgattatgatgaacaaacctttctatctgcctcatctgcataccaaaatacaggtggtacttacattgatatcggagatcctgtatgggaatgcccacattgtaaggctatgatgtggatcctctag

SEQ ID NO: 11034 - DNA, 444 bp, Glycine max
  Peptide Sequence Number=SeqID_102719
atgaagcacttcactgacaccctcatcagtgccaacatacttcttgctgattatagccttgagctactatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11035 - DNA, 580 bp, Glycine max
  Peptide Sequence Number=SeqID_102720
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctcagcctcaacagaaagactctcaggcttagcgcacagggcgcgcttaaccttattacaaaggaaaacttacagaagcaaagtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11036 - DNA, 519 bp, Glycine max
  Peptide Sequence Number=SeqID_102721
atgccatatgtggaagctacggaggagtcattcgaaacggtcttccagtcttttgaggtggttagcattgcctctgtagattccttctctgggcaaccttgcctttccgatgcggcagtaatgatggcccaagtgatgtttgggaatggttacgagcccggaatgggtttaggcaaggacaacggcggcataaccagcctgataagtgctaaaggaaaccgtgggaagtttgggttaggctatacacccacacaagcggacatacagaaaggcattacaggatggaagagcggaggtcaaggctcgcgattgggacaaaaagtcaaaggaggcccgccctgccacatcagtaggagctttataagcgcgagtctaggacacgaaggccaagtcgttgtgatatgtgaagatgatttgccaagtgggtcggagttggtacaaccatgccctcctagtttccgactaggaaattggcgagtggaggaatgcccagacatttacgcaacaagcataatgtaa

SEQ ID NO: 11037 - DNA, 189 bp, Glycine max
  Peptide Sequence Number=SeqID_102722
atggataagagcttgaaggtaggagaagatgaatggagggagagggagagaaggagcacaaaattttgtgcctcaaatgaggccttggatcttcttcatcaatggagtcctttgcttcttgaagatcaatggcagcggaatagagaaggaagaaagatgattggagatgccacttcaaggagaagatga

SEQ ID NO: 11038 - DNA, 243 bp, Glycine max
  Peptide Sequence Number=SeqID_102723
atgggatcaaatcaagcacctttgtttaagaaaaggttctatcacgtcaaaattaaaagcctagaggttgccagtttgcaaaaattagagcaattgatggatcagctccaacgtcaagctttcctcaagacctatggaaagatatgggatctagtaatgatagaagtctttgttgaagccattgcatccctcactcagtattacgatcagccgctaaggtgcttcacatttggggacttttag

SEQ ID NO: 11039 - DNA, 525 bp, Glycine max
  Peptide Sequence Number=SeqID_102724
gtttaccaaaggtcaaagaggagtttgtccgaacaattgagcaagacggaagagaacatgtgggcaatcattgaccaatacaaagaaaagctaagtctagctgcaacctatgaacaaaggatagaaggcgagtatgcgaaggtatcactcctacaagtggaaagggaagcaagagagagagtgatcgattcattacacagagaagcaatgatgtggatggataggttcgctttcgccttaaatgggagtcaagagcttccaagactgctagccaaggccaaggcgatggtggacgtgtactcagcccccgaggaagtgcaagaacaaatgaaggccaatatggaggccttgaaggatcaaatggcttccatgatggaaaccatgttaagcattaagagaatgatggaaagcaatgtggccgcagttgccgccactagcgctgccaccgaggcaaatcttacccatccatttaccataaaccaagcgaaccaacccatcccagacatggtgggggaaggaggatag

SEQ ID NO: 11040 - DNA, 267 bp, Glycine max
  Peptide Sequence Number=SeqID_102725
atgacgtttttccaaaactacttggactacaaggcccaaaacgtacaagtgactaacgctctcgaaaacggaagcttcgcacacactccagacgtcttctcgaagatcccaacggttgaagcactgacggatgaaactcacatcctcctcaagctaagtgatgtgtgtatccattcctgcaaaccgtgcatcaatggcatcaatacggttgtccaagtagtcaaaacgctcaccgacgaaggtgtggagaccatccaacttgtctag

SEQ ID NO: 11041 - DNA, 249 bp, Glycine max
  Peptide Sequence Number=SeqID_102726
atgcaaaagctcaaggaaaagcctaaactccctctccaaaatctgatttcaggcttaaataggatgacccttcgctcagcgaacatgcacaactcatccttcttccagattcttcctcgcactcagccgaggagtgttgtgctcagcggatgtctcgctaagccagaagattggcttagtgagagggtgaaaatcagcacttcacaaacttgcctaattaacttgaaattgagaggaaatgattattaa

SEQ ID NO: 11042 - DNA, 598 bp, Glycine max
  Peptide Sequence Number=SeqID_102727
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgataccaccagcagcgcttggaggcccatctgcatggtgaaggtcgcccccggatccaggatgcgcgccagcatgatggagaagaagacgacgacgagcgcggtcaccagccccgcgccgaagaagtagagcagggtgtccccgatcaggatgcccagcgtgcagcccagcgccacctcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11043 - DNA, 369 bp, Glycine max
  Peptide Sequence Number=SeqID_102728
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaagagttggtagctcagagaaccttcgaaaaccgccctgcaaggcg

SEQ ID NO: 11044 - DNA, 532 bp, Glycine max
  Peptide Sequence Number=SeqID_102729
ctgtccctcctgttcagctactgacggggtggtgcgtaacggcaaaagcgccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgttgtggattactctcacttcatcttcattcacatcaccaaaatcaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11045 - DNA, 138 bp, Glycine max
  Peptide Sequence Number=SeqID_102730
atggcacaagaatgcttcccaaatgaatatatgatgtggaattgctcctcaagtgtaaatagatggcatgaaagttccttttcaaatgcaagaaatggccccgaggaaacttgcctcaaagagatccaggaaggataa

SEQ ID NO: 11046 - DNA, 360 bp, Glycine max
  Peptide Sequence Number=SeqID_102731
atgaggctgttcttccagagcccaattgtgccagttatacaggagactgttgaagcaggtgagtcacagttaaggcaggaggctactactcttaagaggacatcacagaccccagaaggtccactctcaccagggatggacctatcttttgctcagcaggtagtagatccttctacaccaatacaagagagacaggcagaccctcctacacccatcatggagatgccagaagaccctaccacgccagtcctaagactgtcatccactcctctagctaccccaattttacatctgataaatgaggaggatatgcaagaccaggacacacagggcacacaggaccagtcacaggaattctaa

SEQ ID NO: 11047 - DNA, 240 bp, Glycine max
  Peptide Sequence Number=SeqID_102732
atgattttgatgatgccaaagaagaaacacacaaggttgcttgaaaggataagcactgcttcaacattaatacaagattgcatagcacatgatgtagctccatgtggagcttgtagtgatgcaatcctccctaggaagggaccagtcactagagccatgagcaagaggctccaagacgattgggctagagctgctgaagaaggccctagggttcttatgaaccttagggtagatttctaa

SEQ ID NO: 11048 - DNA, 177 bp, Glycine max
  Peptide Sequence Number=SeqID_102733
atgcgatggcttcaacggacacttctatcattgccagatcccatatcttcccatttattatcatggtacccaatgcatgcaactaagaaagcggtgcagactttcatgcttctttgtgactttgacgacaaaaaagaatgcaaggcatgtgtcacgacacggcggaagtatgcatga

SEQ ID NO: 11049 - DNA, 303 bp, Glycine max
  Peptide Sequence Number=SeqID_102734
atgaccggaacaagttctgaggggctctgtggagtagatgagttgaaggcttgctcaaggtccaagagaagtttgtctcagcgtttatgcgagacagagaccaacatgttagccatcatcagcaagtaccaagaggaactaagtctagccacgacccacgagcatagggtggcggacgagtatgcccaagtgtacgcgaaaaaggaggctagaggaagggtgatcaactcgttacaccaagaggcaaccatgtggatggaccaatttgctcttaccttgaacgggagtcaagaacttccctga

SEQ ID NO: 11050 - DNA, 1449 bp, Glycine max
  Peptide Sequence Number=SeqID_102735
atgattttaacggtcaagcaaccctatgagctgatcaaggaatcgctgcccattgtcggttatgagcaccgttaccgtggccaagtctctggcatcgaactgactgcgatcgatgtagaagaagcgcacgaaagccagcaaacggtgtacaccattcacctggaatatcaggtattcaaatccggccgcgtggctaagccagccatcctcaggggcgaaattgtcaaactgcggcaacaaggcagcagagacatcaaacaattccgcatgccttcgttcaacttcaggacctcaccgctttcagtctatggtgaagtcaatttaaaaaatgagatgagcccatttgttgctcccctgcaactgcatgctgataaagaatggctggcactcaaggttgcggcgggggttctagtggtttgcttactaggtctggtttatatcctgggcgctagtacctggttaccccgcatgggcggcgcctttgccaaagcttaccgcaagattggcaaattgccagacgacaaccaaggcctgcaacaggcaatatccacgctgcatgaagcgatgcatcaagtggccggtcacagcgtattcggcaacggcattgatcatttcttacagcaaaaaccgggctttgccgctgccaggccagaaattgaacgcttttttgccttatcccgccaggtattttttgatgccaacacgccgctggacctgggcctgctgccaccagatccgttgtctaaaaccatagggttcttactcaaggtattagccgttatcagcatcgttttcattattcttggcctggccggaccacatagtctggagcaacaagtggagcgtacaggtatcggtgcacagatcggcctggtgctggaccgcagtgccagtatggatgacccgtttgccggcgacaaagatggcaatgtgggtgaaaccaagtccgtggccgccgctcgcctgatgaccaagtttgtgcaaagccgccagaacgacatgatgggcctaatcactttcagtaattcggcaatgtatgtgttacctctgacagaaaataaagaagccatcttgtcagccattcaggccaccgccgggaactcgctttttcaaaccaatattggtgggggattaacgggtgcagtggaactgttcaaggatatgcctgactctggctcacgcgcgattatcctgatttctgacggtgctggccgtgtcagtgacatggtgcaacaaaaactgcgtgactggctgcaacgctacaacattggcctgtactggattgtgctgcgccaacctgggggcattaccattttcgaccccaaatacaccgagagcggctacgatggccctatgcccaccgaagtgttgctttaccagtttttccagacactacgcaccccttttaatgcttacgaggcctcagatcccaatcctgctggcggttaa

SEQ ID NO: 11051 - DNA, 171 bp, Glycine max
  Peptide Sequence Number=SeqID_102736
atgaatgttgcagacaatataaagacaactctccctaagattgatagtgctaaagagtttatgggattagtgaaagagtgctctcaaacagttgataagtctcttgtggggacattaatgagtacattgagcgccatgaagtttgatggttcacgaataaacgaggcttaa

SEQ ID NO: 11052 - DNA, 204 bp, Glycine max
  Peptide Sequence Number=SeqID_102737
gtgacggcgttagtgaggtgtataggtggcaattcagtgccacgtagattgtccaacgtggcactgaggtctgcatctataaactctctctcacgcaaggttgcttcttcttcttccccaaaaaaattagggtttacgaagctgctggttgcttcttcttcttcttcttcccacgctgagttgcttcttcttcttctactctaa

SEQ ID NO: 11053 - DNA, 462 bp, Glycine max
  Peptide Sequence Number=SeqID_102738
atgaccatgattacgccaagctcgaaattaaccctcactaaagggaacaaaagctggtaccgggccccccctcgaggtcgacgattatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11054 - DNA, 429 bp, Glycine max
  Peptide Sequence Number=SeqID_102739
atggacacgaagagagagcttaagccaaagagaagcttcaagggtaagctcttgcggaagtcttgggcctgttttcgagatgtgagtatggcgaggaacatgatgagtgccgtgacggagaagcaaaggcctatgagcgaggcgatggcgaatgcgtcgaaggcgggctggccttcaagttcgggtttgcccttctcggtgccaccggggacggagctcgatgtggcgaaggagacgccggctattagggcagcgacgacggagcaggagttggagatttcgcctgcggttttgtcgtccttgttggttctgaaagcgaagtgctccggcactagggctctaatgtactgctccacatggcagaatcaagggattaataatatgagtgtgcatatatgttgtattgttgtatatgttacatcaaattaa

SEQ ID NO: 11055 - DNA, 795 bp, Glycine max
  Peptide Sequence Number=SeqID_102740
gtggcaggcggaaatacccctagtggttatccatacaaagataacatctactgatcctgacccacgtgtcaggtggaaggcagaaataccccgagttgttatccgtacaaaggcaacatgtgctcatcctgacccatgcgtcagatatatccaattgattatccgtacaaagacaacatctgctgatcctaacccatgcgtcagatatactgatgtgattatccgtagcaagacaacatctgctgatcctgacccatgcggatatacccatgtgattatccgtaccaagacaacatctgctaatcctgacccaagcgtcagatatacccaagtgattatccgtacaaagacaacatctgctaatgctgacctatgcgtcaggtggcaggtggaaatatcgcaagtggttatccatacaaagacaacatctgctgatcctgacccatgcgtcaggtggcaggcggaaatacccctagtggttatccatacaaagataacatctactgatcctgacccacgtgtcaggtggaaggcagaaataccccgagttgttatccgtacaaaggcaacatgtgctcatcctgacccatgcgtcagatatatccaattgattatccgtacaaagacaacatctgctgatcctaacccatgcgtcagatataccgatgtgattatccgtaccaatacaacatctgctgatcctgacccatgcggatatacccatgtgattatccgtaccaagacaacatctgctaatcctgacccaagcgtcaggtggcaggcggatatacccaa

SEQ ID NO: 11056 - DNA, 493 bp, Glycine max
  Peptide Sequence Number=SeqID_102741
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatacatgcgtgtccaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11057 - DNA, 690 bp, Glycine max
  Peptide Sequence Number=SeqID_102742
atggttgcaagtgacattgctattctgagagatagagcccacattcctactaaaaagagcttattggagctaaccttacaagatgcattgttggcacagaacaagttgctatctaagcaactggaggcattggctgaaacactaagatgtacaatttgtggtggagcttatgaatctggatgttgtatccctaatgaaaaacaagtcacacatgaagtcaattatatggggaaccagtccagaaaccattttaatgcaggtggatttttcggattccagcatggacaacaatacaaccaacaacagggacaatggaggaaccatcctgggaatcaattcaatagagaccagggatcatccataaggctgcaaccacaagggtctagtctctatgatcgaaccatgaagctggaagagactctagctcaatttatgcaggtttctatgtctaaccaaaagagcacagagtctgccataaagaatctggaggtccaagtgggacagctcgcaaaacagttggcagataggccgtcaagaagctttagtgctaacactaaggaaaatccaaaggaagaatgtaaagctatcatgacaaggagtagaatgacaacccatgtggatgaaagaaaagttgagaagaagatggaggaacataaacaacaactggctgatgaactggcactggaaccg

SEQ ID NO: 11058 - DNA, 450 bp, Glycine max
  Peptide Sequence Number=SeqID_102743
atgatgacaaaaaaatcccaagagaatgacttcaagattgagtcaataacaattcaagaatcaagagaaatattcaagagaaagtttcatcaagaagattcaagattcaagattaatcaagatcaagattcaagactcaaagattcaagaatcaagagaagacttaatcaagataacacaagaagttttcacaaaatcattaccaaagagttttactctctgggtacatcctttgtggtacaagtagatggtacatctacttgggttgttgtgactgagaacaagagaggttacatctcttgtggatcagttctagtggagggtacatccactaggttgttcaaagagaacaagggagggtacatcccttgtgcatcttttcttgtaaaggattttacaaggttgaaaagaaatctcaaggaccgcaggtcgcttatggactggacgtag

SEQ ID NO: 11059 - DNA, 752 bp, Glycine max
  Peptide Sequence Number=SeqID_102744
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgatgaagaagatcctaggcctacaagctccaatggagcttgcatcagtattatagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11060 - DNA, 732 bp, Glycine max
  Peptide Sequence Number=SeqID_102745
ggaggatttcaagtgagccgtactacaactgttgatggcgctccggcaagcgacactgacaagcaaagcatttctcagccaaatcaatttattaaacgcggtacgccgcaatttatgcgcgtcaccctggcgctgttctctgccggactggcaacatttgcacttctctattgtgtgcagcctatccttccggtgctttcgcaggagtttggcttaacccccgcgaacagtagtatttcactgtccatttccacggcgatgttggctattggtttgctgtttactggcccgctatccgatgccattggtcgcaaaccagtgatggagatgcaaaaagcgggtcgtctgccgtgtcgtaaagaatgggtcgccgactgccagcagcgtaaacgcactttgctgcgcaaaacccacttcgacaacgtgccggtgaaaccgcagcgcgtgtatgaagagatgaacaaagcctttggtcgcgatgtttgttatgtcaccaccattggtctgtcacaaatcgctgcggcacaaatgctgcatgtctttaaagaccgccactggatcaactgtggtcaggctggtccgttaggctggacgattccggctgcgctaggggtttgtgccgctgatccgaaacgcaatgtggtggcgatttctggcgactttgacttccagttcctgattgaagagttagctgttggcgcgcagttcaacattccgtacatccatgtgctg

SEQ ID NO: 11061 - DNA, 147 bp, Glycine max
  Peptide Sequence Number=SeqID_102746
atgtatttgctgccattgaccacatacatcaccatggaaggcaaattcaatgctcatactgaatgcattgttgcagaagactctgaagtcgccgaagctttcttaagtcaggttgacagtgtcaagttccaagagatactaatgtag

SEQ ID NO: 11062 - DNA, 550 bp, Glycine max
  Peptide Sequence Number=SeqID_102747
gtcgactctagaggatccccgaatacacgtcctcaacttaagagtgctacacgcccttaccttcagaggactacacttccccgccttcagagggctacacgtcctctccttcagaggactacacgtgctcacctttagaaggctacacgtcctcgccttcacagggctacatgccttcaccttcagagtaatacacgtcttcgccttccgaggactccacgccttcgctttcatggggctacgggccctccccttcaggggactacacgtactcaccttcagaggactacacgtccccgccttcagagggctacacgactacatgtacacgccttctgaggactacacaggattacacgtgctcaccttcagaggactacacatcctcgccttcagagggctacacactgtcaccttcagtggactacacgtcctcacctctaaagggctacacgccctcaccttcagaggactacacgtcctcgccttcagagggcttcacgtccttgcgttcagagggctacacgccctcacctttagaggactacac

SEQ ID NO: 11063 - DNA, 342 bp, Glycine max
  Peptide Sequence Number=SeqID_102748
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccatgcatcctccaccatcgagtctggagccccacgaattgattgcctagcactgttcgtctatcctccaccctcaaatcttattcggagtcccatgaattgcttgcctagcgctgttcaagcgtccttcaccatcgagactggagccctatga

SEQ ID NO: 11064 - DNA, 336 bp, Glycine max
  Peptide Sequence Number=SeqID_102749
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccctggttcccttgatggtaaactcttcagctcctcttcaatcatttttaaagctctgagcttaaacaaaacattggatacgacatgggttttcagag

SEQ ID NO: 11065 - DNA, 261 bp, Glycine max
  Peptide Sequence Number=SeqID_102750
atgggctacaagtgtcataataatcctgaaggaatccgttatgctaaaaggagcagtcatgctcaacggaccctatgggctcagtgcagatcctgggctaagcgtagcttcagtgtgcttagcgtgacaagggaatctggaagagctcaagaatcaaggccgcacgctaagcacgagatcagctcgctaagtgagacgtttgtctcttgccaggctcaacgtacgactaacgctaagcccaaatccacttactcgtgctaa

SEQ ID NO: 11066 - DNA, 561 bp, Glycine max
  Peptide Sequence Number=SeqID_102751
atggaagatccatcatttttcgatcggatgatcagtcatctgagagcaacttgcaatgttccttggattatacttggagcagtctcacctgatctaattcttttctattcttggaatttttgtgataatgtaaggtactatactggttatccaaaggaccttggaccatcacgggttattcattttacctctgagcgtgagtttgttaaactccttcacgaaggtttccctgttgttgttgcatttaccatcagggggaactacacacggcatcttgacaaagtattagaagaatctgctgctgagttttatccaaatgtaaaatttatgcgtgttgaatgtccaaaatatcctgggttttgtataactcggcagaaaaaggagtatccattcattgagatatttcatagtccaacacaagcagctaaccagggaagggtagctgatccaaatattactaaatacaacgtgaaggtcttgcctttcaactacgatgttagtgcttacggttttagagaattcttcaagcaacatggtatacgggcatcagatccaaagtag

SEQ ID NO: 11067 - DNA, 219 bp, Glycine max
  Peptide Sequence Number=SeqID_102752
atgaagaataagaagggtgttgtggctggtgtctcgctaagcgaggtacttagcccgcttagcgagttgggagaatctggaggagaatctgccaagcatctgcacgctcagcgtgtcatcaactcgctcagcaagtcgtttgtcttttctcatgctaagcgcacccagctcgctcagtggaaaatcgcttacttgtgcttagcacgaaaatggcgctaa

SEQ ID NO: 11068 - DNA, 591 bp, Glycine max
  Peptide Sequence Number=SeqID_102753
atggagctccgtgacattgatgtcaagataaaagatgaagatctgacaatgattctgttagcctctccccttctttcatatgagaattttgtgagttctcttagtgttggcaaggattccattacacttgaagaattcaaatgctggttcctaacatatgaaatgtctggcggtaatgttctaatgggtaaaaatactccttgcaagttagttagtataggttctatacaaatcaaaatgcattatgagattattggaaccttaattgagatccagaaacaaagccaaaaggaagggcaaaatggtcttttctcaaatatttctgatttcaaattcgccagttcgtttgggctaaaatgtaactttagccctaagcaagcaacttgcctgggcgagtggatgccttcaacaccatgcatgttgaaggagaaaatcatcccagctgaaccaaaaaccatagaaaaatgcagaaaaagagtgaagaagaaggagaaaaggaaaagtggagtcaaggcactgcagagttgtgaccgtggatcacttccttcgtcatttctcttgttagtcttgtgctttgcacaaatcggttag

SEQ ID NO: 11069 - DNA, 282 bp, Glycine max
  Peptide Sequence Number=SeqID_102754
atggcagtgaaagaagctatatgtgaaaatgaaggtgaacgtaaattatatgaagaagccctcattgccatcacagttgatgagcctctaaaacgttactgccaacggattgtgcgacctgatttctggggaggagaatcagagctactgcatttaggcggtggttttggatctggttttattcccattgcagattatggaagtgagtttagaaagggttctagccgaaaagctgtgaggctattgtacagcggtaagaaccattatgatcttctactatga

SEQ ID NO: 11070 - DNA, 69 bp, Glycine max
  Peptide Sequence Number=SeqID_102755
atggcttttgctgttgaattcgaaggttgtaaaagcatagtactaactcgtgtgagaaagagggagtaa

SEQ ID NO: 11071 - DNA, 423 bp, Glycine max
  Peptide Sequence Number=SeqID_102756
tggttccctgagatccctccagttattcccccgactgctccgatagaattcccaaacgtcagagagacggagaagagattgaagcctccacttgtactgtcttcatgcgattcctttttctccctccacgaatattatcacgcaaatcccaacggtgaaaaccattttgggtttctgcgggaaaggaaaaggctacaatgcgaaaggtatttctctcagctcaaacatgatatcgaaattccgaacggtgagaatgctcggaattggtcttcgaacctagtgctcaaatttcacgacgatccaacggtgaacgagtctgagatcgttgtttttctgagacaggccatcaacctaatgctggaggttttcatggtggctaacatccaaggagcctatagaatagatgagtgggtgaactcctag

SEQ ID NO: 11072 - DNA, 159 bp, Glycine max
  Peptide Sequence Number=SeqID_102757
atggtgacgatgatcatggtgacaaaggttgtggtggtggttgatgacgatggtggctacagtgatgatcatggtggtggaagcaatagtagtggtcatggtggtggtagtgacgacaacgacaaagcggtggtcatgatggtgatggtgatgagttaa

SEQ ID NO: 11073 - DNA, 258 bp, Glycine max
  Peptide Sequence Number=SeqID_102758
atggtcttcttgaccagacataaagagtctataaaaggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggattttacaaggttgaaaagaaatctcaaggaccgtaggtcgcttggggactag

SEQ ID NO: 11074 - DNA, 534 bp, Glycine max
  Peptide Sequence Number=SeqID_102759
atgaagatggaaatagtcatcaccctcagaattgaagctccttattcaatgaaaaaaggcttctttgtgcttctgatgcctatgatgctaggaccttttggaatcagattatatgggcgaacactcagaaagcctctacttttggttatgatggaagggataatgatgatcattgcaatgtcattcaagtgttacgtcatgttaggaaatgaagcatctactaaagatatggatgacaccattgtacttggggtcatcattgatctcaccaacactggtgtcatggacgcaactcctaaggcatccaatgcagccatagttgatgaagttgaactcaacactatagaacttgcgtccaagaagtcaacaacttcaaataaggctacttctagagacatgggagaacctaatgtcatcatcatctactccaatagttcaggcactactcccttcaactatgcacaaccttctattgttatcagggatcaagtgcaagacatgatagggcaagttatggaaaccttcatcgaatga

SEQ ID NO: 11075 - DNA, 333 bp, Glycine max
  Peptide Sequence Number=SeqID_102760
atgattaaaaaggagctaaatgctttggagaatgttctaaatgacagatctctatcccaagtggaagtcactcttaagaaatctcttcaagttcaattgtgggaggcagcttatgcatatgaatctatgttgagacaaaagcctagaattaagtggctaaaagaaggggacagaaactctacttattttcacagattgatcaatcatagaagaagaaaaaatgctattccagggttaaaaatgcagctgtcctttatttcaaagacagatttttggaggattgttctaacaggccaacactggatggtgtttacttctcctctctggatctaa

SEQ ID NO: 11076 - DNA, 333 bp, Glycine max
  Peptide Sequence Number=SeqID_102761
gagaatgttcaagaaaaagacgacgttgaagatgaagaagaaaaggaagatgaagcggaagagaaagagaaagagaaggggttgacctctggtttggaacttggtctaaggcttaatggagctgaagagatcaaggcagagctcaagagattgaagaggatgaaggaacatgagaaagtggtagcgcattttctacccttcggtacgattctggccattatgtctttgccactctatgtagatggaaatggcctactcataggatattgcactgttcatcatatttttttgcttctttatatcaatatgaatgtggttgttgaacaacgctag

SEQ ID NO: 11077 - DNA, 1170 bp, Glycine max
  Peptide Sequence Number=SeqID_102762
atggaggataccaatgagttgttgcacctcttggtggatgctatgaataggggattgcgtgatgccaatggtcggatgaagtggtttcgaaaccagtataacatgatgtcaacccttatgcgcaacaactctggctttggatgggacccaattggaaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatactgatgcaaaaacttttgagccagaaaatagaactgttgggatagaagaattttcatatgatcctaataaggttcccatagaaaaacaaaactatcacaagcgaaggagatccgagtatggagggagttcaagcgctgttgggattaacaatcaaggcaacgttctggaaaatctttctgttggcattgggactattgctgtgaattttgaaaaaatatccaacatgatggagaaaagagaaaaagatagagatagagatagagagctcgaggaaatgcttgcatcattcctacagattgtcggccagaacactcgatattgtgtaatccgcaatacatttggccgatcacaatttgctacaagtgaaaattttcacaagattttgaaagctctgaactcattagcacctgatttaatggttagatcaggctcaactgtgcctgcaaaaataagggaaagcacaaggttttatccttattttaagggttcagcacatgattccaaggtgttaagtgatgctttggcaaggaagaatggacttaaagtgccccaaggtcacggtaatgaccctgaaaatgaaaaggaattatttaatcttcggcatgcatccttaaggaatgtgattgagaggatatttgcacttcataattttcttcgcaaagaatgtcgttctgatgaatttccagtggaacctactgacgagtcttcatcttcatcttcagtgttaccaaattacgaagacaatgatcatgaacccattgttcaaacacaagagcaggaacgagaagatgctaatatatggaggactaatataggttcagatatgtggagaaatgctaataattag

SEQ ID NO: 11078 - DNA, 144 bp, Glycine max
  Peptide Sequence Number=SeqID_102763
atgggaaagcgaaataacaatgcaacaattgtagcaaaattgcagcatactaatctcatgggacgtgttgatggacacaagcctcatatcaggaaggatttgcccttgacctggactaatgtctatgaggaggccactaattga

SEQ ID NO: 11079 - DNA, 525 bp, Glycine max
  Peptide Sequence Number=SeqID_102764
atggagatctattatgaagctgtcagagaccttctcaatgcaggtgctacttcactaagaattctagatgatccagagtcattacttttggatttctatcttttttactttgttttaggtggtgaaataaaaaaacgatcgttagcagccttgttcgaaaacaatcaacctctcatcacaccactcacgattctagacatcaagtgggaaagtacgacttcagagaagcaattattggtactggtgcaatggtcagggctatttctggaagacacttcatgggaaaagtgggaaaatctcacgaaagattacaaccttaaggacaaggtcgttttggaagcccgaggggatgttatgaatgaaaagcagaacacaaaacaatatgtaccaacaaaacattatgcagaattgaatgaagatgatgcaacaataacagagcatgaggcagaaccaagagaagaggacaaaaggccaaaaagggaaagcaataggccacgatacctcgaagactacgtggctaagtaa

SEQ ID NO: 11080 - DNA, 111 bp, Glycine max
  Peptide Sequence Number=SeqID_102765
atggatggaagctctgaagtatatataaagcttgaagatgtttgtgttaaggtggttgaattagaagagaatatggatgaaagaaacatgaacaaatcgggagtgacttag

SEQ ID NO: 11081 - DNA, 339 bp, Glycine max
  Peptide Sequence Number=SeqID_102766
atggctcgcaagaacctcgagaagcgaaaggctgcagctaagggactttccaagtgttgccacaatgcaattgtcaacttgattagtaatccagtgaattccatagtttctatagttgcggaggttttcttgaaagcttgtacatatgatccaaagcgactattgggtgttacaaccatggatgttgtacttggagttgatccaagagaggttgatgttccagtggttggaggtcatgctggagtcacaatttttcctcttttgtcacaggttaagcctcccagtagcttcacggcagaaatcacatccaaaatggtggaattgaagttgttgaggtaa

SEQ ID NO: 11082 - DNA, 525 bp, Glycine max
  Peptide Sequence Number=SeqID_102767
atgtaccctctcttgttctcagttacaacaacccaagtagatgtaccctctacttgtaccacaaaggatgtatcctccaatgtgttaagacaaagttctcaggcgggaaaggaaagaatcaaaagaattctcagactttgtcctttgaaaagggagaagggagacacaaaagagtgcaggcgggagaagataatgaaaagatatagcacacttttgttttctgcaaaagaacaagactcttcatgtctgatcaagaaaaccattggaagaggttataaccttgagaaaatcttgagaaaaacattggaagagttacatctcttgactctttattcagaacttgtcactgttggtggagatgaagagttttcaaaagtccaagggatgctcagaattagaaaagaagcaagcacataccttagaattgccgatgttgaactccaagggatgctcgaacttgtggtggtgataaagcctaactcttcgagtagttgcgggtttagcggcgtcgagcaggacatgtag

SEQ ID NO: 11083 - DNA, 200 bp, Glycine max
  Peptide Sequence Number=SeqID_102768
atgtctccacaacttcagtctgcaattataaggggttgtgaaggagactctggaactggttgctgcatcccaaattgtctcaacactctgtccgattggtgctactcaataacttggaaacaaattagtgacaccaccgcgtaccacgcgagacttccgactaaacaaacgggaggcaacaatgatataacggttgatgg

SEQ ID NO: 11084 - DNA, 207 bp, Glycine max
  Peptide Sequence Number=SeqID_102769
atgattctgcctcatcaagtttccaatgctagcaaagttccaaggtataggacttacctagttcatgatcaaacacatgcaatattgatgcaatcctaccccgtaagggcattggataaaagactccaagaagattgggccagagatgcaagagaaagccctagggttctcatgagccttagggtagatttcgagcccatgggctaa

SEQ ID NO: 11085 - DNA, 387 bp, Glycine max
  Peptide Sequence Number=SeqID_102770
atggaggataatctcccttcaactgttttagatgggactgttgttgggatcaaatttggtatggctacacgccaggaaatttctgtcaaaattatgtcagtcacatgcatggcaactggcaactccttgcacacaggcaacaaaccaagcaatgctaaagtgaaccagttagtgaaagctgcagaaaaatacactcttgcaaaccatctattttggggtttgtggggacttatttcgagttatgtgaacaaaattgactttgactataaggagtatggaaggcagaggtttcaacaatactggataaggaagcctagtttattggactcgccaagcatcatttccctagatgaaactgtgaatggattgttgccatccttcacgtga

SEQ ID NO: 11086 - DNA, 479 bp, Glycine max
  Peptide Sequence Number=SeqID_102771
ttcaagtggagggtacatccacttggtttttcaaagagaacaaggaagggtacatcccttgtggatttttggcttgtaaaggattttacaaggttgaaaagaaatatcaagaaccgcaggttgcttggggactggatgtaggcacgaggccacttgatctaacaaaaacatcattaaatagatatacaaatatttacatcaagtacctacaaggaagaaccaacagaggatttagctcttcatatcagaacctcacaatcactcacagacttatctcatgctatcatgatggcttccttttcactctcagttttctgtcagtcttcacacagcaaaagctctcaaaactctctggaacttggacctttctgtctctagaaatctctaaaaatgcagaagctcaaggaaaagcccaaactcttcttccatttctgatttcaggcttaaataggtggccttgttggtgcttgcacgcttag

SEQ ID NO: 11087 - DNA, 270 bp, Glycine max
  Peptide Sequence Number=SeqID_102772
atggaagattttggactccaaagtctattaggaaagccacttatagtgggtgcgaacaatctaacatggacattggtgaagtttatcaactctgagagttgtgatgttggtagtactaagaatgacttaatggcagagaaatacagcaaactcagtgttgcactttcggtgatgcacgagtgttttgagccattaaagaactcttttactagtaaagatattattgatgatgttatattcaacactaggtctgaaattcttatcctttaa

SEQ ID NO: 11088 - DNA, 330 bp, Glycine max
  Peptide Sequence Number=SeqID_102773
atgaacaaaggcggttttctattcacacccgctgtagaaataagtcctacaaagacgggtctcgaagaccgtcgtaattatcttgccgctatttacaaaaatgccttgagagacattctaaggtggttcttgggaaccaccttagaatgtatctatatggagttgattgtgatttacgtggttttcaagcttgacgagagttacacgccgagcaaagtttccatccgtgtcggtgatggttttcacaacttgaaggagattaagatcgtggaactcgtgaagccaactgggtgggtttatctatccttgtctggagctgatcctaggtaa

SEQ ID NO: 11089 - DNA, 288 bp, Glycine max
  Peptide Sequence Number=SeqID_102774
atgcctcttctttccctcattttcgtttttctctcttctcctcccaaaaccctctctttttcccgtaggccactaaacctgtctcagaaaaatgacgatctcagactcattcatcgttggatcgtcgtgaaatttgattaccagaaaaaggaatcgcatgaagatagtacaaatggagccttcaatcccttctcatcctctcaaacgtttgagaaccttatcagagcaaccaagaagaatcttaggaacttgttagagatgtctctatcgttgttagaagacacgtga

SEQ ID NO: 11090 - DNA, 389 bp, Glycine max
  Peptide Sequence Number=SeqID_102775
gcacgggtcagtgtggcgtgatgcacgagtggcatgaagtgggcaatgcatgggtggcgagatatacgtttagacagggtgaggtggtcaacgcggtgtgggggatggtgcacgatggtgggatgaaggttaagggtgagattctgaaggaaagggaaatagggtgcgagaaagggaaggagaaatcacacaggctagtttgcaaacctgttgcgcttaagcgtcacccaagcaagacaagggagatagctattataagtttgcgcttaagctacactcaagttgcacttaagcaagagtcatcagaaaggaagataatgcccaagcttaagcacaagggtgctaagaaggctctcaacctagtgttggaggttgtcggtggtggctaa

SEQ ID NO: 11091 - DNA, 135 bp, Glycine max
  Peptide Sequence Number=SeqID_102776
atgtcattcacaacaacatcccaatcaatggcagcggaatggagatggaagaaagatgattcgagatgccacttcaaggagaagatgagtaaagaagaagttcgccaccatagaaaactatggataaaagcttga

SEQ ID NO: 11092 - DNA, 431 bp, Glycine max
  Peptide Sequence Number=SeqID_102777
atgtgtcacatgggttatgaagatgaggaggaagatgataataacaagaataccaaccataacaatgatgatgatgacaacggtggaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 11093 - DNA, 384 bp, Glycine max
  Peptide Sequence Number=SeqID_102778
atgcagtgtaaagaatgcgaaatagacaacaatttatttacattttacacagttcaacaaatgcacacacgaagctttacaaatccacaattccttaaaagtaggcccaactcacaaaaagtccccagtggagtcgccaactgtcgcaacgtgcccttcgcgggcgagcgagggcgaggctcacggatgcgctttccaaaggaggaaaggtgcgcggagtcgccaccaacgtttatttgtggaaaacgtcgggaaaaccgaaggaaaccggtcaaaatgagaattctaagttcgggagttgtatttacgcttgaggaaggtcgacaaaagcggggcttttgctcctacctaccctcctttggagaggaaatcagacctacgtag

SEQ ID NO: 11094 - DNA, 429 bp, Glycine max
  Peptide Sequence Number=SeqID_102779
atgaacaaagaacaccgaacgaagaatgatgtagaagttgattacagtcgcgatttggtagcgcctcggcctcattttctcttctttcttcttattctttccctctcctctcaatatccttcaatgctgaaccttggaaccctttactcagcctccctcacgcctatttatggcaaagaaaagggacttggtggacttgcagctcaatcaggcaagctaatgcttcactctaaagtaaccttgctcgcccagggaaaatacttgtacatgggggcatgtcactcggtttggaactctcttgtgactcagactgatcaccatgagagggagttgcctgtgcacgacagggaggttgtcacctctacttctgtgttgtccttaccaagtattgagctttcctttgacactaacacaatgcttctgccatag

SEQ ID NO: 11095 - DNA, 399 bp, Glycine max
  Peptide Sequence Number=SeqID_102780
atgcgtagtcctcgtgccacatgcatcaaaggacgcatacaaacaacaaagaaagagagacgagaatcaagcctctcaaagaagcagttgtggccccttaagcggaaatctctccaagtttgggctcacattcgtgatttggctcctttccgtaggcgtttcacttctttgcaacgcattactgactctttaattaggggcagatccacatcaggtgttcaaggaaaatttcgttgcctagctataacaattacaatctactacatctggttgtctaggaacaagctgatttttgaagattatcaattttctgtaatagagacaagcgcacctgttgcatttgttttagcatcttcatctaggccttcttgtattagggaggtttttgcttttctctag

SEQ ID NO: 11096 - DNA, 243 bp, Glycine max
  Peptide Sequence Number=SeqID_102781
atggatgaccatgattgtctccgcatgacgacagactttgatagtcttggaaaagtaaaggaagcagatgaccatgattgtctccacatgacgacagactttgatagtcttgaaaaatcttggtcaaaagacattggagtctttgaaaaggaggcaaatgaccttgattgtctctgcaagccaatggacttgatagtctctgaggcaaagaagactgtgatagtcttggtcaaaagacattga

SEQ ID NO: 11097 - DNA, 294 bp, Glycine max
  Peptide Sequence Number=SeqID_102782
atggaaggagttcaacctttccatattaagcccactaaggaacctagctatcctttggagcttgtccataagctctctttcatagtaggagggaatgtgcctcttcctaagggaactcttaagatcatttcaatactctactggagggtccccatgaatccttcgtgctctaacaagggaagtccaccaatagagggcatacccttgaaagctaagggtagccaatggaacttttctctctttgctaatatgatggcaagcaaagaattgttcaaccttcatttttcaatctaa

SEQ ID NO: 11098 - DNA, 918 bp, Glycine max
  Peptide Sequence Number=SeqID_102783
atgggttttggaaaagttagatcaaaagtggcaaggcgagcaaaagggttggtcatgcacatgattgctcatgacctctatgctccgagtgatagtgcatgtgcttttggtgtggatctggtgtcctttgatcaagccatcgccactgcagatttcatctccctctacatgccactcactccaactactaacaagatctttaatgaaaacacttttgcaaagatgaataagggtgtttgcattatcaacgttgcaagagaaggtgttattgacgaagatgcattagtaagagcactcgacagtggaaccattgctcaggggggacttttagaaactactgttaatgcttctattaaggagttattattgttgttcttcgccttcttgttctttggttatatgagtctggcggagatcatttctgatgtgctaacaaagctaaggactatcaattccaacttggagaaggaaaacaccgagaatgaggaagacaagaaggaaaagtcttttgagaacacagaaaaggttgaagttgttgctgctattatccaaaatacaccagaagttgaagttggtgaaaggacccatgttgagtctatgaaggattctacgttcaacattgaaaacctacaatatctctttaactcttccatctttgacacttctgttaagattgcctatggccttggtcccatacatgaaccttttaatgttcgggaagaggtctcacctgttcatatttcctctccttcacctattgttggaccttcttcaaggactaatgagttctttcagaggttccttcaccttgaggagtggatctctgacaaggctagaccttccttgatccctaaagttgcccctatgcagcataaacctccaccaccaccaatattaccaccatgccttcatctttag

SEQ ID NO: 11099 - DNA, 249 bp, Glycine max
  Peptide Sequence Number=SeqID_102784
atgggttccatcagagggatcaagaagaggaagaaagctgacaacaaagatggcccagatgcctctgcaacctcattcgattggtggcatcacttctccctcagaatctcagtttgcaatgttaaagtagacgacagaggccgtatcattcaattttcagaaaaaacaaaggatattgggatcccagtaattatgcattttcaaattggaaagcatattggtggtatactatctttccgacccccatag

SEQ ID NO: 11100 - DNA, 1137 bp, Glycine max
  Peptide Sequence Number=SeqID_102785
atggagagaaaagaaaaaggaaaaaagaggatagaaataaatcaagatgagagggaacaaacaagggaagaagaaagaaggaaaatactaaaagaattaagaaaagaaaagcatgcctcctatagtagtcatgacccttgcaagagcctaagtgaagaacttcgtgactattatgaaggaaggcataggtcacatcttagacctcactcccataggatagaaaaggaaagaaagcctcaagtggctaacattaacctctcatacttccatgggaagggcaatgtagaggcttacttagattgggaaataagggtagagcaacatcataaaaggaagtctacttcaaaatcttatggctctcactcttatccaaagaaagaccaaggtcaaggcatcttaggggtgactccttctaagcccaaagatgataaggggaagacaatagaaaaacaaccccttaaggctagtatgcaagagaagactagctctataaagtgctttaaatgtcttggaagaggacacattacttctcaatgccccaccaagaacaccatgactatgaagggccaaggcatttatagtagtcaagatgatgctattacttcaccttcctctagtgaaagtgaagaaacaaaaatggaagaatctagtgaagaaatctacccccaagaagaaggacaacctttaatggttaaagaggagtgtaaggaggtaagtgtcccctccaagagattagctaagaaggaaattcattttgcaataaagacaaacattaaagaaacttcccctcttagacaacctccacatcttctcctttgtaaaaagacacttattagcattgccacacctcttaggcttgagattattcctcaagtaaatgagttgttggataggggtttggttcgtattacgaggcaccaaattcctatgataggtagtatgatgaatgtgttgagtggtgcaaccttcttttgtaaaatcacccatgcatccaacatcttcatgattcacatacatagggactcattaggtgttgaggaaaaaatcccagtgtttcaagaacctctggatttgaggtcaaatccttttcaagggggaagggatgatgcagtcttaccccccaagggcattggatag

SEQ ID NO: 11101 - DNA, 192 bp, Glycine max
  Peptide Sequence Number=SeqID_102786
atgaaggcctgcgatgcaatcctacccccaagagtattggatagaagacttcaagaggattgggctagagatgctaaagaaggccctagggttctcatgaacctcagggaatcttctcaaggaagtttctcaaggaagcttctcaaggagttgagcttagttattagaggggtatgtgtagctaagctctag

SEQ ID NO: 11102 - DNA, 444 bp, Glycine max
  Peptide Sequence Number=SeqID_102787
atgatgacaaaggtgatgacaaaaagctcaaaggtaaatcaaagaatgagttcaaaatgttcaagacggaaccaagaacaattcaagactcaagaggaaaagttgaagaacacttcaagattcaagaggaaagttgaattcaagaatcaagattcaatcattaagcttcaagaatcaagatcaagattcaagattcaagaatcaagagaagacttaatcaagataaggtacatcctttgtggtacaagtagagggtacatctacttgggtttgactgagaacaagagagggtacatctcttgtggatcagttctagtgaagggtacatccactaggttcaaagagaacaagggaaggtacatctcttgtggatctatgcttgtaaaaggatttttacaaggttggaaaagaaatctcaaggaccgcaggtcgcttggggactag

SEQ ID NO: 11103 - DNA, 2853 bp, Glycine max
  Peptide Sequence Number=SeqID_102788
atgccaatcaatatacagccaagtaatggattgttgaaacctgctgaggacatgggatttggtttggagttcagaaagagcagcacaaaacagcatagcagttcaaagacagctaaagaaagttctgtattgccccattcgaaacaaagttggaaggatgctgagaagttgaagtcaaagagtgatctcaaacagaaaggcaagttggatgcagaagggaagattcagaactcagaaactgtgaggagaagggcaactgaaagagatgaacttgtcaagcacatgtctaatttgccaggctatctcctgggtaccgataaagtagaaaactttcaagagaaagctttcaatgttggtgttctagattggtctcggcttgagaagtggaagcataagcagaagcatatcccagtactagttagtagtttcacatcactcaataacagtgaattgtcatcaagaacagctgccaaaccatctatcagtgttggaggcaaggaaaaacttaatgataagaaaagtttgctttcttcaggcataaggtcatcttatagggaatcctttcctgaaagtgccaaacatccttttcatgatgtcaaacgatttgaatcttccaaaactgtaactaagagcataggagatgagaagagcttgacaccccgggcatttgagtactttggaaacaaaactcactcagatatatcacttgaaaaggagaggaggaatggctatagtaaaagaacttcacaagtcaagaattttgcatcaaacgcgaagctccatggcatctcatatcttaatgaaaacggtagggatgatggatctaagcagaacatggaggattggaaagagcataaccataataaaaaagagagaaattataagtccagcgctgatatgggacatccatcattaaaatcaaaaagaaaaggggcatcatccagtcctaagaagatgaattccagctgtagtgaaaccaggaaaaaggtggatcagttgcaggaatcagattttgacattggtcggaaacattaccatatcaagccaagtaatattgtgcttctttgtccagtagaaattccccagtcaagttcttcagaggattttcagctttctgaatcaagaacgtcatcggatgaaaatttttcggaatcaaccaaaagtagtttgtcatatgtttcccttcctgatgaggtttacactccacaatccgggccactgcgttctgcagttgagttttcttctttggaaatgatgcaacacagcattagtactgatctgggtgtagatcgttcttctgttgtgtctgagataccatcttccacaataaataaaatttctagtctgcaatctgcgagcgcttgctttgaaaaggatatgtttgatgctaagctgagagatcagtgtgcttttagtaaattgaaggaatcactggaccaagaaactgctgagctgacagctcagaaggaaatgaatacttcccataaccgtcggtttagcttcagcttaagtcgaattggaagaagtttcagcttcaaagaggggcctacgcttccacaatatagttccatgcatgttagtgcaaagtctggtccggtgacgcctcaatcttctgttcgttgggataatccaagcaaagagaaggccaatagtcatatcagaaaccggtccagccccttgcggaggttgttagaccctttattgaagcacaaggcatcagataaacaccattcagctcaaagggatcagacactagagggaattgcgaattcaagcttcaggactatcggtgtcaatgaatcactgctggctgagaagagccaaggatcatcagttcaaggcctcttgcagcttacaataaaaaatggagtgcctttgttgaaatttgtgctcaacaatgaaagaaagatttttgctgctaccaggaatagtttagcatcactggagaagggtgatttaggcagctgttttacattctacctggttaatgaaattaagaaaaagagtggtggatggataagccatggaaacaaagaaaaaagctgtggctatgcctacaatgttattgctcagatgaagttttctagctgtaaaatcaccgaaccaaccaatcagaactccaatagaaagtgtatggttaaagaatatgttctggtgggtgttgaaatcagccagacggatcaaggaccaccgaagttcatccagagcatggagcttgcagctgttgttgttgagacctcatgtgaaaagagcactgtaggactggatgatgataataacatgctgaagaaaggatgctcaaagtgcttgacggatgaaagatgcttgtgcagttcaggagacaatgatgcctctgattgcactacagttgtacttccaggtggtgtgcatggttcaccaaacaaaggtgaacctacacctttgatctatcgatggaaaaccgggggatcatgtgattgcgggggttgggacattggttgcagactgcttgtgctctccaaccagaaccagaattcaagtattgcaaagagctataaaccttacaatgatcgttttcaactttttgttaaggaaggagctgagcaagaaaaaccacttttcactttgttgccactgaaggatggtttctactcggttgaattcgactcaacaatcactcatttacaggcatttttcatttcagttgcggctttaagctgccagaaactaccaggttccttggaaattggtaacatgcatgaagagatccttaaccttaaggaacccagttccaagaacaacagaaaacttcaggggaaagcacctttaaaatatgctccaatgcctccactatcccctgtcggcagagtttaa

SEQ ID NO: 11104 - DNA, 159 bp, Glycine max
  Peptide Sequence Number=SeqID_102789
atggaaaaacaagggatcttaacagtggaagtagatcaggtggcaaggagcatgaaggagatgacgatgactatggatgaaaagcaagctgagcaatcaaagtctaatggagaaccccctcaagatcttaattctaatgttgacattaatgagtattga

SEQ ID NO: 11105 - DNA, 390 bp, Glycine max
  Peptide Sequence Number=SeqID_102790
atgacggacaaaagaaaagttttaggaaaaaataatgaggaaacaagaagttattttacatggaatttggagatggaacgtgtactggctgatgtacttagagatcaaaggaatttgagcaataagggtgacggaggttggaaaaggtcagcattgaatgatgcagccgcagtgttgtttacaagcttcaatgttaatgtcacatcagataatgtcaaaaaccgtatcaaattatggagatcatgtgacatccttggagagagtggatttgattgggatagcactaagcacatgatcacaattgagaatgaaaatgcttggaatgaatattgcacttcgcataaatcgactaaacccgttttgattcaaggtgcttcgaaattgggatga

SEQ ID NO: 11106 - DNA, 405 bp, Glycine max
  Peptide Sequence Number=SeqID_102791
atggctaatgatagaggtctaaaagatgatggggagcaatcatgcacaactaacaaaaaaggatctatttctcatcagccttatgcaagggaggatgaagctagactagagctagaatttgaagtgaagtccaaggttctaaaacaaatggactacattgaagcaaatgaagaaggaggtggctggattgaaaagcctaaggaaggtgaaggtacaataatagcagcaacagttgaagaaaaactgatgaatccttttgagctgatgatgatggctaagatggatgagctcaagaggatgcacaaaaaagactatggggagatgaaggagtcttttgaaacaatttcaaagaggttggatgctatgagagcaactcatgtggatgatctattattcttcccttag

SEQ ID NO: 11107 - DNA, 256 bp, Glycine max
  Peptide Sequence Number=SeqID_102792
aagtgctaaagttgatgtctcgctaagcgagctcaatgcgcttagcgagtgtcatccactaagcgagacatcaacgcgcttagcggataggaggaatctagaagggaatctgtcacataggcacgtgctcagcgcgtcatcagcgagtcatttgtcaccttccaggcttagcgtgagtttggcgctaagcgaaacttcacttactcgcgctaagcgtgacgttgagtttagtgagccctttttaagcctggaataa

SEQ ID NO: 11108 - DNA, 252 bp, Glycine max
  Peptide Sequence Number=SeqID_102793
atggtagccatcgatgctctctacactcaacactacaaaattgacgttgtagtgcttgctccaggccaaaccgttgatgtcctctttagcataaatcaacctgtgggttcttattacatggcattcactccgtaccattctgccccacgcatccgaagacaactgtttgggcatatttggtctccggtggtgtacgagcattgttcaagagtatacggtgaagttgggtcgcttttcgtcgctagagaataa

SEQ ID NO: 11109 - DNA, 48 bp, Glycine max
  Peptide Sequence Number=SeqID_102794
atgggttgtctcttggagaatcttgagcacaaggatgaggatcccaag

SEQ ID NO: 11110 - DNA, 405 bp, Glycine max
  Peptide Sequence Number=SeqID_102795
atggctgatatgttcttccttttgaaacagcaaaatagtttagagattttgagcggtaagaaagaaatgactccgaatagagttgtgaactggccattcaggactttatatttaattatgagtcatcctgccctttgtgaacttctgaacgtagaggatcaaaagatatttaagtatttgggttctcttgatgttgaagattataaagatgtcaaatcaggctactcaatcacctttaatttcaatcccaatccctattttcataatacaaagcttacaaagacttttaccttccttgaagaaggaacaacaaagataactgttacccccataaaatggaaagagggcaaggattacccaatggacttgatcatgacaagaatgggaacaagtaggtcgtattga

SEQ ID NO: 11111 - DNA, 678 bp, Glycine max
  Peptide Sequence Number=SeqID_102796
atgactgtgatgactcctgctcccattgaccagcagcaggaggatgaggagatgcttgtcccgcacacgaatttggctgagaataatcaccaacccatggaagggccaggtgctgtaaactttatcatagatcatggagagttggattttgtgtttgtccaagataggaaggttatccatcttttgaatcctgattgtaaatctactcaacgactcaaagaggaagagaaagataaggccatcagcattggagttaagccatatttatgggaagttaatgaagttgtcgcactccatgatccagatcacatgactttagaatttctttctcatgcagatgggagggaggcagtggccaaagcagctaacttgatttttgtggagaacttgaaacaacataaactgggtggagaactagatcttcaaatcttgttagaacctcaattgaatgaagcattgcaaattgttggtagcaaaggtcctgagcctgaccttttacttgtttatggacctgtgaggagccatcttggttttcctgcatggagacttcgttacacagagatcattttaaatctcaagtggttggtaaatatatttggatccgatttaccttcttcctatttgctctatattcctcctgttatattttctttctccagcagtcaatctgtggtatag

SEQ ID NO: 11112 - DNA, 225 bp, Glycine max
  Peptide Sequence Number=SeqID_102797
atgattttgctgagagtggtacctggagatatgtcgcgggggtcaggagaccttggggacgtcaggtggggtgctattgcccaaaaccaagcttggccaatcccgacccaacccgagcatagtcaatcaatgagaacctgtgacatacctaagcaggcgagctcttggcagtcaaccaataaaagaacaaagtccacgaagcaaggaggcctatgtggcggctag

SEQ ID NO: 11113 - DNA, 693 bp, Glycine max
  Peptide Sequence Number=SeqID_102798
atggatcaacaatgggtcgaggtaatgattcacatgcttaggcaaggcatacaaaaggctgtggatatttacaatacttttcagagtccaccctcacccaatgtcgaggtgataaacacaaagtatgtagtggttcctcaatcaaggctttgtaatgaaactcctccaagtgtttctattgtcaacactaatgcagaaactggaaacttgtccacccatgatttatgtaaacctcgtggtagaccacccgacaggaaacttcgtgtccaaggtcaaaacacattgttgccatcaagtaatacaatcaataataaagtaatttctcggcccccttctccaattcaatcatcatatgggaattttgcccccaacaaatcacagactcaaggatctattgttacccaatgctcatatgtatcccatcctaagatttctcttgttgcaacatgtaatggggaggctagtccctcttgttgcaatgtaattcaaaccaagagagttatggttagtcctacaaatcaaatgtcctatacagagagtagtcgtagcatttctcctgttaatactgattcagacatggcaagtaagaggaatcgtgtaagggataggctggatgcctctgataagcataaaagcttggacaaatctgatattgaatgttcagactgggagaaaattcatcttactcagtga

SEQ ID NO: 11114 - DNA, 399 bp, Glycine max
  Peptide Sequence Number=SeqID_102799
atggtcattgatgttgctatatggaaggaagtagttggtctggacatgggtggagtccgcaagttcaatgaaatgtctgatggatacaacaagatgcagacctataggagaatgcttcttgacccagctaggaacttgaggaatcagttaggagttggtggattggctgtagaagacaaaatgttggttaaccttgttacctacattctcactcagagattcatcgactacttcaatgttgatgtctctaatgagattgtcaactttaccaaagcatctagtgagattaccgaatggcatctcaagaagataggaatgaggtttattgatcatgaatggataatggctggagagccaatagctagattctttgaccagatggaagatgttaaagcttaa

SEQ ID NO: 11115 - DNA, 150 bp, Glycine max
  Peptide Sequence Number=SeqID_102800
gtcgactctaaacatccccgtagtgaggatgatgaagacccactccctaatgttgattctccagaggatattatgtcagcatctgaggcagactctacagaggagagtggccctggagggacaacgaatagtgacgactcttcatcgtag

SEQ ID NO: 11116 - DNA, 366 bp, Glycine max
  Peptide Sequence Number=SeqID_102801
atgactcttggggatccaaagtactgggatgaccctcttgagtttaggcctgaaaggtttcttagcaatgataatgagagtggaaaaatgggtcaacttagagtcaggggacaacattatcaacttttgccttttgggagtggaagaaaagggtgtcctggagcttcactagcactaaaggttgctcacaccacccttgctactatgattcaatgctttgaattgaaggctgaagaaaaaggagggtattgtggttctgttgacatggaagagggaccttcatttattctttcaagagttgaacccctgatttgtgtcccaaaatcaagattcatgcaattccctttgtatcatgctaaatactag

SEQ ID NO: 11117 - DNA, 189 bp, Glycine max
  Peptide Sequence Number=SeqID_102802
atggttgttgggggaggattggagctttctagaggggtcttgcatctgaggccagactgtatgctaaccattactggaaaagaggtcgtggggtgggctccacgatctcgcatgtcggactgtgagaaccctttgttaggaggacaagaagagggacctgcaaaacaaaggactctcatgctaaagtaa

SEQ ID NO: 11118 - DNA, 315 bp, Glycine max
  Peptide Sequence Number=SeqID_102803
gtgcagaagacgacgttagtctctgcgtgctactggactctgagtctgacggatagcaaaagagtgtgtgcgggttaccgtatagggcgtctccgcgtgccaacgagctcacaagtcacgatagcgaaaggtggggcggtcgataaaagtggggcttttgctcctatgtatccttcatcggcgagaaagtcgatagcgcacaagatcttggttggcgatcaaagggagaggaccactgcaagtcgtggcaaggtttatggtgagttgggattttggctcaaggcttgtagaatggctggacatgatatatgttag

SEQ ID NO: 11119 - DNA, 743 bp, Glycine max
  Peptide Sequence Number=SeqID_102804
atgttagccatcatcagcaagtaccaagaagaattaaatttagccaccgcccacgagcacaaagtggtggacgaatatgcccaggtgtacgcagaaaaggaggctagaggaagggtgattgactcgttacatcaagaagcaacgatgtggatggaccggttttctcttactttgaacgggagtcaagaacttccccgattgctggccaaggccaaagcaatggcagacgcctactccacccccgaggagatccatgggctcctcagctattgtgacctagaggaagtacaggaacagatgaaagtcgacatgtcggctttgaaagaacaaatggcttccatgatggatgccatgctgggaatgaaagaactaatggagagtaatacggccaccaccgccactgttagaaattacccctatggtttaccacctaattacacaccaccagtcatacatgacgacgcgggtcacgttcctcccctcatcctcgaaggggagcctcctcgacatcctgacgtagtccacgaggatcatcgagagcatgctcagggaggcgtcgactcctactccccgcttcctgccgagggatcggcgcccaacgcactacttcaacccaacatcatgggagaacctcgaaaccacccaatgcagccaatgtttctgtccgcgagagggccaccccgggtagcggaaggaaaagggaaactcgatctcattgaagaaagattgagggcggttgaagg

SEQ ID NO: 11120 - DNA, 504 bp, Glycine max
  Peptide Sequence Number=SeqID_102805
atggcggcttgtggtggccaccgatggtcatgggtggtggaaaaggagtttctagcgcaacatttcatgctgagggcaattcctctcaagttggaatttgcactgagcgcgacattttgtgctgaatgcaatttgtctcgagttagaattgcgcttaatgcgcttgtctcactaagagagattcccagaagtgttattttgcacatcccaatggtttatactggagatcaaactctaatagttctacggtccatgctgtcatccttcctaccagctcaggctttcactacacctgttgatagggtagttcatcttgactaccacttggtgactttgaaaatgggaagttggtgtttctcatcctcctacacgagggttgagctgacaaccttgtcagctactgagaggattggtggcgtggcaatagttttcttaaaggctaagaaagcttgcttgcaagcttcatcccatgaaaatggcttaattttcctaagtaacttgtag

SEQ ID NO: 11121 - DNA, 257 bp, Glycine max
  Peptide Sequence Number=SeqID_102806
ctatctctagaatatgtccattggatttaatgatgaaatatgtgcaatttcagttgagcttagctcatcagtgggctaagcgtgcatccaccactaagcgtagcttcagtgcacttagtgctacagaagaatctggcagagcatcaatatcaaggccgcgcgataagcgcgagatcagtgcgctaagcacaacagttgtcttcagccaggctcagcgcacgactggcgctaagctcaaatccacttactcgcgctaa

SEQ ID NO: 11122 - DNA, 1305 bp, Glycine max
  Peptide Sequence Number=SeqID_102807
atggtgtcgatttctttggtcactcctattgtggctcctacctccacaattgttacgcctttacttagcgctggtgtgacggccacgataaaagtgttggcatcggtttcccccttagctgtgttggcattaacatcatcttcctcctcttttgaccccaatgtgggatataggctagagcagagaactccaactatccttgtgtcttcttttgacaagaatcttattcaattagtcagggaagctctaagcaaggtggcattcttagaggctgaggttgccaagtggagggccactactcagactgtttggagaatggagcgtcctaaggtggccaacgccactgtcaccttcgttgaggtcgtcaggtctaactgccagttgtcgtccaagtttagcgatgtccttgccaagttgctatgcaccaaactggatggaggcgagatgtttgggccctacaaggacttgctaaaggagaagaatgacttggctggaaaagtggataacactgttgccgaaaaggaagagctagccaaggtggttgctgaccttgaggcccgattgaaggagtcagagtccaggttggaagagtccgagcttagggtatccaaggagagggagaccaacaaagagttaaaggatgaactgctgatgttcaagaaggaagttgcggaacatcacaaaaagggtttttacaaggccgacatgaaagacagtggactgcttgacaaagaggaaatagttgttgtggaagaggatgctggtcttgctgaccagttgggtggtatctcattttgccttgtggtacctcttattcgaggacaagaatgcttaccaagggcggaccttgggttccttgcattcctacgaacttgtattcctgcaaagataaagttttggaatagaagagcttgtcaagaatggaccttgcataccttggattttcacgaaggcgagacttggcaacggagaggctcaccaagggcgaaccttggggcggactttgggtttgtcaagcctttggagatacgagactcacacacagcggaccttgggtttaacgagcctttggagaagcaaggctcaccaaggatggaccttgggtttcatgagcctttggagaagcaaggctcaccaaggatagaccttaggtttaatgagcctttggagaagcgagactcaccaagggtagaccttgggtttgacaagcctttggagaagcgagacgcaccaagggtgaaccttaggacgaaccttaggtttgacaagcctttggagaagcgaacaaggacacgtccatcctag

SEQ ID NO: 11123 - DNA, 276 bp, Glycine max
  Peptide Sequence Number=SeqID_102808
atgacgactaataagaacttgatagctcctgggcctttcagcaatggtcccagtatgtctatcccccacatggcgaaaggccaaaaggagctcaagctatggaggcccttcaaggatgatacctacctcgcttcctttgatgttaggcacaccatccacatacaaattccaccagtcaaaggtggcttaggcattggcaacaaactccgctatgaagtctgctatgaacttggtcatcataggaccttatgtttcatattggatgtcaaattctga

SEQ ID NO: 11124 - DNA, 1503 bp, Glycine max
  Peptide Sequence Number=SeqID_102809
gtttcgcttctcggaacgggcgttgagatgaacgggaaaagcttcaagagcatcgagaacgggcaattgatactgcagcggttcaaggaggattgggcctcggcccagagggttgtctccgaggccaggaccggaaccgaaacctccatgcccaaacgcgtcctcgagaggttaacgactccagaaatatggatgaagccaaacagtgacaaatattacaaatgcgtttctcgacccaggaatgtaataaggctaaaaaagacaaatggctatcttcttgttcatgcaaatggtggattgaatcaaatgagaactgggatatgtgatatggttgcagtggcaaaaataatgaatgccacccttgtgcttccctctcttgaccatgattcattttggactgatccaagtgactttaaagatatctttgactggaggcacttcatgaaagttttgaaagacgacattgagatagttgagtacttgccggtccaatatgcatcattgaaacctcttgtgaaggcccctgtttcctggtcaaaggctagttactacagaggtgagattcttccattgttgaagcgacataaggttgtacagtttactcacacagattcccggctcgccaacaatggccttgcttcctctatgcagaagctgaggtgccgtgccaattaccatgctctcaagtacacagcagaaattgaagagcttggaagggttttggtgaataggctaagaaacaataatgaaccatacattgcccttcatttaagatatgagaaagatatgctagcctttactggctgcagtcacaatctcactgctgaggaggctgaggagctaagggttatgaggtatgaagtgaagcattggaaggaaaaagagattgatagtgtggatagaagattgcaaggggggtgccctatgtcacctagagaggcagctatttttctcaaggccatggggtacccttccactacaacaatctacattgttgcaggacctatttatggtgccaatagtttggaaggctttcaatctgagttccctaatgtcttttctcattctacccttgcaactgaggaggagctagaacccttcaagccatatcaaaaccgtctcgctgctttggattatatagtggccctggaaagtgatgtctttgtgtatacctatgatggtaacatggccaaggcagtgcagggtcataggaggtttgaagggtttcagaaaaccatcaatcctgacagatcgaattttgttaagctgattgatcaattcgacaagggtgccttatcttgggaagcatttgctactgaggttaagaattcacattccaataggctaggcgcaccttatcttagacaagtaggagagtcaccgagaacggaggagaatttttacgccaatccctttcctgattgtgtgtgcaacaagtctcaggaggaaatcacaagccagaaactagaccatcatcggtttggtattggagcacaaagatag

SEQ ID NO: 11125 - DNA, 447 bp, Glycine max
  Peptide Sequence Number=SeqID_102810
atggttttaaaaactgtcgtcaaatactgtgttcaacgatggttatttgaaaaactcatggttggcgcgctcatcttactcactcatcttccagtaattgtcatcacgctcgtgccttcactcactcaccctctgctcgtgctcgtgcccttactcactcaccgacgacgacgacgctttagtctgttcactgcgacgatgcttcaatcttgttccttgcgatggtgcttcactctccttcgtgcgtgccctcgcggtgacttcactctgcttcactggaactcgcattctccgtcaaacgacaaaacaaggcattcaggggacttcttagccgtgtcgaagattcaggataggtggggagggtttgagacgttaaaaaagtgggtgactggttcttttgctagttatactgctatttgcttgaaggatgaattggggatcctctag

SEQ ID NO: 11126 - DNA, 228 bp, Glycine max
  Peptide Sequence Number=SeqID_102811
atgtggctactgaatctgtcaactgctagagaagaaggaaggtatcttttgtcagaaaatgatgggaaagaggaagaactcacaacaaagtataactcaaaacctaagaagcacggacgcggctcatcaccagcatgtcccacgtcaaactcgcaccaggcatgcatgcggttacgactccggtgcgacgtggtgtctgtcgcctccgccgtcaccggacacggttga

SEQ ID NO: 11127 - DNA, 345 bp, Glycine max
  Peptide Sequence Number=SeqID_102812
atggcccaagcctcttccattgagagggacactttaaaggcctcctccggaaattccatcagaagtcttgaagaaatccatataagatggataccacccattcctccttggcacaaagttaatgttgatggtccttacagaaaagcctcctcatctgcggcctgtagaggcctgattagagatcacatagggaggtttatcaaagggttctcaaccaacttgggctgttgtaatgctctttgggctaagttgtgggctttgtacaaagatgatgttcccctgctatgttgtctttattgtcagaggacgttacacgggttgttttttcgcgttgtagtgttgtag

SEQ ID NO: 11128 - DNA, 818 bp, Glycine max
  Peptide Sequence Number=SeqID_102813
atggcccgcaccaagaaaactggccaaatgacatctcaggcaccaaaggaaatttctgtcgagattgattccttggaggagcaggccttacagggttcctttgttgcccatggtcgtcaagatgtattgactgctgccattggccggtgtcacgatcaaacaatactttggaccgactccaaggacctcttgcacgtcttagtccatggctcctggagacctagagcagctaactctcagtttcaattacaaatgcaatcacagggactcgcattgcctcctgagcctgaggttggtccttcatttgctcatgtaagcacaaaggagagttgtgttgaacccttagggaacgacccagacacagtcaaggttggtgttgaggaagttcgagatgcagatgctcgcattccagtacccactcaagaggttcagttagtggggcaaacacttaacatcttccttgcttggccgacacatcttgtcaagcgttactcagaacaagttatgtgggatgctaccgtgtttgggatgtttaatgacaacttccccctgtacataaagcatgaagatctgtctgaaatagcacacaatggccttgaattcggtaatgcacaaggagaggagataggaagaggaagatggagaaaagagggaagcaaagacccatcatttgtagaggaagttcccttgagtgttctcgtagataaagtaaaaaagaaaggttcactttgcagagacagtgaaggactttgtaccttgggtttcttgaaatttgcccatggtctctattgctacagtgaggaaggattgaaagaagg

SEQ ID NO: 11129 - DNA, 591 bp, Glycine max
  Peptide Sequence Number=SeqID_102814
atggttgagaaacattcaagtacacgtttacgtgcaatgaaaattagaaattccgtagacactcagaagaagttaccttgtcaagctatcaaagtacctattactaaccaaatagtgaaaaataggattgagaaatgtggcagaattggattgattgagaataatgaagaggattcaaactttttgagaccaagggatgctcagaagagttttcaaaagtccaagatgctcgcaatcagaaaagaagcaaccacgtacctcaacggatgctcacaagatttttcagaagtccaagtaatgctcaaaatgagaaaagaaacaaccatgtaccttaatcgccgatgtcagactccaaaggatgctcgaactcgcggtggtgatgaagcccaactctttgagcagttgcaggttgcaaactgcagtgttgtaaatggcgacaaggaaggtcttgttggtgatgttgttgatgtagacaaagaggcaagggacaagagggtgtgcgacagagtcaaggtggcagcccaggtagaggtagcaacgtcgagggcaacatcgccaaaggaagaagggaaagggaggagggcaatttaa

SEQ ID NO: 11130 - DNA, 243 bp, Glycine max
  Peptide Sequence Number=SeqID_102815
atgcctggtcaaggccttgtgccactgcctcctctcgagctccttgcggaactcgtcgtactccgtaacaaacaaattaatgttcctctccggaagaatgttccgaaagtgaacgttctgctcatagcgcttccaagcgaccttggaaataaatctagtagtattatatggttctcgaggttagaaggcaattgctttcctcttcctagaggccatctgcatcaaaagaatcacaggaattga

SEQ ID NO: 11131 - DNA, 218 bp, Glycine max
  Peptide Sequence Number=SeqID_102816
ttgtcatcatgaaaaagggagagattgtaaaagcaaagcttcatgatgaatcaagattgattcaaagatgttttgatgataacaaagatgatgacaaaaaaggtcaatcaaagaatgagttcaagatgttcaagatagaatcaagaacacttcaagattcaagaggaaagttgaagaacacttcaagattcaagaggaaagttgatttcaagatttaa

SEQ ID NO: 11132 - DNA, 282 bp, Glycine max
  Peptide Sequence Number=SeqID_102817
atggtggacaagcgacgatgcggtggcaacaagagagtagcgatgcatagtaaaggtagtgcttatgagatctacaaaggtagaaagccaaatatatcacatctcaaggtcttttgttgtaagtgctttgtgttaaataatggtaaagaatctcttagccagtttaatgccatggttgatgcagggagtccaagagaagcttctccaaggagtaaagaggtggtgagcaataaacctcaagaaggaccctcatcacaacacaactttcttcctaaggaatga

SEQ ID NO: 11133 - DNA, 534 bp, Glycine max
  Peptide Sequence Number=SeqID_102818
atgaaatctaagaaggagaaggggtctgcaaagggtggctcttcaaacaagggcaaacaaacaacacgttctccctcaccaccaccctctacaaaggctactccttggtttttagaggagcactacgaggtttcctacaagtacaactatgtaaaggagtttattaaaccaatgtttttgaacttggaatggttgaagactcaatggttaatctttcctaaacttcttgagtaccatggtttgaataagctagtggagatgaagggtactttctacttggagttggtaaaagttttctacactactacccatattgatggtgagactggatatttgtatgctaaagtgaaagggaagacgattgtaacaacccctgagattattactcctaaggggattaatcatgcacaactgacagaggaggatcttcttctcatctacctaatgcaggggaagatgaagcttaattgggtcagtgttgtggtggataatatgatgaataccaagaggattggatccttcaagtgtccttag

SEQ ID NO: 11134 - DNA, 364 bp, Glycine max
  Peptide Sequence Number=SeqID_102819
atgactaggggcaatccaggtgatttacaaccctttgatcctgaaatagatagaacctttcatagattagttagacatagtgtgcatcctgatcattctatgcatttcgagcattgtgagcattttgagcattctgagtattctattgctaatgattctgaatattctgattttaagcattcgactactaattttcacactgagaacatggctcaacctccacctcatgagaggactcttagggaaatggctgcacctgatttcacttatgaaagcttgtgcattcaatatcctgatgagggtgttccatatgttctcaagactagactaatacatttgttgcccaagtttcatggtcttgcag

SEQ ID NO: 11135 - DNA, 129 bp, Glycine max
  Peptide Sequence Number=SeqID_102820
atggaagaagcaaatgaggtgtgcaagaagcaaacaagggattccgatgttagagacttcaagctcttgattgcccagtggattctcaagaggggcttccatgtacagaggagtaacaaggtctcatag

SEQ ID NO: 11136 - DNA, 375 bp, Glycine max
  Peptide Sequence Number=SeqID_102821
atggtggtggtggtggtgataatgacaatgaaggtgacattgatgatggtggtgatgatagcaatgttgatggtgatggtgatgtcggtggtgacgatggtggcaatgacagtagaggtggtggtagtggtgttggtggtggcaccaagtggtggtgttggtggtaacaatgctagtagtgatggtgatggtgatggtggtgctagcggtgtagatggtcatggtgggggcgatggcgatggcgatgactgtagtgacaacaaaaagtatcatatgtcaaacatgggaaatgaaacttatatgacaatatttatgatcaacaaacaaattcagtcattctcaggattaataattctcaagaatgataactcctag

SEQ ID NO: 11137 - DNA, 335 bp, Glycine max
  Peptide Sequence Number=SeqID_102822
atggcgcttagcgcctccatccccgctaagccctgtggaagcaaagcttccaagcttattgtgatgatgccaaagactcaagtcaagaatcatgattcaagcaagtcttattggttgagcactaaacacaagggaccaacattccttgggttcattgcaagaagcaagatttgcttcttggttgatcactggacacaaaagaccaacgtctttgggttcattgcaagaagtgggtacaacttcttggttgttattactggacacaagggaccaacgttccttggggattttacaaggatagtggaaatctcaagcgggttgcttggggattggac

SEQ ID NO: 11138 - DNA, 201 bp, Glycine max
  Peptide Sequence Number=SeqID_102823
atggcaggcggagacacccaagtgattatcctagcacactcattcgctatccgtcagactcagagtccggacaaaagcgagtccgatgacatgcggagatacacgactggttatccgcataaacgatttctgttaatcctgacccgtgaagtcagatggcaggcagtgactgatgtgccatcattttcttctattttctaa

SEQ ID NO: 11139 - DNA, 240 bp, Glycine max
  Peptide Sequence Number=SeqID_102824
atgaagtcaggtggcaggcggagacacctaagtggttatccgtacaaaggatttctgttaatcctgacccgtgaagtcaggtggcaggcggagaaacctaagtggcggagaaacctaagtggttatccgtacaaacggtttcttttaatcctgacccgtgaagtcagatggcaggcggatatatccaagttattatccgagaagactcatttgctatccgtcctactcagagtccggtag

SEQ ID NO: 11140 - DNA, 597 bp, Glycine max
  Peptide Sequence Number=SeqID_102825
atggccccgaggaagcttgcctcaaagaggtccaggaaggataaggcggccgaaggaactagttccgctcctgactcagatatggactcagatatcccttttcaagattttgcccggactactgcagggaggcgagtgcggatcatgcgcaccaacatgaccaccctgactcagatatggatgactttgctgctcagcaacatcctgcccaccgatcataattccgacctccccctaccgaagtgtcagctggtgtacgccatcctgacgcggatgagcgtccatgtggctcagttgatcgctgatgccatctatatttttgcaggtatggcgcctactaggcaccctttggatccagataagtccaaaagggccctgggatttccctcgctgatcacaagactctgccagtcgtttggagtccccgttgcccctaccaaggtaattcggccgcccatcacccgggcttttattgagaagtactatacccagagacaggctcagggtgatgctccacaggccgcaggcgcgccaccaccacctcatcaggctggccaggctgggtcatttgacatggagcagtatttacggcatttg

SEQ ID NO: 11141 - DNA, 614 bp, Glycine max
  Peptide Sequence Number=SeqID_102826
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaaggagagtccggagccttcccaaaatatcttgatgatgccaaccatttctgatgttagcactgttgaggaatggagactagtggctggagacattgctcaacggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11142 - DNA, 135 bp, Glycine max
  Peptide Sequence Number=SeqID_102827
atgacggagaagattcatctcttctttcgaagattatggaaaggtttgatggtcttcaaacctttgttggtgaaagatgtatcttacattcgctcaagcttcgatcttccaccaccgccaccaccatcatcttag

SEQ ID NO: 11143 - DNA, 462 bp, Glycine max
  Peptide Sequence Number=SeqID_102828
atgaagcacttcactgacaccctcatcagtgccaacatagttgaggaaagtagccttcggacgcatcttatgcaaatcatgcaagctttggggatgagcaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11144 - DNA, 462 bp, Glycine max
  Peptide Sequence Number=SeqID_102829
atggcataccatgctagctctaaagccgatcaaacttcaatgataaatcaggaacttcaatttggcaagagctactccatagaagattaccaagggggactcaagttacaaccctacaatcaaaatgaagcagaaagaggttccaatctggataatttgttgatgcaattcaaggaaacaactgaatcaactcaacaaacattcaaaagtgcagaaattcaggttggtaagctagcagaagaagtgactcaatttgtggccagaagagaagaagatttggtagaggttgaagctcaagaggaaagccctgtaaaagagcatgaatcaagagaaaaagatgaagagaaaggtgaggaaaaagtgcaacaatggggggagtactcaacagtagaaaatcaacaagaaagtattctccaaatcaatacctttcctcgtcaactgattgtcaaggaagaaaggtag

SEQ ID NO: 11145 - DNA, 707 bp, Glycine max
  Peptide Sequence Number=SeqID_102830
ttcacccgcagattgccgtttttatactcgtcggccaacacctgcatcatgccctcggtggcgaacttcgacaccgcataggcgccccagtctgcgcggccggtgcgcccgacgctggaactggtgaacaccagcgaacccgcgtgggatttcagcagcagcggcagcagcgcctgagtcagcataaaggtggcgttgacgttaacctgcatcacctcttgccacatggtcatcgacaggtcggccatcggcgcgatgtcgccgagcaggccggcgttgtgcagcacgccgtcaaggcgggggatctggcgcgccagatcgtcggctatctgccggcattgctccggcgtggcgtgcagcaagtccagcgtcaccaccaacgccggggcgccgccctgggccgcgatctcttgttgtaccgccagcagcttgctctcggtgcgccccagcagcaccagccgggcaccgaagcgcgcgtaggtcagcgccgcttcgcggccgatgccgtcgccggcgccggtgaccagaatgatacgttgttcgagcagatcttgtttgggttggtaatgcacgataaatcctcgcctgggtggccgttctcccgcagatatcggggagcaagagtgaaacgcgcggccggggcgggagcgaaggctcgaccgtctgcgggccgcgcagcgaatgcgtctcatcatattgatgaataa

SEQ ID NO: 11146 - DNA, 465 bp, Glycine max
  Peptide Sequence Number=SeqID_102831
atgaccatgattacgccaagctcgaaattaaccctcactaaagggaacaaaagctggtaccgggccccccctcgaggtcgacgagttagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11147 - DNA, 516 bp, Glycine max
  Peptide Sequence Number=SeqID_102832
atgaagcacttcactgacaccctcatcagtgccaacatatgtacaatcactttatctataagcttcttcacaaactgctctgcaacatatctccaattagcagcactaaaatatcaaagtacattttactgtaacggtagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11148 - DNA, 459 bp, Glycine max
  Peptide Sequence Number=SeqID_102833
atgttgttttgggtttatcgggataggactgatagagttcacccaagacaacgattccaaccaaagaggactgattttgctacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11149 - DNA, 221 bp, Glycine max
  Peptide Sequence Number=SeqID_102834
gtggccttgttggtgcttgtgcgcttagcgcaactctggctcacttagcgtgcattagtgaatttcggcttagcacgcgtcttttcactcagtggatggactcaagcggtgcgcttagcgggattagcccttgctcaacgaacatgcacaactcatccttcttccagattcttcctcgtgctcagccgcaagagtggtgcactcaacggatggctcactga

SEQ ID NO: 11150 - DNA, 208 bp, Glycine max
  Peptide Sequence Number=SeqID_102835
atggactcggatgttttgtatggacttgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatg

SEQ ID NO: 11151 - DNA, 801 bp, Glycine max
  Peptide Sequence Number=SeqID_102836
tgctggatttatgagcactttccctcggtcgcggagtccactgctgatcaagactacggcgaggcttctccacgtgcgtgcaagtggattgcaacgaagaagaccgtgaagagcattcacacgccatcgtacagggagtgcctggaccggctccagatttttggatgtctgttggttcccttatggggagcatcgggaggtccgggacttccacgtcagatcatgctattccgggctcttgcgctggggggcctgttgctgttttattaccgactggaggaggggcgtgcgacagtttggctacacgcagacccatttcctgctcctcctgtcgattcatgggtctcgtatgatgatatacacgacaggtggatgcactacgaggatcatatcgtacctgcaggtgaggtgtgcgttgtgctaggggcgtgttccagtgactacatcgactggttcttccgcatctcccatcctttcatgacaccaggccacgcattagatcctctgcctcatggtcacgccccgcagcctcgagtcgtccctcaggccccgcagacgaatatccttagcgtgccggagccaggagcatcgtcgacatttgcggaggagtccagacatgcagtggaagtttgtgatgacattgctgagaggttggagcgccatttgagtctaggggtggtcacgcctgactcatcgacatatgaggtgatcgaaaaatgcctcagattggccaggagtgtgacacaggaccatctagtatacgttaggtgtagacgcaggtggcgcactgatcagacttag

SEQ ID NO: 11152 - DNA, 617 bp, Glycine max
  Peptide Sequence Number=SeqID_102837
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctgaaaatgcaatcaacttttcccggttgtggtatatttggtgtggaaatgttctatttagaaacaggggaattgcttattaacgaaattgccccaaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11153 - DNA, 323 bp, Glycine max
  Peptide Sequence Number=SeqID_102838
atggaggttggaggggattggatgaagcacatcgagacaatcatgagtcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11154 - DNA, 388 bp, Glycine max
  Peptide Sequence Number=SeqID_102839
ggccctggggtttccagctctggttacgggcctctatcagtcctatagggtgcccgtacccccccggcaaggttatgtcatcatagggatcgcgcctgcaagacacccagtggacccgaagaagtccaacagggtctcggagttgtcaagctctaattacggcaagggcatcaggccccctactgatcgagctttcatcaagaagtactgcgtccccaggcaggcgcagggtgaaacaccacagcagcattgggatggtcggcagcgggaaatagacgcaccgtcaccacctttagagttcacctctgctcatccacaaaaaaatgaccgacaagtcataaggcgtccagctaaagacgttaaagaagcgctactaggaggcaaccta

SEQ ID NO: 11155 - DNA, 896 bp, Glycine max
  misc_feature (895)..(895): n is a, c, g, or t
  Peptide Sequence Number=SeqID_102840
ggcttctatcgatgaaggaagcagggtctttttcggggtcaataaggtgccgtctaagtcgagagcaatcacgcgtgtggtcatggcgtattccagattaaggttaagaattttcgtctgcgcgaatgttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggaaggccagtgttgggtcatcgacgatgtgcgttacttaggcggtagcgttcatgccacggcgggaatgccgacatttatgctcgccgaccaccgcccccgtactatcttcgacctcaatagctatcagactgccagtatacgagtgtcaatgagtattcaattaaacggcattaattgcttctacggcgcgcatcaggcgctgttcgatatcacgctggattgcccacagggcgaaacgctggtgttacttggccccagcggcgcgggtaaaagctcgctgctgcgtgtactcaatctgcttgagatgccgcgctccggtacgctcaacattgcaggcaaccatttcgatttcaccaaaacaccctctgacaaagcgattcgcgatttgcgtcgtaacgttggcatggtgtttcagcaatacaacctgtggccgcatctgaccgtgcagcaaaacctgattgaagcgccctgccgtgtactggggttgagtaaagatcaggcgctggcccgtgcagaaaaactgctggaacgtctgcgtctcaaaccttatagcgatcgttacccgctgcatctttctggtggtcagcagcagcgtgttgctattgcccgtgcgttgatgatggaaccgcang

SEQ ID NO: 11156 - DNA, 447 bp, Glycine max
  Peptide Sequence Number=SeqID_102841
atgaccatgattacgccaagctcgaaattaaccctcactaaagggaacaaaagctggatttctactaacacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11157 - DNA, 405 bp, Glycine max
  Peptide Sequence Number=SeqID_102842
acgaagctattaggctcagccttttctcattctcattggcaagagaagccaagaggttgctccactcattcaagggtaatagtctgaaaacctgggaagaagttgttgaaaagttcctaaagaaatacttcccagagtccaagactgcggaagggaaagctgcaatctcttcatttcatcagtttcctgatgaatctttgagtgaagcattggagaggttacaggttgtaccatctgtggtgaggctcatgaaacagcccagtgtattcccactgaagaaaacactcaagaaattcattatatgggaaatcaacagcgacaagggtatactcaaggagggttttcaggcttccagcagggtccctataatcaacaaggacagtgaaggacacaccctggcaacca

SEQ ID NO: 11158 - DNA, 208 bp, Glycine max
  Peptide Sequence Number=SeqID_102843
atgacggaagggtgtggtgaagggttttgccttgcaaaccttcccggtgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 11159 - DNA, 439 bp, Glycine max
  Peptide Sequence Number=SeqID_102844
gatttgcattttagacatgttctggacccttccatccttggtgagatgaaaggatctggggtagaaacagttcctcgatggccatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 11160 - DNA, 417 bp, Glycine max
  Peptide Sequence Number=SeqID_102845
atgaccatgattacgccaagctcgaaattaaccctcactaaagggaacaaaagctgcccgggggatccactagttctagagcggccgccaccgcggtggagctccgattcgccctatagtgagtcgtattacaattcactggccgtccatttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11161 - DNA, 66 bp, Glycine max
  Peptide Sequence Number=SeqID_102846
aatttcagctcgtaaatgaacccggaagctctggtccaattcagacggccatcacttttgacatag

SEQ ID NO: 11162 - DNA, 551 bp, Glycine max
  misc_feature (74)..(74): n is a, c, g, or t
  Peptide Sequence Number=SeqID_102847
gtgctccagtggcttctgtttctatcagctgtccttcctgttcagctactgacggggtggtgcgtaacggcaanagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagttaggagattggatcaagttctaaagcttgtagtggaaggggagaccttcgatatgatgagtacttatacacctcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11163 - DNA, 438 bp, Glycine max
  Peptide Sequence Number=SeqID_102848
atgatgccagtatcagccctagccgacaggttgttggttacatcacgtggtggcagtgtgggatatatgagcactttccgtcagttgcggagtgcaatgctgatctggactacgacgaggtgttaccacgtgcgtgtcggtggatttccacaaagaagactctcaagaagatatctacaacaacgtaaaggcagcgcctggatcatctcaggattccagatgtctgctgaatgccatatgcggagcatcgaccaatacagaccacagagggttatacgccagtttggatatgtccaatgcattcctgcacatcctgtcgattcatgggtgtcatttgatgatgtagacgataggtggacgcactactcagaccatccagcgccagcaggtgacatatgtgttgtgccaggtcagtgtgtgcccgactacatcgactga

SEQ ID NO: 11164 - DNA, 498 bp, Glycine max
  Peptide Sequence Number=SeqID_102849
atggctgcgcagttgatccatgatcgcgtggtgatggagtgcctagaggtacatccggaggaacccacacgcacacttcagcagcctgtggagtggatattacctacacctactccatatcgactagtggatccagttcaagtgatagaggtgtcatcctctgaagaggatcttgaagaagacccagaggagttacctcctgaacctgatacggatgcccttgacttacctgaggatgatgaagacccactccctgatgttgattttccagaggatgttatgtcagcatctgaggcagactctacagaggagagtagccctggggggggacagcgaatagtgacgactcttcatcgtagcaaacggctccttagactaggagtacatactttttgtgggtgggtgtatctagtacagactgctaggtttactcttttgatttttgggtgggtagatctattgtatagaaattttgatggttgtatatatcatggctga

SEQ ID NO: 11165 - DNA, 530 bp, Glycine max
  Peptide Sequence Number=SeqID_102850
gagatcctaatggactgccaccttcaagaggcatagaacatcaagttgatctccttcccggagcttcattgcctaacaggccaacttacaacagcaagccccaagagactctgcataaggatgcacaggccaaagttaagtatgtgaaaaaattgtatgacaaagtgaaggtgcaaattgaaaagaagaatgaaagttatgtcaagcaaacccacaagaaaaggaaggaagtggtacttgaacccgaggagaaggacgaaggcccaagtggagaaggacaaagcccccgagtggagaaggatgaaggcccagagagtttctctctgggttccttgttgaaccaatctcagatttatcaagataatccttgtggcgtctatcctgacttatcttccttcactggaagtggcgtcatccaaaactccgtagcctgtatcgaacgatccgctcctagtcaggttcacatcacaaagaaaatggtaacgacaattattgtaacaataacaatgaacaatgtgtttgaattatga

SEQ ID NO: 11166 - DNA, 291 bp, Glycine max
  Peptide Sequence Number=SeqID_102851
atgcagctggcacgacaggtcgacggtatcgataagcttgatcttacacctgatgaaggtgctgaagctgccgtgcgattggcactgctacctgatggtagtccttcggctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11167 - DNA, 128 bp, Glycine max
  Peptide Sequence Number=SeqID_102852
atgcccaaagaagaatgcggaaagaaggactcttttttaccggtcggaagaaagaaagcaactaaaagcttcacagatgaccagtccatttatcatcccaccactcacgccaacgtaggagttggagg

SEQ ID NO: 11168 - DNA, 475 bp, Glycine max
  Peptide Sequence Number=SeqID_102853
gtttgattggctcccgagtttgagaaccgctaaaagggaggaagttgaggcactggaggaaaacgaagaggtgcaggcccttagggcagaaatcgagcaagcccaaacagtcaaagaaaggttcaaatcagcagctcttaaaatccgaaaggagaatgtcgaactaagagatataaatatagctaccaccaaggccttggaacaagaaaccaagagggctcgtagggaagagcacggtcggaacaagttccaaggggctctctggggcagcaacagcgagcttaagctctggagagaggaaagagaccaatcacgagtacatagcatggtcttaaaagaggagttagctgcttgctcaagatccaagaagagtttggcccaacacttagaagccacagagcaaagcatgctagctataatagggcagtacaaagaagagttaaaccagtctttgacccatgagcaaaagctatga

SEQ ID NO: 11169 - DNA, 600 bp, Glycine max
  Peptide Sequence Number=SeqID_102854
atgtcagatatgaaaagcggaaacatatcgatgaaagcgatcttaatcccatttttatctcttctgattccgttaaccccgcaatctgcattcgctcagagtgagccggagctgaagctggaaagtgtggtgattgtcagtcgtcatggtgtgcgtgctccaaccaaggccacgcaactgatgcaggatgtcaccccagacgcatggccaacctggccggtaaaactgggttggctgacaccgcgcggtggtgagctaatcgcctatctcggacattaccaacgccagcgtctggtagccgacggattgctggcgaaaaagggctgcccgcagtctggtcaggtcgcgattattgctgatgtcgacgagcgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaacgtgactgacgcgatcctcagcagggcaggagggtcaattgctgactttaccgggcatcggcaaacggcgtttcgcgaactggaacgg

SEQ ID NO: 11170 - DNA, 342 bp, Glycine max
  Peptide Sequence Number=SeqID_102855
atgactggaaggcttcttgccggttcattggcttttgaaagccgcatcctccattaccttattgttcgcatcttgcttctgagatcttcaaaccttgctcagaaaggtgctcgacatgttggtgaagaaggacatgatggagaggattcatctctcctttcaaagataatggacaggtttgatggtcttcaaacctttgttggtgaaaggtttgacactttggaattacaagtggatatccgcttcaatgaaatggagtcaagaatcacaaaggttgaagaagatgtgtcttacattcgttcaagcttcgatcttccaccaccgccgccaccatcatcttag

SEQ ID NO: 11171 - DNA, 100 bp, Glycine max
  Peptide Sequence Number=SeqID_102856
atgggcccaaaatctaccctaaggctcatgagaaccctaaggccttctcttgcatctctggcccagtcttcttggagacttctatccaatgtccttgagg

SEQ ID NO: 11172 - DNA, 198 bp, Glycine max
  Peptide Sequence Number=SeqID_102857
atggccgaccagcaggctaccaagtccaaagccaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11173 - DNA, 806 bp, Glycine max
  Peptide Sequence Number=SeqID_102858
atcgaggcgctctactggaccgtgcgcctgggcacgttctcggcgtcggcgcagaagctgcacaccacccagtcggccatcaccaagcgcatccaggagctggaggcggacttcgacgtagccctgttcgaccgctccgggcaccgcgccgaactgaccgcgcgcggccacgaggtctatgcgctggccgaggaaatgctgggccaccgcgaccggctgctggtgcgcctgaagggccagcacacgctgaccggcacgttccgcttcggcatcaccgagatcaccgcgatgacctggctgccggccctgatccgcctgctgcgcgcgcactatccgcgcatcacgctggagccgcatatcgacctgggcgcggacctgcagaagcgattgcaggccgggcaattggacatggcattcctgcacggcgaattcgccgagcccgggctgcaggtcgtggcgttgcagcggctggagttcgcctggatgggcagccccgacatgatcgacccgagccgtgtctacacccccgccgacatcgccgccctgccgctgttgcggcaaagccgcgagtcgggcctgaacatgatctacgacggctggctcaagccccatacgccggccagcaacatgttcaccatcaacagcctgatcgccatggcgggcctgaccgcggccggcttcggggtgagctgcctgccgcgggattatttcgcggagatggtgagcgccaggcaactggtgatagcgcggaccagcaccgcggcgccgcaatcggtgtactgcgcgatgtaccggaagggggctga

SEQ ID NO: 11174 - DNA, 348 bp, Glycine max
  Peptide Sequence Number=SeqID_102859
gtgagccgcgcctggtataaccaacacgccacgggaagttacaccctgcttcaccgcctgacgccttccggcaaagatgaaattaccgcggccagcgacagcaaagatcttgagtggctggatcagcagctcagcgtcgcgctcggtgaaaacgaaacgcacgataaaaactggacggcggagctgatgaaacgcacccgcgaattccaggagaagatgcaccttcgcgtcgacggtatcccgggggaagagaccctgatgcagttgatgcgcgaaacgcataccacaccgagcgttcagatccaggcatcgcagaccaccccgaacacgcaagagaagcacgcataa

SEQ ID NO: 11175 - DNA, 324 bp, Glycine max
  Peptide Sequence Number=SeqID_102860
atgtcacatcctatcagagcattgtgtctagacgtcattaagcacaaggttcctttaaacaatccacctagtcatctgctcccccgaacacaaagttcaagatcatcacaaggtccaaacacaaacaacacacagggaggagaccagtcagggtcacgatgttttgcaagaatgctccaaccatatgggatcagcataggcttaaaggagcactcaaacccggtgacccccaaggcctacactccgaagagttcgtcagggtctctccctcctaattcaggtccaacccctaaaaacattttagcacacagacactgctcgtaa

SEQ ID NO: 11176 - DNA, 249 bp, Glycine max
  Peptide Sequence Number=SeqID_102861
atgaggtttcatgatgttatcacttcatttggctttgaagaaaacatcatggatcaatgtatataccaaaaggtgaaacaatttctctcgaagaactttgatatgaaggatatgagaaatgcatcttatgtcattgggattaagggtgacaaactcgctttaagtcagtgcccgaaaaatgattttgagcgggaacacatgaagaatactccatatgcttcagctattggaagccttatttatgcttag

SEQ ID NO: 11177 - DNA, 1177 bp, Glycine max
  Peptide Sequence Number=SeqID_102862
ttcgaggttgtgcaaggctcgaacactcgttaagccattgcactacgacttagcgagcagaacatctactctagaaacatcttccccgagaggaatgtggacctctacgtcactcagtaggacaagttttgaaaggagctcgagaggaggagaggataagtccccaaggcaggtcagggtgcggggcaaattgataaagtttgatgctacaatgctgaataagttcttggagacccaccagtggttttggagccaggggagcggtactccacttactccagattatccagaccctcaggagcttgcatccaagctctgcatcctagggcgaggatttgtgcttaacgctgagggtgcaccttggaagcttctgaggaaggacctcactactttggcccagacttggagtgctctatcatactccaacctcgctcccacttctcatacgttcggtctgaatatggacagggtgaggttggtctatgggctcgttatgaagatggaaatggacgtgggctcgatcatctctggtcagatctcacagatggcccagtccaactcctatcggctcgaattccctgccttgatcactgctctatgcacttccagaggagtcatccctaactcgctgactttcgagtccctgagccccgccattaatttggattatatccgaaagaattgctggaacccagatgattcgacaatcacttttacggggacccataaagctcgggctcggggaccttctaacacttctacctctacccctgcatctactccaacaccagcatcagcacctgcacttgccctagctcttctagccacgacagcaccctccaacccctccacttctaccagggacgcgattgtgccgatgagtccagtcttctcctataggggaggtgaggcttctatagcccaagagccgcaaccagatccggaggcgacactagacgacacaccagaggagacatctgaggacacttctgccgccacacccatggaggtcaccaaggagggagatggcattgcggacatagattacgtcgcagatatgacagtagcgcagggcacttgggacccttggcctactccagcacaggatacaccgctgccagcccaagatgccccctcatcacctctggatgacccaacaccagctcaggaggagtga

SEQ ID NO: 11178 - DNA, 294 bp, Glycine max
  Peptide Sequence Number=SeqID_102863
atggccattgctacgaatgtcgtcgccgccccaccatgccagctcttccagaaagaacccgacatccagatgatgttggccgtcgacgtccacctcgacaccaagaactgcgacttccaaatggaacataacatcttcaagcaccgcaacgacgggatttacattattaaccttgggaagacgtgggagaagcttcagctagcaaccttgttaatttcttttctagcaccatatgcttttaatcatgttaatatacaacatttggactattatttgcaacttaaaaacccttga

SEQ ID NO: 11179 - DNA, 460 bp, Glycine max
  Peptide Sequence Number=SeqID_102864
cattgattacccaacagtggtatcagagctatggccgagagcacacaaaggtcttgatcgggtgttagaagatgaaagatcggcttttataaatgaaatcgagtggactaagatccaaaggagggttgtgagcacgattcggttagctcttgctcccgagataaaacacaacgtgttgaaggaaacaacactgaaggtcttgtgggagaagctcgagaatatttacccatcaaagtcgttaaccaatcgcttttgtttgaagatggagttgtatcaactcaaatggagatgggaggagatctccatgaccacatcaacaacaaggtccttcaaagctttggttcaaacgttgcttataggaagatcaactttgaatttggatgagagaggaatcattcaaggagacatgatggtccaagaggaagatcaaaatcacaatcacacccgcaatgagatataa

SEQ ID NO: 11180 - DNA, 144 bp, Glycine max
  Peptide Sequence Number=SeqID_102865
atgtgggatcagcacaggcttaaaggagtactcaaaccgggtgtatttatccccaaggcctacactccgaagagtccgtcagggtctctccctcctgattcagtagatcccatcacaatactcgtcgcccttaaagggtcttaa

SEQ ID NO: 11181 - DNA, 756 bp, Glycine max
  Peptide Sequence Number=SeqID_102866
atgccagcccgagttcacgccatcatcgtcgcgcgtccaggatcctcgtcccgcgcgcagctgctccgcactctcgaagcactccgttcgcagactgcccccgtcgatgccgtcaccctcgtcatgtgtggcgatgcgtcctcggccagggagagtgacgcggtcgcggccaccgtcgaggggatcatcgaggcgcggcccgggacctctttcgccgaggcggtcgagctcgcgagtccccgagtgctcgacggatcggcggtctggctgctcgcacaggacacggctccacatccgcgcgcgttggagcgtctacgcggcatgctcgaacgctccccgtctgcggccatcgtcgcgccgaagctcgtcgccacggacaacgaccgtgagatcgtctcgctcggagtgagcatgaccgccctcggtcgttccgtcgagctcgcggcgggcgagctcgaccaggggcagcacgatcgcatggacgacgcgctcggcgccgatgtgcgcggcatgctgatccgtggcgaggtcagggacgcgctgcgcccggatccggccctcgccggcgccgacgaggggctcgacctcggcgtgcgcgcgcgcctggggggaggtcgcgtcgtcctggccccgagcgcgcgggtctcggcggcaccgggaggaccggcggcactgccggccggacggacccgacgcgcgtacgtcacccggctcgcacagcttcaccgacgtctcgcgtacgccccgaccttcgcg

SEQ ID NO: 11182 - DNA, 162 bp, Glycine max
  Peptide Sequence Number=SeqID_102867
atggcttgtcttgatttcaggtattgtcatcatcaaaaagggggagattgtagaataaaggatcaagatgaatgttttgatgatgccaaaggattacatgattcatatgcttctcaaagatttactcaagacaaagcaattagagataatcaagatggatga

SEQ ID NO: 11183 - DNA, 288 bp, Glycine max
  Peptide Sequence Number=SeqID_102868
gttgaggatgtaccatctgtgagggagctcatgaatccggatgatgtattcctattgaagaacaccccactcatgaagtcaattacatgggaaattagcccagaaacaattttaatgcaggaggattttctggattccaacatggccagcaatataatcaacaatagggacaatggaggaaccaccctggaaatcagttcaatagagatcaaggtggaccatccacaaggccacaacaacaaaggcctagtctctatgatcacacaacgaagctggaagagactctag

SEQ ID NO: 11184 - DNA, 553 bp, Glycine max
  Peptide Sequence Number=SeqID_102869
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcttcttggagtcttctatccatgcccttgggggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11185 - DNA, 318 bp, Glycine max
  Peptide Sequence Number=SeqID_102870
atgatggtggcccgggtgatgttggggtatggctacgagcccggaatgggtttaggcaagaacaacggcggcaaaaccatcctggtaagcactagaggaaaccgcaggaagtttgggttaggctataaacccacgcaagcggacataaggaaaagtatcgcggaaaggaagagcagaggccaaggccaagtagtcgagatatacgaggatgaccctccgaggggatcggttttggtacgaccatgtcctcctggtttccgactaggaaattggcgagtggaggagcgcccggacatttatgcaacaagcataatgtaa

SEQ ID NO: 11186 - DNA, 290 bp, Glycine max
  Peptide Sequence Number=SeqID_102871
gattgaacccataaacaacctcaaaaggggactgcttggtggttctatgaacccccctgttgtaggcaaattctacatgaggaagatacttcatcccaagactttatggttgcctttcagaagagcccttaaaagggcatcatccaccttgtggcatggtataaagtgtgccatcttgctaaacctatccaccactacaaagatagagtctacaccactttgggttctagggagcccaaggacaaagtccatactaatgtctacccaaggtgcagatggaatgggtaagg

SEQ ID NO: 11187 - DNA, 366 bp, Glycine max
  Peptide Sequence Number=SeqID_102872
atggcacctccagactctattcctttacccgggacccaaccttctcttcatagggaagatgaaggtcccacagcccaggtacctcagcatgtggaggatgagtcatctgaggccaccatcctagagccatttgttataacagaagaggaagaggagacacatgtgagacaagtagctgctgccacacctaagcgatcccttgaggctacttcagatccttctgcacaagggggaggatataccctcacctcagcacgcagcagaccccttcactccttatctagagatgccagaggacccgactacatcagtcctggctatggaaacttctcctccagctactccagtattgcatctaatagatga

SEQ ID NO: 11188 - DNA, 354 bp, Glycine max
  Peptide Sequence Number=SeqID_102873
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaaagcgcggcgggtgtggtggttacgcgcaggcgtga

SEQ ID NO: 11189 - DNA, 413 bp, Glycine max
  Peptide Sequence Number=SeqID_102874
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtgggtggttacgcgcagcgggaaccgctacacttgccagcgctgatgtccggcgggggcttttgccgttacgcaccaccccc

SEQ ID NO: 11190 - DNA, 267 bp, Glycine max
  Peptide Sequence Number=SeqID_102875
atgttgctaagtagaaatgtcatacatatctgtgtaagagtggtcatgttggtgcgcacgatccgcacttgtctctttgcagcggcacgggtgaaatcttgccccggtatgcatagtagctgcatgatagcctccctctctggttgtattcgcacagttggcgccctccaatatcagggggtggccctggagttgataaaaggaaactactggccccttaatcgggagtgcaagtctcggttaagcattaaggtcagaggaccttaa

SEQ ID NO: 11191 - DNA, 441 bp, Glycine max
  Peptide Sequence Number=SeqID_102876
ctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttacacccaaaagtgtttcgaagaaagaagggtgtcccaaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcat

SEQ ID NO: 11192 - DNA, 144 bp, Glycine max
  Peptide Sequence Number=SeqID_102877
atggaccctatgttggagatgcttcctacggtgaatcctttaatgcagaaattgcgtggtactaagcgtagaattgataatacaaactcaggagcattatggcataagcgcttaggtcacatttctaagaacaaaattgaatga

SEQ ID NO: 11193 - DNA, 274 bp, Glycine max
  Peptide Sequence Number=SeqID_102878
ttctctctgtctttcttccctgccgttcaggggcactctatctaaaggctttgaaaccttcagagctggttgacagcggtctacacaagcagttagagatgcagttccaccagttccgtaaagatcggactttctccatccgtgtagagttcatcccggacaaatggctccgcctctccctaaaggaacatttttcaatgttggtactgctactgcatcgcgatccagctataggaattacggatgctggtggtgctggttgccatgatgctag

SEQ ID NO: 11194 - DNA, 297 bp, Glycine max
  Peptide Sequence Number=SeqID_102879
gcagtaaccggcaactactacctatactcaacttgctcgtcggtccccgcccactactaccccgatggcttgaggcagccgctactactcgttccggttcctccaacctcgttcgcggatggtgctaccgctactccaatgccccgtcacaaccgctatctaacaactgggaatgcaactcaagccaccaactccagtacgcaaccaggcatgcgatccccccaatgccctgctcgtagtgctgttgatcgggctactccaggcaaccaccggtggactgacagctgggcttgttga

SEQ ID NO: 11195 - DNA, 480 bp, Glycine max
  Peptide Sequence Number=SeqID_102880
atgcaagaatgtggtgagagattcaaggatcaagatttggtagaaaaggtgatgagaactctaacccctcgatttgatgggagagttgctgctatcgaagaggcaagggacctgtctgagatgaaaatcgagcagttgcaagcctctctagaagcacataagctgaagatgaatgagaggagccctgcaagattaggccttgtatgcttcatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11196 - DNA, 441 bp, Glycine max
  Peptide Sequence Number=SeqID_102881
atgtcctgcccagcgatcataactccgacctccctctgccgaagtgtcagctggtatgccacctaccggcaccctctagacccagataagtctaacagggccctggggtttccagcattgatcacgggcctctgccagtcattcggggttcccgtcacacctagtaaggtgattcgaccgtcgatcacccgggccttcattgagaagtattgcacgcctagacaggcgcagggtgatgcaccgcaggccgcagaggcaccaccaccacctcatcaggatgatccagctgggtcatttggcacggagcggtatctacagcacttggttcgccagcaggcggccaaccatagggggcagagccagggttttgctccttttgcgtgccctactccagatcagttcaggactgaggtcgcatggcccggagattggcctgtgtag

SEQ ID NO: 11197 - DNA, 564 bp, Glycine max
  Peptide Sequence Number=SeqID_102882
atgaaaattggttccacctgttggccccgatcattagtcagtggaacaatgcagctgagtttagggtcgatgtgtaaaacaaagatgtttgtcaacccaaacaatgcaaacacagctgcattgggtgaagttgtggagactttacaatatatggtgtcaccacaagggaggaacacgtggacgattgatgatctcgtgccttacgtggataagttagcgattatatctgaagagcaagagagaattactgagccagtgtcacatggtccagcatcagagcgtgaattcccagcccaagagtttcatattcttcaatcaagtgttgaaactcggggtataggcagacgaagggagcctgttgaagcggaacaatattcccaacaaatgatggagtgtggtcatggaatgtattacacgccagcaacattttccgaatatcgttcacagatgtatcagtatccttttgcaggtcatcatactgatacttttgagacctcacattcgttcggtggtgttgcggaaacacagcctcatttttcatggtccactatgactctttcatag

SEQ ID NO: 11198 - DNA, 640 bp, Glycine max
  Peptide Sequence Number=SeqID_102883
gtatttattcggcgcaaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattactcggtggtttgagaacgagagcgcggagcagaaagccgaaaggcaaaaacagctgtccccaacgcaaaacgaaacgcagcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11199 - DNA, 296 bp, Glycine max
  Peptide Sequence Number=SeqID_102884
gggaggtggttgccgcccagctcgcccaggcgagctcagctcgcccaggcgagccagtttgcttcctccagaagcaacagccttctggaggaatcttctggagggcccaaggttttacttcttttccgtgccctactccggatcagttcaaggcagaggtcgcatggcccggagattggcctgaggcccgggcaggagaggcaccagcagaggctcccgacgaggcagatgaggcccgcgaggacgaggagatgaccgatttacttgatttcttaggagggagcggagccacatga

SEQ ID NO: 11200 - DNA, 619 bp, Glycine max
  Peptide Sequence Number=SeqID_102885
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatatggaggagaggagctaaaaggacacacaacttttcttcaaaagaaaaaactgaaagtctcgcatggtaatttggaattaggagtgaggttgaagtctgtggaatggggttggagggtgttgcttaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11201 - DNA, 282 bp, Glycine max
  Peptide Sequence Number=SeqID_102886
atgcagccacacaacatctcggtctatcgctacggtggagaagagttcgcggtgatcttccaggccgagcagatcgctgccgcattctcattgcttgacgcctggcgcaccgccgttgaaaggcgcgtctggcgggaagaaaacctgcacgttacgttcagtgcgggtctgggggaatggcacttcgaaccgctggaacaacttgtgggaagtgtcgataacgcgctttatagcgctaaacagcagggaaaaaaccgcattgttcgaacaaccgtcggctaa

SEQ ID NO: 11202 - DNA, 546 bp, Glycine max
  Peptide Sequence Number=SeqID_102887
atgctggccgtgcaggtgatgctcatgctgccgattatggttaacgatattgcgggctctccggcggcggtgaaatggatgtatgccatcgaggcgacaatctccctgacgctgctgtatcccatcgcccgctggagcgagaaacgttttcgtcttgagcatcgtctgatggcgggtttgctggtgatgacggcggcgatgctgccgattggcttaaccagcacgctacagcagctgtttaccttaatctgtattttctatatcggctcgatcattgccgaacctgcgcgcgaaacgctgggcgcttcactggctgatgcccgcgctcgcggcagctatatgggtttcagccgccttggtctggcatttggcggcgcgctggggtatgccggcggcggctggctgtttgatgcaggtaaagtgcttaatcaacctgaactaccgtggctgatgctgggcattatcggctttgcaactttcattgcgctatggtggcagtttagccagaaacggtcggcttccggcatgctggaaccgcgcacctga

SEQ ID NO: 11203 - DNA, 268 bp, Glycine max
  Peptide Sequence Number=SeqID_102888
tggcttctgtttctatcagctgtcccctcctgttcagctactggacggggtggtgcgtaaccggcaaaagcacccgccggacatcagcgctggcaagtgtagcggtcacgctgcgcgtaaccaccacacccgcccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 11204 - DNA, 640 bp, Glycine max
  Peptide Sequence Number=SeqID_102889
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcattttagtggagaaaacaacgagactaaaatagtctcggtgaacaagtcaccgatgcacaggattttggttggcaatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11205 - DNA, 446 bp, Glycine max
  Peptide Sequence Number=SeqID_102890
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgtatgggccgcgtttgtctcattccacgcctgacactcagttccgg

SEQ ID NO: 11206 - DNA, 353 bp, Glycine max
  Peptide Sequence Number=SeqID_102891
gctgcgcaactgttgggaagggcgatcggtgcggggctcttcgctatttaccgccagctggcgaaagggggatgtgctgcaaggcgattaagttgggtaacgccagggttttcccagtcacgacgttgcaagcaactacgccgatcgccgctagtactatgaagactccgttctcaaagaatcccaaaatgatgcaagtaaagctcgctattcgaaccttgcgcgcgcaagctatcggcgacgccgataggccgcgatcagcggaggcaatagaatcgaaccgctatcagtcgcttgcttgccttgctcagcaggcacagcaactaacgttcttgcgcagcaggctacgctga

SEQ ID NO: 11207 - DNA, 237 bp, Glycine max
  Peptide Sequence Number=SeqID_102892
atgactgaaaatgttgtaggagagcatcatccacaggaagcgtgcttcaaagcaaatttgtcccaaatttgggggagtaattatcaagctccattaaagcttgtaggcctaggatcttcttcatcaatggattcctttgcttcttggaagatgaatggcagtggaatggagaaggaagtgagtgaggaaacgccacttcaaggagaagatgagtctagaagaagctcaccaccatag

SEQ ID NO: 11208 - DNA, 621 bp, Glycine max
  Peptide Sequence Number=SeqID_102893
atgatagaagtctccgtggaagtgattgcatgccttacccagtattatgaccatcccctgaggtgtttcacatttgaggatttccagctagtgccgactgtgaaagagtttgaagaaatcctgggatgcccgctggaaggaaggaagccatatcttttctcagggttctatccctccatggctagaattgccaaggtagtgaaaatcttggcacaagagttggaccgggtaggcccgtctgtttgctacaaggtcaccgctcgtgcaccgagaaaggaaaggcgaattgggaccaaattttggctagcatggaaggggcatccgttaattggttccctcgctagaaggaaaaaagaaggcggtgcaacggggagccacttccgttatcaaaaccaagcccacttaggccttcttgagtgttccaaaagaaggcggtgccttctggtggaagcaacccagctcgcctgggcgagctgggcggcaaccaccttccttttaactcctataaatagggggaggggggcagagcaagggggagccacttccgttatcaagaaatccctcgaaattggtgagaaaaattgtttcgtgaagaaaatccaagccaaggtgcttccgtaa

SEQ ID NO: 11209 - DNA, 193 bp, Glycine max
  Peptide Sequence Number=SeqID_102894
atgggaatggaattcgggagacacaaccatttacagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 11210 - DNA, 355 bp, Glycine max
  Peptide Sequence Number=SeqID_102895
gttcagtccatctggtcaggtagtagagagagcctaccacgctgtctcaggcatagtagtagtattcgtagtagccatcatagaaagcaacgagcagctacttgagtggaggtgggggaggctgggagttcaagctgctatagtagtatacgtagtagtagaggcagtgggaagctcggtaggtcaagctagtagtgtagtagggacctcaagtagtagcatcaccaccagagctgttatgattgtggagatgtcgagtagtagtaacgatcgacgtggagacagcgcagggggaccagccagtagtagtatacggtcatttatagtggttcatcatgttgttttcatcacatag

SEQ ID NO: 11211 - DNA, 276 bp, Glycine max
  Peptide Sequence Number=SeqID_102896
atggtgaaagttggaacctcttacgtgccgatcaacgtctcattttcgccaaaagttggcccagggcttcccggtatcaacagggacaccaggatttatttattctgcgaagtgatcttccgtcacaggtgcctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 11212 - DNA, 1266 bp, Glycine max
  Peptide Sequence Number=SeqID_102897
atgtcttcttttcttcccgcctcagccgagtcacttgatctggcagtggaggccaaagacccgtctgagtccatctccattctttatcaggtacttgatgatccttcttcttctccagatgctctgcgcatgaaagagcaggccatcacaaacctcactgagcatctcagggaacagaatagggcagaggatttgcacagccttcttacacagttgaggcccttcttttccttgattcctaaggcaaaaactgcaaagatagtgaggggcataattgatactgttgcaaaaataccagggacttctgatctacaaattacactatgcaaagaaatgatgcaatggactcgtgctgaaaagcgtacctttctgaggcagcgagttgaggcaaggcttgcagcacttctgatggaaagtaaagattattctgaagctttgactctcctcagcggcctggtcaaagaggttagaagactagatgacaagcttctacttgtagacatagacttgcttgaaagcaagctacacttctccttaagaaaccttccaaaggcaaaagctgctctcacagctgcaagaacagctgcaaatgctatttatgttcctccagctcaacaaggtgccatagatctacagagtgggattcttcacgcagaggagaaggattacaaaactgcatatagttatttctttgaagcttttgagtctttcaatgctcttgatgaccccaaggctgtatttagcctgaaatacatgttgttatgcaagattatggtgagtcaagctgatgatgtggctggaatcatatcttctaaagctggcgtgcaatatcttgggcctgatttggatgctatgaaagccattgcagatgctcattctaagcgatctctgaagttattcgaaattgctttgcgagactacaaggctcagttggaggaagatccaattgtccacaggcacctgtcatccctgtatgattctctcatggagcagaacctttggagattgattgaaccatacgcaagggttgagattgcacacattgctgaactaattaaacttcctgttgatcacgtggagcaaaagttgtctcagatgattttggacaagaagttcgttgggacattggatcaaggagctggatgccttgtcatattcgatgatcccaagactgatgcaatatatcctgcaaccttagaaaccattttcaatattgggaaagttgtggacagtctttatgttaggtctgccaagatagtggcatga

SEQ ID NO: 11213 - DNA, 720 bp, Glycine max
  Peptide Sequence Number=SeqID_102898
atggagaggagtatgattgatgctgtcagtggtggagctcttggtgatatgacccctactgaggctagaaatttgattgagaagatggcttctaactcccaacaattcagtgcaagaaataatgctattgttcttagaggagtccatgaggtggccgcgaattcatcttcatctactggaaataaaaatcttgaaggaaaacttgatgccttggtcaacctggtaactcagcttgccatgaatcagaaatctacacctattgcaagagtctgtggtctatgttcttctgcaaatcaccatacagatctctgtccttctttgcagcaatttggaatcaatgagcaacctgaagcttatgctgcaaacatttataatagacctcctcaacagcaaaaccaacaacaacagaataattatgacctttcaagcaatagatacaatccaggttggaggaatcatccaaatctgagatggacaagtcctccacaacaacaacagcatgtccctcctttccagaatgttgttggtccaagcaagccatatgttcctcctccaatacagcaacagtcacaacaaagacaacaagcaactgaagctcctcctcaaccttccttagaagagttagtgaggaaaatgaccatccagaatatgcaatttcagcaagagacaagagcctccattcagagtctgacaaatcagatggggcagatggctacttag

SEQ ID NO: 11214 - DNA, 423 bp, Glycine max
  Peptide Sequence Number=SeqID_102899
atgtgtttgccaaacttgtcaatcagtctaggactccagaggtacagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11215 - DNA, 555 bp, Glycine max
  Peptide Sequence Number=SeqID_102900
atgaaaacagaaaaatatgcctcctatagtagtcataactcttgcaagagcctaagtgaagaacttcgtgactattacaaaggaaggcataggtcacatcttagacctcactcccatagaagagaaaaggaaagaaagcctcaagaggctaaaattaacctcccatacttccatgggaaggacaatgtagaggctaacttagtttgggaaataagggtagagcaacaacttaaaaagaagtctacgtcaaaatcttatggctctcactcttatccaaagaaatatcatggtcaaggcatcttaggggtgacaccttctaagcccaaagatgataaggggaagacaatagaaaagcaatcccctaaggctagtatgcaagagaaaaatagctctataaagtgctttaaatgtcttggaagagaacacattacttctcaatgccccaccacaaaaaccatgattacgaggggccaagacatttatagtagccaagataaggctactacttcaccttcctctagtgaaagtgaaaaagcaaaagggggaagaatctaa

SEQ ID NO: 11216 - DNA, 439 bp, Glycine max
  Peptide Sequence Number=SeqID_102901
ggccctgggatttcccgcgctgatcacaggactctgccagtcgttcggagtccccgtggcacctaccaaggctcagggggatgctccacaggccgcgggcacgccaccaccacctcatcaggctggcccggctgggtcatttgacatggagcagtatttacggcatttggttcgccagcaggcagccaaccaccgggcacatgtgcagacccatgattgtctgtaccagatgagcctcagcatgcaaagccagggcttcgcttctttttcatgccctactctagaccagttcagggcagaggtcgcatggcccggggattggcccgaggcccaggcaggagaggcgcccccagaagctcccggcgatggagaggaggcccacgaggacgaggagatggccgatttgcttgacttcttgggagggagtggagcttcatga

SEQ ID NO: 11217 - DNA, 511 bp, Glycine max
  Peptide Sequence Number=SeqID_102902
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcattggaccttgtcgcaatgtgcccttttgcgggtgagcgaggcgaggctcaccggtgtgctttccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11218 - DNA, 792 bp, Glycine max
  Peptide Sequence Number=SeqID_102903
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacctggcgaacggtacttgatcgacctcatggaccgcgcggggctggacaagatccgccacagagcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggggcggagatttccctggaagatgccaggaagatacttaa

SEQ ID NO: 11219 - DNA, 204 bp, Glycine max
  Peptide Sequence Number=SeqID_102904
atgtttgtgcaaaatagcaattcgtcagtgaggcataattcatcatcttctgaccaacccaatccaagaaggatgatgtctatgttggatcaatttcaaccatttatccacgacttcattgataatattgttgatgtcaaagttgatggaaattatggatatcgggcggttgccgatttattaggtattggtgaagactcttag

SEQ ID NO: 11220 - DNA, 159 bp, Glycine max
  Peptide Sequence Number=SeqID_102905
atgaagaatgatgaagaacggtggaaaacctttgcgaaatcgcccacggaaacgtctcggaagcgttacggaagcgcctcggcttggattttcttcacgggaaaagagggtggtggttgccgcctagctcgtgcaggcgagatgggttgcttcgactag

SEQ ID NO: 11221 - DNA, 239 bp, Glycine max
  Peptide Sequence Number=SeqID_102906
gtgctccagtggcttctgtttctatcagctgtccctcctgttcagctactgacggggtggtgcgtaacggcaaaagccaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 11222 - DNA, 93 bp, Glycine max
  Peptide Sequence Number=SeqID_102907
atgacacaacaatactccttgaattcctacctcacaattgcgactgagattcttgcaaggcctattgtggaattaatgaaacattgggcttaa

SEQ ID NO: 11223 - DNA, 667 bp, Glycine max
  Peptide Sequence Number=SeqID_102908
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatggactcggttatgagccctgcaacggctattgagtttgggcgtttgggcggccttggtgtgctcaaccttgagggtttgtggacccgttacgaggatcccaccccgtacctcgaggagctagccgggttgagcgacgatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11224 - DNA, 240 bp, Glycine max
  Peptide Sequence Number=SeqID_102909
atgtctgtcatactgacccgtgaagtcagggttaccttatggttacctgcacctttcgtcaaccaggggtcaaacgagcccgttcatgcgcagagactaacatcgtcttctgcaccttttgccatccagggacagcgagttaggtggcaggtgaagataccttatggtcattcgcacttttcgtcaaccgaggggaacaaattcgacggtatcaggatgatgttggtcgttcgtttctga

SEQ ID NO: 11225 - DNA, 130 bp, Glycine max
  Peptide Sequence Number=SeqID_102910
ggagggtacatgctgagacctcttcctagaggagcaggaaaattccacggtggtgcggaagaggtttctaaaggaacaacaagaggaaaagacaaaatagctgttatatataagctggaagcaagtccta

SEQ ID NO: 11226 - DNA, 567 bp, Glycine max
  Peptide Sequence Number=SeqID_102911
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatcatcgacgcccagttgcgcctgcccggcctcggtcgcgacaaggtggtggccctggcggttgcgctgctcgacgccaccctgatccgcgtcggcaaccaccgctacgcccgcgaatcaagcttatcgataccgtcgacctcgagggggggcccggtaccagcttttgttccctttagtgagggttaa

SEQ ID NO: 11227 - DNA, 405 bp, Glycine max
  Peptide Sequence Number=SeqID_102912
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggcaaaggcagaggctgcaattgctattggattcgatgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 11228 - DNA, 212 bp, Glycine max
  Peptide Sequence Number=SeqID_102913
ttggcccagggcttcccggtatcaacagggacaccaggatttatttattctgcgaagtgatcttccgtcacagtggcttctgtttctatcagctgtccctccctgttcagctactgacggggtggtgcgtaacggcaaaagcaccgccggacatcagcgctggcaagtgtagcggtcacgctgcgcgtaaccaccacacccgccgcgcttaa

SEQ ID NO: 11229 - DNA, 438 bp, Glycine max
  Peptide Sequence Number=SeqID_102914
atgacattgcagctgtcaaacccggtctattacaaggccttatggcgtggtagaagatgctttggtcaagatatgaagaaaggtaatctggaaatgagcgtggatgataagaaagttacagtcaatctatttgaagccatgaagcacccaaggaactataaggcctgttttaaagtagaaaaggtggaacatgagataaacatggtagctagaaccatgaattgtttagaagaattaaagggtgtagaggaaaatccttctaaaaaagtggtgtttgaagaattgaagaaggacattccaacagaaaaggctaaagtggagttgaaaacccttcttgaacatctgaagtatgtgttcttaggagaaaatgaagcaaatctggtgatcatcagcaattctctaagaaaggaggaggaatctcaactggtgaaggtttga

SEQ ID NO: 11230 - DNA, 96 bp, Glycine max
  Peptide Sequence Number=SeqID_102915
atgggtgagaactttaattcagggcttggaattgttgacagtatcgcttggccactgaaaatgtattgtgataactccgcaacaatatttttgtaa

SEQ ID NO: 11231 - DNA, 507 bp, Glycine max
  Peptide Sequence Number=SeqID_102916
gaaattgggattgaaattgataccaatgtgaagagagaagaggtggagaagctggtcaatgacttcatggcgggagagaaaggaaacaaaatgagacaaaagatcgtggagttgaagaagaaggcagaggaagccactacacccagtggttgttcattcatgaacttagacaaattcattaaggagagaaatctcatgtacctagctgcaatagctgattctcaaccacaaccatctccattggctggtcagcaaggcatgcacaaccaacttggcatgtgctccagtggaagtcaaggcctccacatgctgcaaagtgaagccactaatgttggaggaaatgcaaccataggaaccggaggagggtttccggactttgtatgcatcggtagtggcaagcaagatattggaatctctggtgaaggcagaggaggaaactctagtggccactctggtgatggtggtgagacacttaattacctgaaagctgctggtgatggaaactga

SEQ ID NO: 11232 - DNA, 213 bp, Glycine max
  Peptide Sequence Number=SeqID_102917
atggagtcgccaactgtcgcaacctacccttcggcgggagggcgacgcgtgactcgcgggatgcgtgttccacgaaaggaatatgcgcggagtcgccaccaatgtttatttgaggaaaacgtcggaaaaaccggaaaagacgcgatctacgaacttttaagtgaaaggctcgggagttgtatttacgcacggggaaggttaagcgagaaatga

SEQ ID NO: 11233 - DNA, 249 bp, Glycine max
  Peptide Sequence Number=SeqID_102918
gtgactacggataagtggatggatataacggacatgggacatgtcattgcatcaaggattgaactttttttgcatgtacaacaagtttatttaaaagaacgttgtcccttaccgcctgtagcattgttatggtctagccattgtcatcctcaggcgaagtcgtggccaaatccatatattagcagaatgcagcattacaagagcttcatgatgttcaagagagactatgttgacataaatgatgattga

SEQ ID NO: 11234 - DNA, 444 bp, Glycine max
  Peptide Sequence Number=SeqID_102919
atggatgaagaccgtaaatccacggcgctcaaagcgctgcaggggatcatctggcacgatggctacgtgaatggcgactttaccggccacctctacccggacgtcctgcctgcgctggaaaaatggaaagcgcaagggattgatctctatgtttattcctcgggatcggtcgccgcacagaaactgttatttggctacagcgacgaaggtgatattactcatctgttcagcggctattttgatacccacatcggcgccaagcgcgaggtggcgtcttaccagaacattgcggcccaaacgggcatcgcgccgtcgcagatcctgttcctgtcagatattcatcaggagctggacgcggctgaacaggcaggctttcgtaccctgcagctgattcgcggcgatgatgacgggggcaagccatcaccatcaggtccaccagtttga

SEQ ID NO: 11235 - DNA, 198 bp, Glycine max
  Peptide Sequence Number=SeqID_102920
atggaggaggataaaagcaatgcatatataagattactacagtacctgctaaggaagaggaaatctggggtgcattgttcaagagaatcagtgatcagtcccaacagtaatataaggttaatgtcagttgagactgcattaggtacaaaggaaatatgtgaggtaatcttggagcttaagaagttagagttgaactag

SEQ ID NO: 11236 - DNA, 403 bp, Glycine max
  Peptide Sequence Number=SeqID_102921
ggcttttctatatggaagagacaaatgatagtagaaaagtcatgcaacctggagaatggtggaagatgtttggtgatggaactccagagttgaggagatttgctattcgtgttttgagcttaacttttagctcttctggtctaacaatgaatggatactctaaagagggatatagttatgaggatgaacaacctcaaggtgaaggtgatggtggcaatattgaattagtgggagatgttggagaaagttcaaatgatctagttgtagacgcttttgatctcgataatttaattttggtggaacctaatgatgatgcacaatctgaggaagaccatgatgatgatggagatggtgataaaaatgatgatattcatggagatgatcctattagaggattgaacat

SEQ ID NO: 11237 - DNA, 609 bp, Glycine max
  Peptide Sequence Number=SeqID_102922
gacaacaacccaagtagatgtaccctctacttgtacctcaaaggatgtaccctccaatgtgttaaggcaaagaattctcaggcggttagtcctttgaatctttgtaaggggaaacaaaagatatctcaggcggttagtcctttgaattctcttggaaagagagaagggagacacaaaacaatttgggcggttagtccttctattcttttgacaaagggagaagtgaatgaagaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11238 - DNA, 456 bp, Glycine max
  Peptide Sequence Number=SeqID_102923
atgcaagaagggcaaaacggtaaaacatcgtccctgagtatcctcgccatcgctgggggggagccgtatcaggagaaaccgggcgaagagtatatgaatgacgcccagctgagccatttccgcaagattctggaagcctggcgcaaccaactcagggatgaagtagaccgtactgtgtcgcatatgcaggacgaagctgccaacttcccggatccggttgaccgtgccgcccaggaagaggagttcagcctggaggggcgtaaccgcgatcgtgagcgcaaactcattaaaaagattgagaaaacgctcaagaaagtggaagacgacgactttgggtactgcgaatcctgtggggtcgaaattggtatccgccgtctcgaagcgcgtccgaccgccgatctctgcattgactgcaaaacgctggcagaaatccgcgagaagcagatggcaggctaa

SEQ ID NO: 11239 - DNA, 360 bp, Glycine max
  Peptide Sequence Number=SeqID_102924
atgaccgttatcccccgggaaagccacaatatctcacgcaaagatatcagcgaaaacgctctcaaagtgctgtatcgcctgaacaaagccggatacgaagcctatctggtcggcggcggcgtgcgcgatttctggttcccactgggtaaaaagccgaaagactttgacgtgagcctgacctatttcgacgcctttgcgctgtcggagcagatgcgtaagctgattcgaagcctgcggcgtcgcgtctggcgattcggtccgaaacgtatcatcgccacgctgattccgcgatcatctggagcgtcgacagttcgcatgtcgcggtcacgtaagcggcatggaactgatggagcatcctaa

SEQ ID NO: 11240 - DNA, 387 bp, Glycine max
  Peptide Sequence Number=SeqID_102925
atgtggcttatacagacgatgtctgatgttgaggtcccattcccaacatcagagattaagtgtgtcaggcagacccttcacacattcattgcatggacaacaccacttgttaaaaaaatctttattgagcatgagggcagcagtccaactaaagacactgaagctgttgaagcggtcaacgatgttgttgtagatgaccccttgcgcgagttgattaagagcctagttgacatttatgagaagcctgtagagttagtgtgggatgtaactaaatttggaattccaaatgcagttgcatcattgttcgtaacctgtgctgatgtgaatgaaataatatcaggcgtacagtgtttgaacatagttatactacaattgtggaccatgtaa

SEQ ID NO: 11241 - DNA, 462 bp, Glycine max
  Peptide Sequence Number=SeqID_102926
atgaccatgattacgccaagctcgaaattaaccctcactaaagggaacaaaagctggtttgtttgtaatacccctccacccaacctctcgctaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcgggcttttgccgttacgcaccacccc

SEQ ID NO: 11242 - DNA, 489 bp, Glycine max
  Peptide Sequence Number=SeqID_102927
atgaccatgattacgccaagctcgaaattaaccctcactaaagggaacaaaagctggtaccgggccccccctcgaggcacctgccaaccttcgttggctgaaagctactcccagggcatcactcctagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11243 - DNA, 345 bp, Glycine max
  Peptide Sequence Number=SeqID_102928
atggaaataaacgataagctgtttgatgagcttcatacatcacaaccggaagttcttcttgaagcgatacaagatgaaaaagtcccgtccacgatgcgtttatttttacaggactttcttgacaatgggcaggaattaaacaatttcgcttttatggaatccgattatgtgaaaaatagatctgttttggatcaagtggcttttttccttccaagcaaatcgtttatttggcatattgactatgaaaagattgagaagaataaaatctttattgttcctgtgtcttttcaagaatattttcaaaaagtagaagagacgataaaggaattttttcatctatcctaa

SEQ ID NO: 11244 - DNA, 416 bp, Glycine max
  Peptide Sequence Number=SeqID_102929
atgacccctactcatgatgcccttctatattacaatgggaggtggaacatgccacgccaaaacaactttgtaggttacgcgtttacaggaaaaaatccaaaaaaatttgacattcctttagtatgtaccattgatgaactgaaggatttgataaagcaagttgcacctcaagggattccccctcatgttaatgtaatgtttgaattcgagaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11245 - DNA, 492 bp, Glycine max
  Peptide Sequence Number=SeqID_102930
acacttgttagcattgccacatctcttaggcttgagtttattcctcaagtaaaggagttgttggatgagggtttggttcgcaagagattaaatccttgtgctttgttggtgcctaaaataggggttcccatgaaccctaagagaataaaggtcattcctgagttgcccgctccaccaagtgtaagaaaaattttgggcttccaagacttaacaaacttttacaaaaggtttgccccatatttttctatacttgtagcaccactcattgagttggtgaggaaccatgttccttcatgggaagatgcccaggaaatgagttttcagaccttaccttacttcaacatactaaacaccactaatacatatgcttttgttctttttgcaagtgttgaggaaaaaagcccagagtttcaagaacatcgggatttgaggtcaaatccttttcaagggggagggaatgatgcaatcctaccccgcaagggcattggatag

SEQ ID NO: 11246 - DNA, 479 bp, Glycine max
  Peptide Sequence Number=SeqID_102931
atgttagtgagctgcccctcctccgccccatacgtagaagcagcggaagaatcattggaaacggctttccaatccttcgaggtggtgagctgcgcctctgtggaactaagtccgttgctaccttctctctccaacgtggccataatggtggcgcgtgttatgctcaggaacggatttgagcccggaatgggtctgggcaaggatggcctcggaaatgccgacgtggtcgatatcaagggaaatccatacaaatatggattagggtatgaacccgggatgccggggaggaggaatgtgccgtcaagacttcgggcggatagggtatggcccggccgtattagccagtgtttcactagtgccggaacggtgtccgaggaggaggtggccgcagtagaagacgagttccctcaagacccgccaagttttgtgcaaccatgccatcccgattctcaagtggggaactggcgcgtgataagcca

SEQ ID NO: 11247 - DNA, 282 bp, Glycine max
  Peptide Sequence Number=SeqID_102932
atgccggaagtcgaaaggaagcattgttgcgcaatccgtaaagttccgcaacattccaaaggcccacttgggccttttagggggaaaaagagcagagtaatttcattcaacccttttggtatttacgattctcttgaaattagtgagaagaattgtttccgtgaagaaaattcacgccgaagcgcttccgtaacgcttccgagacgtttccgtgagcgatttcgtgaatattcttcaccgttcttcatcgttcttcttcgttcttcggtcttcaaccggtaa

SEQ ID NO: 11248 - DNA, 303 bp, Glycine max
  Peptide Sequence Number=SeqID_102933
atgaagatccgttatcgccggctttgcgccgccatgctcgcggtccggcagaagcggccgctgccgcaggcggaacagcaagtggaacaccgggtgctttccatgctggccgatgcagcagggattgagggacatgtgccacccgccggcttcccggccaaagcgccgccacgctacctgccgatgatgccggtgccgctatggccggacacgctgctgcgcgaaacatccgatgcccggcaaagcgaggaccagccggcagcgagcgcagcaccacagggggcggaaggtgggatcctctag

SEQ ID NO: 11249 - DNA, 619 bp, Glycine max
  Peptide Sequence Number=SeqID_102934
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtttggagaggctaaaagtcatcttatcgcctctccagacaaagaaaatgaaaacaagctcaatctaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11250 - DNA, 168 bp, Glycine max
  Peptide Sequence Number=SeqID_102935
atggaccctaagagaataaaggtcattcctgagtggcctactccaccaagtgttgaggaaagaatccatgagtttcaagaacctctagatttgaggtcaaatccttttcaagggggaggtgtagaagcaaatgactttgatgttttgatgatgatcatgatgatttga

SEQ ID NO: 11251 - DNA, 206 bp, Glycine max
  Peptide Sequence Number=SeqID_102936
atgggggagacgcttgccacccagcttgcccaggcgagcaaggtgactttctccagaagcaaccgccttctggaggaatcttctgctgtcgggaaacctgtcgtgccagctgcattaatgaatcggccaacgcgcggggagaggcggtttgcgtattgggcgctagcggagtgtatactggcttactatgttggcactgatgaggg

SEQ ID NO: 11252 - DNA, 117 bp, Glycine max
  Peptide Sequence Number=SeqID_102937
atggataagagcttgaaggtagaagaagatgagtggagggagagggagagaaggagcatgaaattttgtgccccaaatgaggagaaacagggacctgagggctatcgaaatctgtag

SEQ ID NO: 11253 - DNA, 621 bp, Glycine max
  Peptide Sequence Number=SeqID_102938
atggctactccacctgcctcgccttctcctcctcctccttctcattctcctcctcctcctcttgcaatagcatcagcgtctttgtctaccttgaagcggacacgcaaagccacacggctacgatccttggccactaaaccacctggggcagagagaccagtggtccacgtcaatcctgcaaccgggaaagccgacagtccccacaagaagaaattaagaacatatttggggattgtcgctcatgataagatcgacatgacatacgacacttggaaggaagtccctgctgctcagaaggatttgatatgggaggatattcaggcgaaaattgatatccctaaagcttctgaaggtaggacaaagaagaaagtacttcaaactgtcgacgagcgatggagacggtttaaatctgatttgacgaggaaatggacacttgcagtcgacaaggacagtgtggacgacactgtttgtgaaaaatacggcattagcaaggagaaatgggcccagattgttagacccgtagagacccctcgtgggaggatgtgcaaaaaaaggcatgagccatccagaagcaaaacaccgccccccacgtgttgtctcgtgagggttatgaatatttag

SEQ ID NO: 11254 - DNA, 297 bp, Glycine max
  Peptide Sequence Number=SeqID_102939
atggcgtgttttttggtgaatcgacgaggcgggtcgttacagtttggttcgcaagagcttaaatccttgtgttttgttggtgcccaaaatagtgatcaaggggttcccatgaaccctaagagaataaaggtcattcctgaatggcccactccaccaagtataaagaaaatttggggcttccatgacttaacaaacttttgcaaaaggtttgtcccatatttttctatacttgtagcaccactcattgagttggtgttgatgaaaaaagcccagagttttaagaacctcgagatttga

SEQ ID NO: 11255 - DNA, 604 bp, Glycine max
  Peptide Sequence Number=SeqID_102940
atgactgccattgatgattctaaccccttaattctttattcatccgataatcctggcattgctctagtttcacaccccctcacaagtgaaaactacaattcttggaagaaagcaatgcgcatggctcttcacgagaacctgctttgggtcactccacccatgctttgtggcatcgcaatgatagtattctctcatcctgaggtcaaattctttccatggatccctttcccccaattactaaggttttttgccttaattgttcaagaagaaaagcaaaaagaggttggtgcatccacgtctagaacttctgctagtgaggtttcacatgcttttgcattcaagaattcttttgatgcaagagacaattctgataatcgctccaaaggctcttccaagaaccaccccttgtgtgctcattgtggtatgctgggtcatactcaggatcgttttttcaagttgcatggctatcctccaaattataagaagactggatattccttaaaggtcaagaaggaatcttcttcctcctctgaaccatcacacaaggttgctcaccaagtgtctgttgatatgcctcaatcacaaccctcttatgttgacttgg

SEQ ID NO: 11256 - DNA, 432 bp, Glycine max
  Peptide Sequence Number=SeqID_102941
atgaagcacttcactgacaccctcatcagtgccaacataaaatacaaaatttcaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11257 - DNA, 225 bp, Glycine max
  Peptide Sequence Number=SeqID_102942
atgccttccaagattattttgatgatgccaaagaatcaagagttaagaaaattccaaagattcaagaatcaagttttaagaatccagattcaagattcaagaatcaagttccaagaatcaagaatcaagaacaatcaagatcaagattcaagactcaagattcaagaatcaagtgaagactcaatcaagataagtactaaaaaggtttttcagaacattgagtag

SEQ ID NO: 11258 - DNA, 644 bp, Glycine max
  Peptide Sequence Number=SeqID_102943
tgtgggttaccgataaccatcagtttgccctcaccgacttgccccagcgaaataaacggcaggttaaaggtggcggtatcgcgcgtaacgttttccggctcaacaagagaaggcgcttccgtaatgtacgccagctcgtttttatcccaggcgcgtttttcgccgaaggccagccagtagtttttatcattacgcgccatcagaatcgggaaggccgcgttggagatattcaccaccgcctgaccgcgcgcattacccgtgctgccatagaagttggtggagtcatggaatacatggaacttgctgacagatttgtagttcgtatccacgccccacagcttgttgataacgccctgaatctggccgtcattaacattgcgcgtcgtcagcgagaaccagcgagcctcgttacaaccatcggttttcgcacaaatcgcggtatcgatctctttggcctgacccgtattaaactgctcaatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccgggaagcataa

SEQ ID NO: 11259 - DNA, 326 bp, Glycine max
  Peptide Sequence Number=SeqID_102944
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcaatttttgtattgtgtggctggtacttgttatgatcacgaaccttcgttcgtgggagcagatggacaacagtag

SEQ ID NO: 11260 - DNA, 260 bp, Glycine max
  Peptide Sequence Number=SeqID_102945
ggagaaacatcttgccagagaggaaggtggagctctaccacactgagtttgatgattttaagattgagttggagaggcgtaatcttcataaacgcctcaccaatttggttgatgggagcatagatgtggctttagtgaaagagttttatgcaaacctatacagctctgagggtccttcaccaaagcaagccaaggttagaggccatctagtgaagatcgatgctgagggtgagactttgcccacatacttttggagctaa

SEQ ID NO: 11261 - DNA, 222 bp, Glycine max
  Peptide Sequence Number=SeqID_102946
atggtgaaagttggaacctcttacgtgccgatcaacgtctcattttcgccaaaagttggcccagggcttcccggtgctccagtggcttctgtttctattcagctgttccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 11262 - DNA, 280 bp, Glycine max
  Peptide Sequence Number=SeqID_102947
aactggcgatgcgggatgaaccggaagctgggttacggtgcccaactgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11263 - DNA, 177 bp, Glycine max
  Peptide Sequence Number=SeqID_102948
atggggaccaccaaggtgattatgaagtatcaaaagggttgcacccctttctccttcactcctccccctatttataggaaaataggggaggagcttgccacccagctcgcccaggcgagccaggttgcttcctccagaagcaaccgccttctagaggaacatcctggaaggccctag

SEQ ID NO: 11264 - DNA, 327 bp, Glycine max
  Peptide Sequence Number=SeqID_102949
atgacaacacccccgagatcccctccaccaccagattctcctagtgcaaccacaaaaaggaagactagacaaactaccaggctccgaaggttgactgcacgaagcttatatcaagcacgaccaactgtccacgtcaacactagtactggtagaggatctggcccgcataaagaaaaattccatagttacttgggggtagtggcacaggagaaaatccctattgttcatgctacttggaaagatgtccccgacactctaaaagttattgtatgggatgacattttggccaaatttgatattcctgaaggtttaactgcgaagaagaag

SEQ ID NO: 11265 - DNA, 540 bp, Glycine max
  Peptide Sequence Number=SeqID_102950
atgaccacattgacccagacatggatgacactgctgctcagcaatgtcctgcctagcgatcataactcctatctccctctgcctaagtgccagttggtgtatgccatcctgacacggatgagcgtccacgtggcccaggtgattgctgacgccatctatttgtttgcaggtattccacccaccaggcaccctctagacccggataaatctaaaagggccctggggttttcggcgttgattacgggcctttgccagtcattcggggttcccgtcgcccccagtaaggcatggagcgttatctacagcacttggttcgccagtaggcggccaaccatcgggggcaggtgcatatacatgagtgtctctaccggttcagcctcattcagcaggggtagggtttcgctccttttgcatgccctactccagagcagtttggggctgaggtcgcatgacccggagactggcccgaggcccaggcaggggaggagcctgcaggatccccaggtgaggcagaggaggctcgtatggatgaagaaatga

SEQ ID NO: 11266 - DNA, 279 bp, Glycine max
  Peptide Sequence Number=SeqID_102951
gtcgactctagaggatccccaggagaaaccattaaaactaaggtagttcctaaacaaaaatcaattgaggaagcttcgccaagtatccccattgaaaaacctttattcaaacctttcaaagttagtgagaaggctaaacgaaaaattagggaacttagaaaaactaaatccttaattgaaggcgtaggtgacaatcatagtgaattactaaacaagattggtagtttacttaaggtcattccagatactccccaagcctcgaaaaatacttccaaaatg

SEQ ID NO: 11267 - DNA, 354 bp, Glycine max
  Peptide Sequence Number=SeqID_102952
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatcccctaaaggaagagactttgcctttggtgaaggaagaagaaagcaaagacacagatgaagaggctttggtgaagggtaccgagctcgaattcgtaatcatggtcatagctgtttcct

SEQ ID NO: 11268 - DNA, 207 bp, Glycine max
  Peptide Sequence Number=SeqID_102953
atgccgatgttagatcaattttatccgtttatacacgatttcattaacaacattgtggatgtcaaagctgacggtatgggtaaaaattcttggtccttggtgtgcaaccatttgcttaaagaacttggcaaatggtcagatgactatatcaagctctttggtggtacagacaaattcgaggaattaaggaggtccctacttaattaa

SEQ ID NO: 11269 - DNA, 474 bp, Glycine max
  Peptide Sequence Number=SeqID_102954
atgctgagcataacgaacctgtatgccgattacggcggcaaacctgcgctggaggagatcaacctgacgctggccagcggtgaactgctggtggtgctgggcccctccgggtgtgggaaaaccacgctactgaatctgattgccggttttgtcccttatcagcgtggcaccatccaactggaaggcaaaaaggtggaaggccccggcgccgagcgcggcgtggttttccagaatgaaggtttgctcccctggcgcaacgtgcaggaaaacgtggcgttttgggctacagcttgcgggggtgaaccgcgaacagcggctggaaacggcacggcagatgctgaaaaaaagtgggtctcgaaggggggcggaaaaacgcttttatctggcagctttccggcggtcagcgccagcgtgtcggcattgcccgtggcgcttggcggcaaaccccggcagctgtttgctgctggacgagcc

SEQ ID NO: 11270 - DNA, 210 bp, Glycine max
  Peptide Sequence Number=SeqID_102955
atgtcgaatttgacatcaaaatgggcacttgcaaccgacaaggacagtgtggatgacgttgtttgcgaaaaatacaacatttgcaaggagacatgggctcagttttgtcagagccacaaagacccctcgtgggaggatgtgcagaaaaaggcacatgccatccagaagcaaaaacattgcccccacgtgttgtcttgtggagagttatga

SEQ ID NO: 11271 - DNA, 372 bp, Glycine max
  Peptide Sequence Number=SeqID_102956
atgtcgttggaatgcaacaactctaaccacaagcacatgggtcatccgctactagtctatgtggtctgctatgagggatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 11272 - DNA, 136 bp, Glycine max
  Peptide Sequence Number=SeqID_102957
tggcgtctcctttctctcttccttctcaattccgttgccattcatcttccaagaagcaaaggaatccattgatgaagaagatcctaggcctacaagctccaatggagcttacatcacatgttgggagatgatttag

SEQ ID NO: 11273 - DNA, 189 bp, Glycine max
  Peptide Sequence Number=SeqID_102958
atgagtcatgggcgcttgtaccagcaaagaatgaagagtgcattcgacaagaaagggcaggatcatcttgagctaccttctggggtggggacaaaacatgaacagcagaaaccaaccaaggtacttaggaacggatgcaactggggatggggtcacgaccgactaatcgtcgccccttctctgcgctaa

SEQ ID NO: 11274 - DNA, 279 bp, Glycine max
  Peptide Sequence Number=SeqID_102959
atgaaagtaggtgcatctcataggatatcgttcatcaggggaaatggctctgaagaagctctccacgaagagcgctttgaggccatcaggggatggccataccacagggagaggcgtgtccagctcagggaggatgagtatacagactttcaggaggagatagctcgcagacgttggacaccgctagtgactcccatggccaagtttgaccctgagatagtcctagagttctatgctaatgcttggcccacagaggagggagttcgggacatgtgctag

SEQ ID NO: 11275 - DNA, 696 bp, Glycine max
  Peptide Sequence Number=SeqID_102960
atgaagcaagcattacaaggcctgattataaagatcaaagagaaagaagaccaatgtgaattaagggttgcacctaattgggtcactctcctacaaatcgatgaaaatgctttaagaactgatagtgttggttctactggcaagtcgttgttagggtcaagttcctttctttttatacctctttccaagacaaccctaagtgttctcttatcatttggtattagagctttggctgttgaaatgagagcatacatctacttgggttgtaatactgagaacaagaaagggtatatctcttgtggatcagttcaagtggagtgtacatccacttggttgttcaaagagaacaagggagggtacatcccttgtggatctttgcttgaaaaggattttacaagtcccgagacgtctcagaaatcaaaaggaagcaggcttgcgcgatccgtgaaattccgtaatgtggcggaagtcgaaaagagaatgttttttgaagctgggtttcttctggaggaagcaacccagctcgcctgggcgagctgggtggcaacctcctcccccttttttcctataaataggctgaagggggttgttctaatgatcccggatgcccctggtgaggttttcgtaagcaaatccgtgaaggttttcctccgttattcatcgttcttcatccgttcttcgttcttcaacgggtaa

SEQ ID NO: 11276 - DNA, 441 bp, Glycine max
  Peptide Sequence Number=SeqID_102961
atgttggattttgatctaggaactttcttgctgcttgtgtcacaatatgttcagtgtgcatcgaattcaatccctatccaatataaatctgaagcagtgcattcagatttattgtctgtcttttccattccaatatctgagtgtccagcatctaaccatgcaaagtcttttgttttgatgcctaaggaagaattgttcatcaaggatcaatgggcaaggcaacttggagaagaggtggatgcacatgagaatcaaggaaaccattgggagaagaagattttgaatcatctcatctctaggcctaatgttttgattgatatgcaacatgtgttaattattgatttgcatgatacttgtgatgagctagatgcatatgatttccataatcttgttttaggtcatggcattaagtccttgaattttgagattaatgtacattaa

SEQ ID NO: 11277 - DNA, 872 bp, Glycine max
  misc_feature (37)..(37): n is a, c, g, or t
  Peptide Sequence Number=SeqID_102962
atatatcggaaaggtaatccttctccggaatatcacncctttcaaagagctggattttgcaaaaaccaattttatagcaacgatttcccatgagttaaaaaccccgattgcggctatcaaaatgggggttcagcttttagggaatcagaaattcggagaacttaatgatcaacaacaggaattattgaaaagcatcaacgatgacgggcaaaggctcctggatattacaggtgagcttttaaatctgtcgcaggtggaaaccggaaatatccgtctgaatattaaaagctgctcaccgaaagaaattgttgctaccgctattaaaaatgttgaaaaactagcggagcaaaagaatatttcgatcagcaccgactttctcacaagtgaagaagatcttgtttccgcagattttgataaaaccgtttgggtgatgaataacttcctgagtaacgccattaaacattcttttcaggacgaaaacatccggatactggtagagaagtctgaagcaatgatcttgtttagcatcacagacacaggaagcggaattgatgaaaaataccaccgccagattttcgaccgctactttcaggtaccgggagaacatcagaacggaaccggcctagggctggccatttcgaaaaactttatcgaaaaacaacatggagaaatcggtgtaaaaagtgcacccaatcagggaagtacattctattttgggttgccgatatcttatgctcaaaatactgatacagatttctacaacagtgatttcaaatggaagattcaaattccaaaaaactttgaaaaagtaaataatgatgaatgggcaaagttgcaaggaagaggacaggaagtacttgaaaaaacaacgg

SEQ ID NO: 11278 - DNA, 390 bp, Glycine max
  Peptide Sequence Number=SeqID_102963
gactcaaagtcctcgcttttatctttcataggactcacgtcctcacctctatctttcataggactcaaagtcctctgtctttatgctttcataggactcaaagttctctgtgaagaagaaaatgaagaagaagattcagatgatgaagaagacttctcactctttgtgaagaaatgctacaaatgcaaccaacttggtcacatcaaagctaattgtccttcaaatgaagaatggcctgagaaaagtgataagaaaaggtatgatgaaagaaggaccaagaaggcctacattgcatgggatgacaatgattcatccgatggttcagaaaaagagatcaaccttcaaaccaaggattatgagagtgatgagaacatttctcaagaagattaa

SEQ ID NO: 11279 - DNA, 216 bp, Glycine max
  Peptide Sequence Number=SeqID_102964
atgactaccaatttgccggagtctgttaattccatgttaaaaaacacaagacattttccggtgtcatcgttggttgaggagacgtatttcaagatcgcacaactctttgctaatagaggtcaacaaactcaggcaatgatcaactccggctcacagttttctgaagtcatcttcgatgcaatgaatagcggtcaacaagaatctaatacacacatt

SEQ ID NO: 11280 - DNA, 565 bp, Glycine max
  Peptide Sequence Number=SeqID_102965
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcaagaggtttcggttttcattttcaagtgtctcgatatattgctggcctgaatcggacatttgagtcagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11281 - DNA, 152 bp, Glycine max
  Peptide Sequence Number=SeqID_102966
ggcgcgtcccattcgccattcaggctgcgcaactgttgggaagggcgatcggtgcgggcctcttccccctctccccagctggtgaaagggggatgtgctgcaaggcgattaagttgggtaacgccagggttttccctgtcacgtcgttgtaa

SEQ ID NO: 11282 - DNA, 443 bp, Glycine max
  Peptide Sequence Number=SeqID_102967
ggacttgcactacctctagagtcagaggttggtctctcaggtcctcgtgtcagcacaaaggagagttgtgttgctccctcagggaacgatccagggacggttcacaacatccctttgggggatggtcaagtcaaggttggtgttgaggaggttaaagatgcagaggctctcgttcttgtacccactgacgaggttaccttagtggggcagacacttaacaccttccttgcttggccaacacatcttgtgaagcgtttatcagaacaggcagctgtgtctctagcaaaacctccagaaagccccgatgaagaggttatgtgggatgctaccatattcggggtgtttaatcaaaacttctcgttgtatataaagcacgaagccctctctgaaattgcacccggtggtcaatgtctcagcgtatctgttatacagttgtggattct

SEQ ID NO: 11283 - DNA, 79 bp, Glycine max
  Peptide Sequence Number=SeqID_102968
ctccaccgcggtggcggccgctctagaactagtggatccccgggctgcaggaattcgatttgtggacgagcttgactag

SEQ ID NO: 11284 - DNA, 426 bp, Glycine max
  Peptide Sequence Number=SeqID_102969
atgaagcacttcactgacaccctcatcagtgccaacataggtaacaacggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11285 - DNA, 180 bp, Glycine max
  Peptide Sequence Number=SeqID_102970
atggaggttaaggagtctttgctggggattatggctaccattgcattattgagtagatatgggaggtggtgtttggctttggatgtgcagcgggtgggttttgttgctgatttaggggcggcctttgtggatgattgggtgttcttggctggtaaggtggtgggtaatgagaaggattga

SEQ ID NO: 11286 - DNA, 596 bp, Glycine max
  Peptide Sequence Number=SeqID_102971
ggacaccaggatttatttattctgcgaagtgatctcccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatttgacaagcttcagactagttctaaccctgatccttcttcagcggatctgtcaaagccttgcctctttcctcctgccgaatcatcagagacatggaatcacattactgtaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11287 - DNA, 243 bp, Glycine max
  Peptide Sequence Number=SeqID_102972
atgtccaccttatcacgtgccacaatccccaaatatgttcttaatttcttcttgtggggaccgtcggccttccctgtagcaggatcaacatgcaccactggtctctcaacaccaggtggtctagtggacaacaatcgtaggcgtgaggctttgcgtttccacttcacggcagacgtcgaagccgatgagtccgaagtagtaggaggaggaggagtgttagtgcttagctttactaagctttaa

SEQ ID NO: 11288 - DNA, 417 bp, Glycine max
  Peptide Sequence Number=SeqID_102973
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccgggcgtgcttttgccgttacgcaccaccccgtcagtag

SEQ ID NO: 11289 - DNA, 630 bp, Glycine max
  Peptide Sequence Number=SeqID_102974
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggctgcctgggcaaatcagagggctggggtaagtgctaaaagctggactgtatggcagcctattataaggaagtttgaggccaagcttgcaaaatggaagcaaagatgtgtttctatggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 11290 - DNA, 306 bp, Glycine max
  Peptide Sequence Number=SeqID_102975
atgggtattttagaaattaagatattatattttcaaaactttaaaattaagcataaattcaaaaagaaagggggagaaagtgatgagggaacggattgtcatcatcaaaaaggtggagattgtggaaacaatgtcttccaaggttattttgatgatgccaaagaatcaagagttaagcaaagtttcaagcaaagattcaagaatcaagtttcaagtttcaagattcaaagaatcaagtttcaagaatcaagaatcaagacccaagattcaagaatcaagagaagactcaatcaagataagtactaa

SEQ ID NO: 11291 - DNA, 492 bp, Glycine max
  Peptide Sequence Number=SeqID_102976
atgaagcacttcactgaccaccctcatcagtgccaacatagtaagccagtatacactccgctagcgcccaatacgcaaaccgcctctcccccgcgcgttggccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcaggcgtgaccgctacacttgccagcgctga

SEQ ID NO: 11292 - DNA, 264 bp, Glycine max
  Peptide Sequence Number=SeqID_102977
gagggtctcttaatgccttcctttttcttctcatcggagttatttcacaaagacttgccatggtaaagaagaagggggaaccaagcacacttggagagcgcagtacaacggatagttgtgcgatgatttacttcacgggcgaggtctctgctcagttggtagagctccgctcttgcaattgggtcgttgcgattacggaggaccgaaacatgccactgaaagactctactgagacaaagacgggctgtcaagaacgtagaggag

SEQ ID NO: 11293 - DNA, 694 bp, Glycine max
  Peptide Sequence Number=SeqID_102978
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgagccggtcacctggcaggggcgacagtatcagccgtatcccattcaggggagcggttttgaactgaatggcaaaggcaccagtacgcgccccacgctgacggtttctaacctgtacggtatggtcaccgggatggcggaagatatgcagagtctggtcggcggaacggtggtccggcgtaaggtttacgcccgttttctggatgcggtgaaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11294 - DNA, 348 bp, Glycine max
  Peptide Sequence Number=SeqID_102979
atgggtgaatcaacttcaataaggttttttaatggtgattttccaccatggagatgcaacgcaaggcaaaggagaagagaagaggggaggcaccatccactagggaataagccatggaagaaggagcttcaccacaaagaatgtgccttggataagaagcttgaagaggatgctttaatggaggaaaagaaagagagaaggggggagcacgaaattgaaggaataaaagagggagagaagagaaactttgaagtatgtcttataagactttcattcatcaaagttacaacaagtgctacacatgcttctatttatagactaggtagcttccttgagaagctttcttga

SEQ ID NO: 11295 - DNA, 408 bp, Glycine max
  Peptide Sequence Number=SeqID_102980
atgcctaattcaaaagggatgcttgagttgaacaacaccgaccctaggttaaacccttctgtgaggttcaattgtctagcaagtgatgatgacatggaagaatatgtcaagatgacaaacctacttgagagaattgcaaggttgaagtgtattgcatttttccttggagagtcaaaccaagaaaaactgacatctactgatgttgatctaacaaagttttgcaagaaaaatgtcacaacaatctatcactatcatggggttgcacggttggatcagtggttgatgagcactacaagaactgtgacaagcttcaatgtggcaccagccaattggcaatttaaagtcagggcacctgtcagttatgtgagggcaaccatgatcaacacaatcgcagaaattactacctaa

SEQ ID NO: 11296 - DNA, 426 bp, Glycine max
  Peptide Sequence Number=SeqID_102981
atggctactccacccagctctcctcctcctcctactaatgcagcatcacaaccggtggtccatgtcgatcatgcgaccgggaaggccgacggtccccagaaaaagaagttaacaacatatttggggatcgtcgctcgtgataaagtcgatgtgacatatgagaattggaagcaagtccctgctgctcagaaggatttgatatgggaggatattcagtttaagtctgatttgacaacaaaatggtcacttgcagtcgacaaggacagtgttgatgacactgtatgcgaaaaatacggcattaacaaggagaaatgggcccaattttgtcaaagccgtagagacccttcgtgggaggatgtgcggaaaaaggacaggttatccagaagcaaaacactacccccatatgttgtctcgtggaggttatga

SEQ ID NO: 11297 - DNA, 297 bp, Glycine max
  Peptide Sequence Number=SeqID_102982
atgacaattatcaacaaaattggcataacatacaatactatgaagaagcttgtggtacagagaagagtggaaggtgccgccgttggcaacctttacgaactccatgagcgtgtccagcacgatggagggagcggcggcggcggaggaggaagggagcttggggaggaggaggaagaaggagtgaagcgagaggagggattcgaggacgtggtgaggaggggaagaaagggaaacgaaggtgaggagaagaagcagattgttgatgtgcgaggcggaaaagaaaagctggttccctag

SEQ ID NO: 11298 - DNA, 120 bp, Glycine max
  Peptide Sequence Number=SeqID_102983
gacctcattgaagctcaaagatccagcctccactgaagccccacaagcaagcttccatcaaaaggcctacaagctccacatggagctacatcatgtggtatcaagagcatcttcgtctag

SEQ ID NO: 11299 - DNA, 324 bp, Glycine max
  Peptide Sequence Number=SeqID_102984
atggaaaatgtaattatgaaattgagatgcccgaagaaacaccatttcctagttaaccatgcattagaggaaaacgcaaggatgagcaaacatgaaaacaaatggtatgcaattttgcagatcaaaagagatgcttatgcgatgcatgatatgaatgcattttacggacacgagagcccgaaaaattatttcttcttacttgtgcatttgggggcgcagtgccccatgtgtacaattaagaaggtgatatggaccttccggcttcccgtgacaaaggacgagaccaacatacaatgcatgctagagataaaatgcggggagtga

SEQ ID NO: 11300 - DNA, 55 bp, Glycine max
  Peptide Sequence Number=SeqID_102985
atgaatcggccaacgcgcggggagaggcggtttgcggattgggcgctagcggagt

SEQ ID NO: 11301 - DNA, 681 bp, Glycine max
  Peptide Sequence Number=SeqID_102986
atgccaattcctttggaatcgagccagattcacggcatttatgacgaagacgttaaggacgctcctacttttaaatccattgcttcgaaggtaatggaaatgatttcaggctcagatttgggaggtttcaactccaacaggttcgatgttcctcttctcgcagaagagcttttgcgtgcaggaattgattttgacctgagtaaattcaagttggtggatgctcaaaccatcttccataagaaagaaccgagaaaccttggagccgcttatcagttttattgtggtaagacattggagaatgcccactcggctgaggctgacgttatggcaacctttgaggtattagatgcccaggtaggaaaatatgatgacgtgccgaatgaaattgctgctttgagtgaatttacatttcataataagaatgcggatttagcagggtttatcggattcaatgagaagatggaggaaactttcagcttcgaaaaaggccttaacagcttcatagctaatgagcagctcattcagtcggactggctattgtctcaggcagtgggaggaattcagcttcaggtttttgaagacgacctgggtaaagcaacggaaattttgaaagattacaaagaaaacgagaatatggctcttgaagtggagcataccatcgaagatcccgaattcgatttt

SEQ ID NO: 11302 - DNA, 285 bp, Glycine max
  Peptide Sequence Number=SeqID_102987
atggccaagatcatgctgaaggtcgcggttccgccatatgctattttaaacaccgttaacgccaaggaccagatttacggtgaagttaggaggttatttgctgtgtatctcacttcgcacaaagttacctacaacagcctggatgttccaagcaccatgtattattttcttaaagacaaaggctggactcatttgcatttggaggacattgcagaatgttggcttgtgttcaatcaccggagaaagacagttaaaattgggagctggatgaaaatatttttgtga

SEQ ID NO: 11303 - DNA, 456 bp, Glycine max
  Peptide Sequence Number=SeqID_102988
aggactacacgtcctcaccttcagagggttacatgtcctcaccgttagagagctacatgtcctcaccgtcagaggactacatgtcctcaccttcagaggactacacgtcctcaccttcagagggttgcatgccctcatccttagagggctacatgccctcgccttgccttcagaggactacacatcctcgccttcaaagggcgacacgtcctcaacttcagagggctgcacgccctcacctttagagggctacgctttccttttatcagttcttaagccaccccctgattctggaggagggccaactgtgcgagcacaatcagagagggaggatatcacggatcgcgcccacaagacacccagtggacccggaggagcccaacagggccctatggtttccagcccccccccccggcctctatcagtcctacagggtgtccggacccccccagcaag

SEQ ID NO: 11304 - DNA, 470 bp, Glycine max
  Peptide Sequence Number=SeqID_102989
atggcgacaggaactcgacgtcacggagccaccgaagcacccccgacaccaattccaccttcattgtcatcaaccacactattctcatccgatgaacaacgtctaagatactcatctcttttttcctctaggcaaattcttgatcccaagatgaatattgatgcatctgtcttttatgagttaactcaattgtccaatcaaggtgtaccttttgagggcaccattgttgatgactggaaatttgatttttcaagtcatgatgcccgccgaatggtctgcaccggtcaggcggaaatgaccggaagattgcttgccggatcattgactctcgaatgtcacatcatgcattatctgattgtgcgtattcttcttctccattcatcaaatcttgctcaggtctctaaggaggacctgatagttatgtgggcattcttaaccagtcgtcagatcgactgggcacatctagtcag

SEQ ID NO: 11305 - DNA, 699 bp, Glycine max
  Peptide Sequence Number=SeqID_102990
atgctttttttacttccagcctatttatcagaaaatactcctatcaatcatttttcaccggtgatgaatgattatatcatgcaaaccgattatttttttgtggaaaatgaaaaaactgcccgaaaggtcattaaattctttgctcctgaaaaaaaacaatccgatctcaaactttttttactggataaatacaccgagaatgcggacattaaagatgctcaggaactcatgttaaaaggtcaggattttggattgctttctgaagctggacttccctgcattgctgatccgggaaatctgattgtgaaatggtgccatgaaaaaaatataagagtaatacctgtttcaggaccatcttctattattctggctctgatttcaagtgggtttaacggtcaggagttttcgtttaacggataccttcctattgataaaggagaaaagaaaaaacaaattctgcatttggaaagcctggtacagaaaacaggatattctcagatttttatggaaacgccctatcggaataatccccttatagaagatctgtgtaaatttttatctcccaatacaaaattgtgtatcgctgctaatatcaacgatcctgagcatgaatttattcagacgaaaaccattaaagaatggcaaaagaaaaaaccggaacttcataaaatccccgctgtatttgtgcttggcaaataa

SEQ ID NO: 11306 - DNA, 592 bp, Glycine max
  Peptide Sequence Number=SeqID_102991
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcatagtcttattcccttactgagaatgcccctgcttcgcccctgttttccgtcctcggcccccgttatacctaccaaaagaaccgattccaggaccaagtcgttccccgctggcttggtgaatgctgtcgttcagcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11307 - DNA, 228 bp, Glycine max
  Peptide Sequence Number=SeqID_102992
atggcatttttccaaagctacttggactataaggctcaaaacgcacaagtgactaatgctcttggaaacggaaatttcgcgcacactccagatgtcttctcaaagatcccaacagtcaaatcatgcatggctccctacaaagctctgtatggtagaaggtgtaggacacccttatgttggctagatcccaaagagaacctcaccttagaacatgaagtggtacaataa

SEQ ID NO: 11308 - DNA, 636 bp, Glycine max
  Peptide Sequence Number=SeqID_102993
ggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataagcttttccttgagcttcaggctttagcatttaggttgttcatcatgttgttcatattgctcatctcatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11309 - DNA, 465 bp, Glycine max
  Peptide Sequence Number=SeqID_102994
ggaacaaaagctggtaccgggccccccctcgaggtcgacggtatcgataagcttgatagagcggttgttcgaagtcggggcaaagggggggcggcggcagtagaaggcaaccctcatgttagttgggctgcccggtcgatggtcagatgcgcaccccgtgttgctactggcagaatgaaacgagcaacgaaaggcacgtcagccagtcccccgttctattgcagtggagataggggaaccagcagcaagttcagtatagttcagtgccaaggccaagttggagttcaggctgggggagccaagcttgcacctagtagttggggggttccggaggtgagggcggagggttctactagttccaaggtgtttgcgacgagagctgcgtggaagctagtaggtgagagtcagaccaattactatgcgctaggccaccacgttgttccagtagcagttatagtgcaatga

SEQ ID NO: 11310 - DNA, 234 bp, Glycine max
  Peptide Sequence Number=SeqID_102995
atgaaggaacaagcacaacaacaatggggagaagtactcaacagtagaaaaccatcaagaaattcttttgctaagcgcaagcctcgcgctaagcgcatctttgttcatgcgctaagccgcgagtctcaagcgcttagtgcccaacccttgcatctgaggctgatttggtccgctgagctggccaaggttgagctaagccaacttcaattcgatctggatttggctaagcgatag

SEQ ID NO: 11311 - DNA, 598 bp, Glycine max
  Peptide Sequence Number=SeqID_102996
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatcatcaaccctaatttttgcttaggtcgccctttcgggttttcaacccaccggggaacctaccaggtgaggatttctgatctgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11312 - DNA, 345 bp, Glycine max
  Peptide Sequence Number=SeqID_102997
atggttcaagtggaaattagatttcaagaatcaagattcaaggttcaagcttccaagaatcaagatcaagattcaagactcaagattcaagaatcaagagaagacttaatcaagataaggtacatcctttgtggtacaagtagagggtacatcgacttgggtttgactgagaacaagagagggtacatctcttgtggatcagttctagtggagggtacattcactaggttgttcaaagagaacaagggagggtacatcccttgtggatctttgcttgtaaaaggatttttacaaggttggaaaagaaatctcaaggaccgcaggtcgcttggggactggatgtag

SEQ ID NO: 11313 - DNA, 252 bp, Glycine max
  Peptide Sequence Number=SeqID_102998
atgaccgatgataatgccacctctagcaccaccatggacaagatgagtgatttcagtgataagctaatgataaagtttctgtggggatatgaaaatggttatggggaggtctttgataaccaaacttttaatgcaagcaagctgatggatgaagcgcttcttctagtctggtcctggcttaaagctatggagaaagatttcgatacacattttaatcagtggtcttccaatttgacagatgcctttgtgtaa

SEQ ID NO: 11314 - DNA, 195 bp, Glycine max
  Peptide Sequence Number=SeqID_102999
atgaagaagctaaagaagaacaaggatgcttacaatcctcagaagttatggattatgtgcttagcgcagcaaacgctcttagcatgtagtctgacgtcaacaattgcattaaagtgccccacgcttattgggaatgatccccattgccttgtaattggcaatatctgcaaaccatggcctctcacccatagctag

SEQ ID NO: 11315 - DNA, 135 bp, Glycine max
  Peptide Sequence Number=SeqID_103000
atgactactaaatgcattcttgatggtagaatgccatatatagcacatcttctctttgtgaatgctataagagataataccatcgatcctattaaagacgaggtacttggtcctctgaattcttctgaaaaataa

SEQ ID NO: 11316 - DNA, 172 bp, Glycine max
  Peptide Sequence Number=SeqID_103001
atgccctggggttcctccatgataagcacacattgcgttcgagtcgtatcctcggaaaaatggaggttgaggaaacctagcaggggctttttgctgcaaaattcccttttggttggtgctttggttcgtgctatcaagcttatcgataccgtcgacctcgagggggggcccg

SEQ ID NO: 11317 - DNA, 557 bp, Glycine max
  Peptide Sequence Number=SeqID_103002
atgtcggtggctccttccttcctttcgcttggatgcgcatacctccacggacctgcgtggctgtttttgtatggaaatggaatagaccttcctcatatgcggattgcatgcatatgtgctgctcttcacccccctcatcgccaacttccagccggccttggtctatcatttgttgcaacaggtctcctactgctaaacatgcttccatataaaccttctgggggtcgtcacgtccttcaaaggtttggacctgcgcggcctacccgactagatggcattaatcgctccccctccatgattggcaagcgggccaagcactgtttggttgagtggcccgaggttttcccatggtatgcgcaggtcgcatcagggttataccactttgggaaaggaggctgttggccttgggggaaagttccttgtcgtgttggaaccggcgccaaagtggatattgctggccgcgcgagttggggttggagccggagcttggggggctccctctggatgggcgcgagtgccctagcttgtacgagtgctgagttggaggagtccccggc

SEQ ID NO: 11318 - DNA, 148 bp, Glycine max
  Peptide Sequence Number=SeqID_103003
atggaggagttgattaacaaaacacaactttctcctaaaataatcccaacgtcatcacatcggctcggtagctcctcaacagaatctcacttccggcaccctactgctgtcattctactcccacgaacaaggttcgcgatcatcgcag

SEQ ID NO: 11319 - DNA, 228 bp, Glycine max
  Peptide Sequence Number=SeqID_103004
atggataattcatcaacaagtagggaacacttgaatcccttaaatttgtctatgccaccaggcaggttgatatactcatcagaccattttgcaaaatctttaagcaaatggttgcaaaccaaagaccatgaatctttacctattcctaataaggcaacaattgcacgatatctacagtttgttggatcaagtggccttgaaataattaagaagggggggttgaattaa

SEQ ID NO: 11320 - DNA, 447 bp, Glycine max
  Peptide Sequence Number=SeqID_103005
atggttggggaattatctagtaacccaaaagcaaagctacctggcagaaggaagcaggaccaaaaaactggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11321 - DNA, 426 bp, Glycine max
  Peptide Sequence Number=SeqID_103006
atggcggcagcgcggcctgacttcgtcacctattcaccgcaggattctctggatgacatccggccaaccgcagacagcgtcgggctgatttacccggttatcacccttgaagcgccgtatcagcacacccgtactcaccagatgatcgtgggcaatgacgccacgccgacccaggaagccaactggtcagtgcaaaattacgtcacccgcgcctacccgccaacctttctggcgcaggcggaggacgatcatacctccaaccctcataacaccgagctgatgcgcgacgcctgccgccgtatgcgcgtgccggttgagctgattgaactgagcagcggcggccacggctttggcctcggtaaagccggcacccccgccgcgctgtgggaccaggcgtatgtccgctggctggataagctgggataa

SEQ ID NO: 11322 - DNA, 248 bp, Glycine max
  Peptide Sequence Number=SeqID_103007
atggatgtaatgttctttctttgctgtactggtgaaattttatcttgcacgctttgggagaattactgtatgcagttcctatcctatttgaatgagcgtgggaatgatgggccgatggctattatattgacacatgccagaataaaagatgcgcagggaagttatccagcttcagtgagcaattccttcaaggcatcaaaactattgattaataatcctatattggaaattcaggaatttaaagaaag

SEQ ID NO: 11323 - DNA, 753 bp, Glycine max
  Peptide Sequence Number=SeqID_103008
atggatatgaatatgggatccttcatttctagtcagattacactcatggcccaacatgactcctcgaggctcgactttcctgccctaatcattgctttattcacttttagaggacctaggaaggcgaggggtaagagatctaaggcctcttccacagcaccatcagaggctccagcacctccttcttctacacttcctccctcttcctccatagatatcccaatgattcctccagcaccttcacatattccacttccagctccaatatctacaggtccagcagattttattttcactcctcagatgttgtactccatgctccagagcatccatagggggcagtccatcatcacacagagccttcagggcttgggcttgccctccattatgagcatggaggagtttgatgcacaggtggcctggccaggagaccagccttcttcctctggagggggtggggcctccacagcccaggagcctatgactgaggagcctttaggagtagcagtagcagaggatgaggatgagttcactcctcctgggccttttgattttgttgcaggtacacatacggctcaggaggaggaggctattccaaagccatctccagcccctgtgcatgcacctgatgatgccacactagtggtggagcctgagcagactattcaggattctttagcagctccagcactggatcttaatgaagaccaaccacaggaggagcaggacgtttacattttttttgcattatga

SEQ ID NO: 11324 - DNA, 393 bp, Glycine max
  Peptide Sequence Number=SeqID_103009
atgggatcgagtcaggcgcctaggctcaaaaagaggttctatcaagtcaagatcaagagcctaggagtcgctagtttgaaagagttaggacaattgatgggtcaactccagcgacgagcctttcgcaagacctatggtaagatctgggacctaaccatggcgaagttaacacccacggtggaagagtttgaagagatcctgggatgccctatgggaggaaggaaaccgtatcttttctcaggcttctatccctcattggctagaatttccaaaatagtcaaaatctcgacacaggaattggaccgaggaaagcaagtcgaaaatggggaggttggagtaccgaggaaatatttggaagcaaaggcaagaaccttggcaagtcaagatgaatag

SEQ ID NO: 11325 - DNA, 586 bp, Glycine max
  Peptide Sequence Number=SeqID_103010
ctgtccctcctgttcagctactgacggggtggtgcgtaacggcaaaagcaccgccggacatcagcgctggcaagtgtagcggtcacgctgcgcgtaaccaccacaccccgccgcgcttaatgcgccgctacagggcgcgtcccattcgccattcaggctgcgcaactgttgggaagggcgatcgtcacgacgttgtaaaacgacggccagtgaattgtaatacgactcactatagggcgaattggagctccaccgcggtggcggccgctctagaactagtggatcccccgggctgcaggaattcgatagaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11326 - DNA, 273 bp, Glycine max
  Peptide Sequence Number=SeqID_103011
ggcggaaaaacttttatgctctcgtttcttgctcgtatcttcgagaaatggcgccgcttctttgagttcggtaatctattccggacaacagcaagggagcgaaatgggagcagcctaaaccgtgaaaacggggttgtgggagagcaatacaagcgtcgtgacccggggggggattgtacggccgtattcgcggctttgcctactgaggcggccgctctgtaccccgccctttcttttggcccttctaatgaaaatttgatgatagaagtttga

SEQ ID NO: 11327 - DNA, 610 bp, Glycine max
  Peptide Sequence Number=SeqID_103012
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcataagaggggatttgaagaaaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11328 - DNA, 328 bp, Glycine max
  Peptide Sequence Number=SeqID_103013
gatcgcacccacaaagacacccagtggacccgaagaagtccaacagggccctggggtttccagctctggttatgggcctctatttagtcctacagggtgcacgtccccccatcaaggggtcgcgcccgcaagacacccagtggacccggagaagtccaacagggtcttgaggtttccatctctgattacgggcctctgtcaattctacagagtgcccatcacccctagcaaggtcatcaggcctcctactaaccgagctttcatcaagaagtattgcgcccccaggcaggcagagggcgagacaccacaacaacctggggatggctag

SEQ ID NO: 11329 - DNA, 237 bp, Glycine max
  Peptide Sequence Number=SeqID_103014
atgaaaaccaaaaaaacaagaaatgaattgaaagtctcaaatttggaaatttacccgttgaagaacgaagaacggatgaagaacggtgaagaacggaggaaaaccttcacgaatttttcttacggaaaattctcggaagcgttacggaagcacctcggcttcgattttcttcacggaaacaatttttttcacccaaaacagctgaaatacatagccagggagatcagggacccttag

SEQ ID NO: 11330 - DNA, 461 bp, Glycine max
  misc_feature (4)..(4): n is a, c, g, or t
  Peptide Sequence Number=SeqID_103015
cgcncaatacgcaaaccgcctctccccgcgcgttggccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 11331 - DNA, 264 bp, Glycine max
  Peptide Sequence Number=SeqID_103016
atgggtgcggatcatgcgcaccagcatgaccaccttgacccagatgtggatgacgttgctgctcagcaatgtatgccacccaccaggcaccctctggacccggataagtctaatagggccctggggtttccagcattgatcatgagcctctgccagtcattcggggttcccgtcacccctagaaaggtgatccgaccgccgatcacccgggctttcattgagaagtattgcacgcctagacaggcgcatggggatgcacgttag

SEQ ID NO: 11332 - DNA, 414 bp, Glycine max
  Peptide Sequence Number=SeqID_103017
atgaggattgtttgttatactccggctctttatgtatggttggtttcacacctttttcgccaagaggtgaggcatgcttgcctgctagaaagccactgttcatgcacagagaaaggaggggaaaattgggaccggctcttagcaaacaaagaaggagcgtttgtcaactggttccctcgatggaaagaaggaagaaccggggttcttatttcgtgcggaggatttccgaatgttcccttgatggggaaaaggggttgcattagttacaatcccgttcttgttagaaggcaacttggctaccccatgagaggggcaccacaaggggaagagcacggccggaacaagttccgaggggctctgtggggcagcaacagcaagcttaagctccggagagaggaaagggaccaatcatga

SEQ ID NO: 11333 - DNA, 804 bp, Glycine max
  Peptide Sequence Number=SeqID_103018
atgggtactatgttcccagaaactggtggctatgtggcttgggtttcatctaactgggctttccaactagcaattcctagaataaaaccaactaggtggatcatggtggatttgaacaaagtaaactggggtttgtacatgaacactctcttctggaatttgaactattgggactcaattagtaccctttcaggagaagtggataatcctggtaaaaccctcccaagatctcttttctatgctgttatgttggttgttttggggtactttttaccacttctggtgggaactggagttatgctagttaaccgtgagatatggtatgatggttacttctcagaagttgctagagtgattggaggggtttggttaaggagttgggttcatgcagcatctgctttgtcaaatatggggatgtttgtggctgagatattttgggaatggcagaaagaggcatggttcctgagttctttgctaaaagagatagttgctgctgagaactttttgtactgttttgggatgcttatggagtttgtggcatttgttaagttaaggaggaaatttccatatgctgagaggctttataaagtgcctgttggggaaacgggagcaatattgatgtgtgtgcttccatcactactgatatttgtggttttagctcttgcttctttcaaggtatccatcataagcttctcagctgtgatcacagggcttgttttgaggccttgtttaaaatatttggagcagaaaagatggcttagattctctgataatcctgatcttccagatatttatgctacctag

SEQ ID NO: 11334 - DNA, 1713 bp, Glycine max
  Peptide Sequence Number=SeqID_103019
atgatgaacaagaggccattaaccgccgtctacaacaaggcgatccccgatctttgcaatcgagaactcggccaccttcccccaaggaatttcgctctccgtcttggcgcctccgaggatcttgtccttcgacttgaattactgaggaatctgcaaaaacacagaggttgtgtcaacactgtgagcttcaatgcagatggtgacactctagtctccggttccgacgattggggggttattctctgggactgggaaactggccgcattaaactctccttccattctggtcattctaacaatgttttccaggccaagttcatgcctcactctcatgatcgtaccattgtcacctgtgctgctgatggacaggtgagacatgctcaaattcttgaaaatggacgagtcgaaactaagtgtctggccaagcatcagggaagggctcataagttggctgttgagcctggtagccctcatatcttttatacctgtggtgaagatggattagtgcagcattttgatttgagaactggggctgcaacagaactttttacatgccagccaatcaaggataggtggagttacatgccagtcatccatcttaatgcaattgcaattgatccaaggaacccaaatctctttgcggttgctggctctgatgagtatgctcgactttatgatattcgcaggtataaatgggatggatcaactgattttggccaaccaaccgacttcttttgccctccacacttgattggtgatcagcaagttggaataacaggcttggccttttctgaacaaagagagctgcttgtgtcatacaatgatgagcttatttacctttttacccaagatatgggtttgggaccaaatccccctgatcctgggtcccctaaatctatgaacagtgatgcaagtgaaattggatttagtcatggatctgtgtcatctcaatctaacatggatgctgatgacaaaatcaccccacaagtttttaagggacacaggaattgtgagacagtgaagggtgttaacttttttggacctaaatgtgagtatgtggtgagtgggtctgattgtggtcggattttcatatggaaaaagaaaggtggtcagcttattcgtgtcatggaagcagataagcatgttgtgaactgcattgagtctcatcctcatacaatggttcttgccagcagtggtattgagaatgacatcaagatatggactccaaaggcccttgagaaagctactttgcccaaaaatattgagcagagggttcacgtgtttgatcatcttcattggtttacaattggtggtggctatgatgacgacgatgttatgtttgatgatgattatgaagttgatacatctgacaatgatgatgatgatgaggaggaggaggatgacgacgataatgattatagcgattatatcaatgattatgatgatgattatgattgtgatgatgttgatgacaacaatggtgttgatgataaaaatgatgacaatggcaacgatgataattttggtggtggttacctaatgcaactgatttcacttccaagacgaagggtcaggacagaaagcaatggagaaaactcatctacagatcgagaccttctacaattgatactgacattcaatgccaatagtgacagttctaacgaagatgatgacgatggtgatacaaccagccaagacgacttgttcagttag

SEQ ID NO: 11335 - DNA, 6663 bp, Glycine max
  Peptide Sequence Number=SeqID_103020
atgggaaaggcaaacctgtcgagtctagttcacgaactccgcatagcagcagcatcctcttccactcccagtcccaacaatacctcagacgacgacgctttggaagtcaggttccgcaccgttctccccaatcttctccacgcctacgtcctcccttcttcctcttcctccggtattctctcaataatgcttctttctttcttctctttctctttctcttatactgatatcatttcaggcaatgagagagaagtcattgctgtagtcaagcttatctctcacaccgccagaaacttccccggagtcttctaccatggcaaggctacctcctctattctacccatcctcgctcgaattcttcccttcttcgccgaacctctcttccgatctcgccacggtgtcttcttcgaagctaccggttctcttctctccttgcttcgctccggagcacgagatgcttaccgccagttttttgtcgattccatgtcgctcattcaagatattccatacgtggcttcactcagtgttaatgttaatggatcctccaggtccagggtgacgctcaagtgtttttgcgactccttctctggagttgaagaccttccatccaccaacaggctggtcgatggatgtggtttattgattgacctcaccgcccgaaccagatggcaaccctttgcaacttggattttgaagcttgccagtaaatgtctaactgaaggaacactctatgttgagggattgatccacgcatcctttatttctgctgtgtgttctcttttatgctacggggatgctgacctgcatgtggcatgctttgactttgtacatatcattgggacggtcacaaactatgatgtcattccttatcagaatttaatcctgtcaatagctactatcttgaatttggacaaggaggggcttcctgttttcagaaacatggcttatgattcatcgttgggtatttgcctgaatacactttactctagctgtcctgaagatgttgtcaaattaacagctgctgatttagtcagtgtattccttcaatcgatgtggagaaccaaaagccagcaacttaaggcagcaaatggttcaagaggatctaatagtattccttttcaggttgcgttatgcggtgcctatgctaggattgctcaagtttgtccccctcatatctggaagccagaatatctcatatctgcactttaccattcggaaccatgtttgcctctgatagagtgcttccatgtagctctgtctacacttggcccacatcttgtagggggaattcgaggaaacattaaggatttaaccattttagcatctggagataagtcaactgaaagcatgaggatttgccaaaaaaggcccattcaggatatagataatttaagtatcaagagacaaaaattgaatgaagaaattgttgttgcagatgccagtcttgaggtggaatgtaaaagtagttacattgttacttaccaaagagtagaaggttatgctagccatatgaataaatctcttctttcatttgttgaatcattaaatgctcctactatcagacccggttctttgaggccagatattgctttatctgcacttagcatgctatgcattgccttttctatttatccagagacagatctgtctctcagaatctttgagcagatgcttgcatggcttccatggatagctgatcaggcaaaacaaggaaactcaattaccatagatatttccacatacctagaaggaattcacagtgtgttgcttgtgcaaaatgcctctctcaaagaacacaacccgttagatgatgagaattaccatgtagaccttatacttgtgcttaaacttccatggactcatatgcttgttgatctgggtcttcatgatgaagctgaagaagtcagaactgaagctgccatttctattccagtgatggttttgtggtctggtcttgatgtatcatctcctgtctttgaaataatggagagcaaggaattgagagaagcattttgcagtcagattagattctttgtggacgatcttattttgagttcaattttttctggaaatgctgacaaaagcaaggaacaaaaattcctggatacaattaaacatgccatgacagtagctgatggtccacatatattggagactttaatggaatgtacagctgaaataatggtcgctgtcagtatagatagcaaactgttcttatgttctcttatactgttggttgatcaacttgatagcacacatgtgactgtgagaatgaatgcatccagacttgccagccgcccagtcttagtgagggagtttgcagaagctgtttttggtgttgagaccaaagaacttgtcaagaaaatgattccttttgttctcccaaagcttgtggtgtctcagcattataatagtcaagcagttgacactttatatgagttggccaagtgtttgaacactgatatggtgcctctgatagttaactggctaccaaaagttcttgcttttgctcttcatcaaactgatgaccagcagttaatttctgccgtgcagttttaccatgcacagactggttctgacaagcaggaaatatttgcggctgctttacctgctcttctagatgaacttgtatgctttacagattgtggtgattcagaagagataaatagaaggttagcaagagtacctcaaatgattaaaggcattgctaaagttctcactggtgccgaagatctcccagggtttttgaggaatcattttgttggccttcttaacagtatagacagaaaaattctccatgccgacgatttcatgcttcggagacaagcacttgaccgtattgagatgctgattagaatgatgggttcacatcttaatacctatgtgccaaaattgatggttcttcttatgtactctatagataaagaaccactgcaaaaggagggtctgtctgtcttgcattttttcataaagcaattggctaaagtatcaccatctagcattaagcatattatttctcaagtttttgcttcccttcttcccttcctggagagagacaaagaaaatccctcaatacatttggataaagtggtaacaattttagaagaacttgttcttaagaacagggttatcctaaagcagcatatatgtgagttccccccgttgccctgcatacctgctttgatagaagtgaacaaagcaattgaggatgctcgtgggacaatgactttgaaggatcaattgcgagatgtagttgatggtttaaatcatgagaacttaaatgtgaggtacatggtagtgtgtgagcttcgtaagcttctgaactcaagatggaaggatgttactgctcttatcactgctgaagcaggttcagacttggatgtcttgagttctttgatcacatcattattaagaggatgtgcagaagaatcaaggaccacagttgggcagcggttgaagctagtctgtgctgattgtcttggagcccttggtgctgttgaccctgcaaaagtgaaaggtttttcatgtcaacgtttcaaaattcaatgctctgatgatgatctcatatttgagctgatccacaaacatctagctcgggcttttagatctgcacctgatactgttattcaagactctgctgcattggctatacaggagttgctaaaatttgctggttgtgaggcatcactggatgaaaatgcttcaactactacatcacaggcacaaaaggatgaagataatcacaaagctgtttcatctaagatcaagagtactaatggtagtaaagggatgaataatagggggcagaaattgtgggatcggttctctaattatgtgaaagagattatagccccatgcttaacatctaggtttcagcttcctaaagtagctgattcaacatctgctggccctatttaccgcacttctatgtcttttagaagatggattttcttttggataagaaaactgactgcacatgctactggatctcgtgcaagcatctttaatgcttgtcgaggtattgtgcgccatgatatgcaaacagccatatatttgcttccatacttggttctcaatgctgtttgtcatggtactcaggaggcacgtcaaggaataacagaagaaatcctgtcggttctcgatgcagctgcatcagagaacagtggtgcttcagttcatggattcagtggtggtcaaagtgaagtttgtattcaagccgtgtttactcttcttgataacctaggacaatgggtggatgatgttgaacaagatcttgctctttccagttctcaaccaatggtttctaggcagcaaaagtcaaagggtctaagttcaaattccttgacagatcaggaccaactacttgttcagtgtaaatatgtctcagagcttctgtgtgcaattcccaaggtgactcttgctagggcatcctttaggtgtcaggcttttgcaaggtccttgatgtactttgagtcctatgtgagggaaaagtcgggtgctttcaaccctgctgccgagaggagtggcatatttgaggaccaagatgtttcacatctcatggaaatatatagctgtttggatgagccagatggactatctggcttgtcatgtttaagtaaatttttgaggttacaagatcatctattaatgaacaaaaaggccgggaattgggctgatgttttaacttcctgtgaacaagctttgcagatggagcctacctcagttcagagacattctgatgtccttaactgtttactaaacatgtgccaccttcaggccatggtcactcatgttgatggtttaatttctaggatccctcagtacaagaaagcctggtgcatgcaaggtgtgcaggcagcctggaggcttggcaggtgggatttgatggatgagtaccttggtggagctgaagaagatggtttagtttgttgtagctctgaaagtaatgcttcatttgatttgaatgttgcaaagattctccaggcaatgatgaagagggaccacttctcagtagcagagaaaattgctttatcgaagcagtcactaattgctcccctagctgctgcaggaatggattcttacatgcgagcctacccatttgttgtaaaacttcactttctacgggaattggaggacttccattctattttgggtgatgactctttcttagagaaatcgtttgacttagatcatcaagctttctctaaattagtggacaactgggacaatcgactaaggtttacgcagtcgtcactctgggctagggagccactcttggctttcagaagactggtttttggtgtaagtagtcttggtgctcaagttggcaattgctggcttcaatattcaaaactatgtcgcctggctggtcattatgaaacagccaatagagcaattttagaagctcagtcctctggtgcaccaaatgtccacatggaaaaggcaaaacttctctggagcacccggcggtctgatggtgccattgctgtgttgcaacaatctctcttgaacatgcctgttgaggttttaggctctaaaacaatatcatctattactagcctttcccttttaccacttaatccacagcctattgtttgtgaaagtcaggccatgaatgagaatagagatattgcaaagacccttcttctgtactcaaggtggacgcattacactgggcagaaacaaaaggaagatgtaataagtctttatactagggtgagggaactgcaacccaaatgggagaaagggttcttttatattgctaagtattgtgatgaagtgcttggtgatgccaggaaacgccaggaggaactgcttggtgatgccaggaaacgccaggaggaaaattctaaacttggtcctagaagggttccttcagcaactattgctgttggttcatcaaacttgaatggtgagaagccttggtggtccgatgttcctgaagtgctgttattctatgctaaaggacttcacagaggacacaagaatttatttcaggcacttccaaggttattaaccctgtggtttgattttggaagcatgtatcaaagcagtggttcatcaaacaaggatttaaaggatgtacatgcgaaggtaatgagtattgtaagaggctgtttgaaagaattaccgccataccattggttgacagtgctacctcaattggtttcaagaatttgccaccagaatgaagaaattgttcgactcgtcaaacttatcattacctctgttctccgccagtatccacaacagggcctatggattatggctgcagtttcaaaatccacggttccttcaaggcgggaagcagcagcggaaatcatacaagctgctcgtaaaggtttcagcccaggaagtaaggagaacagtttgtttgttcaatttactaccctgattgatcatctgatcaagttatgcttccatgctggccagtcaagagcaaagacaattaatctctcaactgaatttagttctctaaagaggatgatgcccctgggaattataatgccaattcaacaatctcttactgttaatcttccaacatatgatgggaatctgggtgattcacgtatgtctaatatcttttcctccacagaccttcctactatatcaggcattgctgacgaggcagagattctttcgtctcttcagcggcctaagaaa

SEQ ID NO: 11336 - DNA, 213 bp, Glycine max
  Peptide Sequence Number=SeqID_103021
atgtggcatgcatgccatggtgaggagcttggggctgatccctatggcacttcagatgggttatatacacctgattatgatgatgtggatgaatttgagcagtggcttcttgaagcagatattgacagtgactatgaagagatgggcgatgctgaaaataatgatgaaatggttgtgatttgcgttcaaactcgatctcatgtctttatatga

SEQ ID NO: 11337 - DNA, 2721 bp, Glycine max
  Peptide Sequence Number=SeqID_103022
atggaaaataagatgatagaggagaaggatgctcaataccaaaaccttggtgaaagtggcggcgtaggaggttcttcttccgttcaagaagttgcggcaaagaagcatggcagaaaaagtaagaaggagaaggaggacatgaaaaggaaggagatgctagaggacaatttgttggaggagaaagatgttcaagacaaaaaccatggtgaaaatggtggggtacctgataggaggcacggaagaaaaagaaagacgcttaaggaagatgatggtgagttgcctgcggattctccaggaagtggcattcagaaacactatagtctcagggcccctaaagtcaatacagaagccgtgatgccaaacatcagcaagaaagatcctaagtgcattaaagaggagtccttaatgtgtcatcaatgccagagaaatgataaaggcagggttgtgagatgcacaagttgtttatctctgtgtccccactgcattggcaaccaccaatctggcagcgtcttaacagtgctgtatcctcatttgaaagaggattatattgctgaggcatgtcctgtgtgccgtggtaattgcaactgcaaagcatgcttgagatccaatgaacttattaaaaaaatgaagaaaaaagcaaaaaccaatgaagatgagaaggttgaactctctatgcatttgctgcaagtacttcttccctatttaaggctgctggatgaagaacagatgattgagaataagacagaagcaaagatacaggggctctcagtctcagagctaaatatagtacaggcaaattttgatgaagatgagcgtgtgtactgtgacaactgtaaaacgtcaatatttgattaccacagaagctgtacaaaatgctctttcgacctttgtctcatctgttgtcgtgaacttcgtagtggggagcttgtaggtggtgcagatccaattttggtagagtttgtctgtcagggtcgtcattacctgcatgatgaaaaagaaagtaaaagtgtaaaacgaaatgaaccaaatgttgttgctcctgtagttcgtgaatggtcaagatctgggtggcatgcagaaagtaatggtagcattccttgtccaaaagtcaatgatgaatgtaaccatggttttcttgaactgagaagcatattaggtcaacattttatcaccaatttagtgcataaagcaaacaaactggcacaagcatacaagcttcaagatgtagttaagatacctgacaacttctgttcgtgtttgaggcttgatagaaacacagatgctagatataataatatgaggaaggctgcttctcgggcagattccggtgacaactatttatactgtccaagggttgtagatctacaggatgaggatttaaggcactttcagtggcattgggaaaagggggagcctgtcattgtcagcaatgtgcttgcaaaaacatctggtttaagctgggaaccacttgtcatgtggcgtgcattccgtcagatgactaagaccaagcatgaacaacatttggatgtgaaggcaattgattgcttagattggtgtgagggagaaattaatatccaccaattctttactgggtatacagaaggtcgtgaggattggcttcgctggcctcaaatattgaaattaaaagattggcctccttctaatttatttgaggaacgtttgcctcgacattgtgcagagttcatatcttccttgcccttcaaggagtatactgatcctctcaaaggttctcttaacttagctgtgaagttgcctatgggttgtctaaaaccagacatgggaccaaagacatatattgcttatggatttcatcaggagctcgggcgtggtgattcagtgactaagctccattgtgatatgtccgatgcagtaaatgtgttgactcatattgctgaagtgaaattgaaaccagaccatcttattgtcattgaggagttgaaacaaaagcactttgaacaagacaaaagggaactacttggtgatgatcagaatagagaaactagtgttgacatgcttaataatacatcttctactaatgctttggataagcaaaacagtgtccaagtcatggaacacaaaggtggattatgtgatggaaaagaagtgtatcagttccatcaaccctctggtggtaatgcggttgccattgctaatgaggatggcctttcatgcagatcagagcttaaagaagttgacaaagtaaaactaaagcaagaaagtgatatgttgtctgcgggggatggttcagaaggtgctctctgggatatttttcggaggcaggatgtacctaaattgcaggaatatctgaggaagcatttcagagagttcaggcatattcattgctgtcctttaaagcaggttattcaccccatccatgaccagaccttctatctgactgtggagcataagaggaagcttaaggaggagtatggaattgagccctggacttttattcagaaggtaggggatgctgtttttgttccagctggttgtcctcaccaagtcagaaatctgaagtcatgtattaaggttgcattggattttgtctctccggaaaatgttggggagtgctttcgtttgacagaggaatttcgcacacttccaattagccatgcgtctagtgaggacaaattggaggttcctggagtgattaaaaatgctgcaaattgtcatttttctgttggattcaagctgccataa

SEQ ID NO: 11338 - DNA, 657 bp, Glycine max
  Peptide Sequence Number=SeqID_103023
atgcagacctcacttcttcataatctagttgttggaactccaatcatctcagctacatatgataagcttcaaacgccagttaacagatacttactggatcctgccattcaatgtcactactcaaccacaacatcaaagcaaagtagagtatattcagttgcgaacaaacttggaaggaagacgggtagtctttcacaaggagtccaagaacatggtgagtatccttgccttatgaacatatctgaaactgttaagaggaagttaagcttaggagctcgcattcttcaagtgggaggagtcgagaaagtgtttaagcaattttttagtgtgagagaaggggagaggctgttgaaagtttccaccacatccggacctctagcgggtctcctcttcatctctacagacaaggttgccttttgcagtgagagatcaatgaaagtttttactcagaaaggccacatgttgaggatctattatacggttgccattccattgaagaagatcaagtgtgtgaaccaccagagtaaaaatgttcagaagccaaaacaaaagtacatagggatagtcacagaggacaattttgatttctggtttatgggtatcatgaaatatcagaaaaccatgaaatatcttgagcaggctgtttctcaagcttag

SEQ ID NO: 11339 - DNA, 339 bp, Glycine max
  Peptide Sequence Number=SeqID_103024
atgtcgtggttgaatattggcattgagtggcaggaacagggactagcagaagttgaagaggaatggtctgaactagctaagggaattgggttgatgagttccttgtattccaaagaggcactggcatggcaacttgaaagaaaaaagatggagcaaggtttcatggtgattgatcgaagtaaggaaataaaagcattctcgctggtagcatattgctattttgtcacacaaaccattgaagaactacactgttttggaaacaggatgcatcaccaaggctttatgaattggcatttgaactttctgatgtcagacttctccaaattcccttgtgatgag

SEQ ID NO: 11340 - DNA, 8310 bp, Glycine max
  Peptide Sequence Number=SeqID_103025
atgtctcagacatccactgtcctgcctgcctttcactccatcaaatcattgcctcctgagtacaagtttgctaataatcctaaccccgttcttgtggaaaaacatggagatgttaaattcagacgcaacaatccgattggatcaaatggccttgaaaatggtgcacaggtaggggaggtttctgaagaagttaacggccgtgctggtggcatggatctttctgatgaggactcgccgtatggtgcaaaaggtagatcattaaaagaccggccatctaatgcagatgaagactcagtatctgtttcgttgccccccctcccgcttttgacatcctcaagggaaagcaggtggaatgatacaaatccttatggttcaaaaaagaagcttcagtcatggcttcaactaccaaatggggattgggagctggtaaaaataataacaacttctggagacgaatctgttatttcactgcctaatgggaaagtgaaagaggagagtttggtgccagctaatcctgatattcttgatgggacgaaagctgggcctgttttggttgctgtaaatccctttaagaaagttcctctgtatggcaatgactacattgaagcctacaagtgtaaatcaattgaaagccctcatgtatatgcaattacggacacagccatccgagaaatgatacgggatgaagtgaatcagtctataattataagtggtgagagtggagcagggaagactgagacggcaaaaatagcaatgcagtacttggctgcccttggtggtggaagtggaatagagaatgagatattaaagactaatccaatactagaagcctttgagaagctaaatctactaagtgctgaagactataaatatctgaggcagagcaattgttattcaattacgggagttgatgatgcagaagaatttcgcatagttaaggaagctctggatgttgtccacattagcaaaggagaccaggagaatgtatttgcaatgcttgctgcagtattatggttaggaaacatatcatttactgtggtagataatgaaaatcatgttcaagctgttgaggatgaggggctgttgactgttgccaagttaattggctgtgaaattgaagacctgaagttgactttatcaactcgcaaaatgaaagttggtaatgatattattgtccagaagttgactctatctcaggctattgatgcgagagatgctttggcgaagtcaatatatgcttgtctgtttgattggttggttgaacaaataaacaaatccctcgcggttggcaaaagacgaactggcagatcaatcagcattctagatatttatggctttgagtcattcaataggaacagttttgagcagttctgtataaattatgcaaatgagagattacaacaacacttcaatcgtcatttattcaagttagaacaggagaaaccactcgggctactatccctgttagatgaagagtcaactttccctaatggcacagatttaacctttgctaacaagcttaagcagcatttgaattccaattcatgcttcaaaggagaacgagaaaaagcctttactgtgcgtcattatgcaggggaggtcacttatgatacatctggattcctggaaaagaacagggaccttttgcacttggattccatccaacttctatcctcaagcatatgtcatcttcccaagttatttgcatcccatatgcttactcaatctgagaagcctgtagtaggtcccttacataagtcaggtggggcagattcccaaaagctaagcgttgccacaaaattcaagggacaattgttccaattgatgcaacgtttagagagtactacaccacattttatacgctgcattaagcccaataacctccaatcacctggatcatatgagcaaagccttgtactgcagcagttgagatgttgtggggtcctggaagtggttcggatatcaagatcgggctttcctactagagtgtctcaccaaaagtttgccagaagcggtgaatcagatatggttttcttctccttgaaaatgttgcctctcaggatccacttagtgtttcagttgctattcttcatcagttcaacattttgcctgagatgtatcaagttggctacacaaaactattcttccgaacagggcagataccagaaatcgtaccctgcatggagttttgcgtgtgcaaagttgcttcaggggttaccgagctcgttgttatcgcaaggagctttggagaggaatcactactctccaatcataggagagaaaagcagaaaggaatatgcagcttcgcttcagagacatagggctgctgttattatacaaaagcggatgaaaacagtattttcaaggaacagaatgaaaaatattaatgatgctgcagttgtcatacaatcatttattcgtggttggttagtcagaagatgctcaggagatataggactatcaaaatctcaaggcattaagactaatgagtcagatgaggttctggtgaaggcatctttcctggctgaattacagcgccgggtacttaaggcagaagctgccctgagagagaaagaagaggaaaatgacattcttcaccaacgccttcaacagtatgagaacagatggtctgaatatgaattaaagatgaaatccatggaagaagtatggcagaaacaaatgaggtccctacaatctagcctctctattgcaaagaagagccttgctatggatgattctgaaagaaattcagatgcttctgttaatgcaagtgatgacagggatttcagctgggatgtaggaaccaatcaccggcgccaagaaagcaatggggcaaaatcaatgagtgctggtttgagtgttataagtcggttggctgaagaatttgagcaaaggagtcaagtgtttggtgatgattctaaattcttggtagaggtaaaatctggtcaagttgaagcaagtttgaacccagatagagagcttagaaggttaaaacaaatgtttgaagcttggaaaaaggattatggtgcaagactacgtgaaacaaaggtcattttacataaacttgggagtgaagatggatcgattgagaaagtgaagaaaagttgccaacaagaagaggatcgtgaaattctctctgatggaacatctgccgtggcaggtggaattgtagcattgggaaagtttgatgctctacacataggtcatagagaacttgcaattcaagcatcaagggctggacctccatttcttttgtcatttgttggcatggcaaaagtacttggttgggaacctaggttgccgtcctgtgacctaggaagtcacagttcaaaacaatctattcatttgcagggtaaggttgggttgtatacttctaccctcccaagacctatttggtgggaacctcgtgtgcttgatcaccctataaacgatccttgttgcaacaataaggttatgcctttgagtaggagggctcctatagttgctaaatgtgaccgaaagcgaattctttcatcttgggttccttattgctgtaacatggtcccagaagagtttgaggttgaattttcaagcgttcgacatctcaatccccgacaatttgttgaaaagttatcaaaagagcttagggtgcggggagttgttgcaggtgagaactaccgattcgggtataaagcagcaggtgatgccttggagttagttaagctttgtgaagagtacgggatggaagcttacataataaaatctgttatggacaagaatcgtttttctgctgatatgaattctgttaccaactccaaagagaggggacaggtctcatctacacgtgttcgtgaagcccttgccgtaggggacctgaagtatgtctcagagcttttggggaggcctcatcgtctcatattaatggccactgatcaagaaagattcagtactgggcagtataaagtgtctgctcctagatcctgcttattgaatctagcaccaaaggaaggattatatgagaagtgctcacttttacttgatcaggaaaatgttgtgcagtgtagtgtagttattgacagcaagtttgtccatatagaaacagattatggagccattcaaagacctcttgtagcggctgccgccgttgctgtcgcttctttctctgctgatctctccgataaattgccatcacgtgattgttctacctccgatttggcacattctactccttgtagcaacacacaaaaatcagattcatcctgggtttctcatatttcagactcaaagcttgctaacctatctttcgtgacccgaattccggtgcctgtgcctcatgttcaattccgggtgccgagtttgggacacaattgtgtttcaaatttgtaccattcttcggttgcttcgtccccgcatcttcgcaatttgtatcactctgctgacttgcctagagtctcaagacctgctgcatattcccatggtgtctccgattcaacaacttctgaggtcatgtataaatggcatttacccgagccgaatgctttggatgattcgagttgttcattgacaaagtcaaggacagtggtggtcttgctgggatggttgggagcaaggcagagacacttgaagaagtacgcagaatggtacacctcaaaggggtttcatgtcgttacctttacatttccaatgggggagatcctgagttatcagccgggtggaaaagccgagcaaaatgttcatttgcttgtcgatcacttggctgattggttagaaggggaaagtgataagaatcttgtctttcataccttcagcaacactggatggttaacatatggtgttattcttgaacatcttcaaaagcaggatccaactatcacgggaaggatcaagggatgcatcgtagactctgcacctgttgcataccctgacccatgggtctgggcctctggtttctctgcagcgtttcttaagaagaacagcgtggctactaaaggacgtgtattttctgatgaatctggcattaaagtatcaattggcagtgaagattggcgcaaacctgctctaacagaagcagctttactactaattctaaagaaattttttgagatcattctggatcttccttcagtgaataggaggctctctgatgtcatgagcatgttgtcatcaagacaacctagctgtccacagttatacatgtatagctctgctgacagggttattcctgctgattcagtggaatcgtttgtagaggctcagcgtagggctggacatgatgtgagggcatgcaattttgtctcctcaccccatgttgaccactttaggaatgacccaaaattgtatacatctcagctcagtcagtttttggaggaccattccattaatggatggtgcgatggtgctatggtggttaggactatatcaaaagtcaaccacctcatggggattacacaattgttccctcacagaaagaaattggaagaacgtgaaagaaataaggtagaagcagagaatctcttccgaaagcaagaaaaagtgcaccctagagcaataagacagggaaaatcaaagcgtggaaacttattagccccaaatcctggggttacggtttcatctgcgtcgatggcttcgaattcgatcgacggcgacgccgtattggggtcggggctgtgcataaacgacgtgttaagggacgacgagctgcgttccattctggggcgtgtggagagcgagaaggacaaggaaacgttcgggctggtctgcaagcgatggctccggctgcagagcacagaaaggaagaagctcgccgcacgtgcgggccctcacatgctccggaaaatggccgataggttcacacgcttggtcgaattggacctcgctcagtccgtctctcgttccttctatcctggcgtcaccgattccgacctcgccgtcatcgccactgccttcacttgcttgaagatcctcaatttgcataattgtaaaggaattacagatgctggaatgaaggcgattggtgaaggtctttccttattacagtcgttggatgtgtcgtactgtagaaagctcactgacaagggattatcagctgttgccaaaggctgttgtgacctaaggatattgcatatggctggttgcagatttgttaatgatggtgtattagaagctctctccaaatattgtcgtaacttggaggagttgggattgcaagggtgcacaagtattactgataatggactgataaaccttgcaagtggctgtcgacagatcaggtttttagacatcaataaatgcagtaatgttagtgatgttggggtttctagtttttctagtgcttgttcgtcttctctcaagacattgaagttgttagattgttacaaaattggtgacgaaaccatattatccattgccgaattctgtggtaatctggagactttaatcattggtggttgccgggatgtctctgctgatgcgataaagtcgctggctactgcatgtggaagcagccttaagaacttgaggatggattggtgtttaaacacttctgattcttcattgagttgtgttttaagccaatgcagaaaccttgaggcactggacattggttgctgtgaagagttgactgatgctgcttttcagctaatgagcaatgaggagcctggattgagtttgaagattttgaaggttagtaattgtccaaagatcacagtggcaggtataggaattattgtgggtaaatgcacttccctgcaatacttggatgtgaggtcatgcccgcatattacaaaggctggcctagatgaggctggtttccattttcctgaattctgcaagattaattttaatggtagtagcatcagtgagcctttggactactccaagttcgcttcactcattggtggttgctggcatgtcgctggtgactgcttaaaccttgagttgactgaggctgcttttcatcttatgagcaatgaggaggctggattgagtttgaagatattggatgttagttattgtgacgagatcacagtggcggcaggtaaggctttgttgttatgttacgccagtaataattcccatttgcaatcagccctaaatcctggggttagggtttcctccgcatcaatatcaatgtctttgaaacggggatcgccgctgtgcataaacgatgttttaacggacgacgtgttgtgtttgattctggggtgcgtagagagcaccaaggacaaggaagcgttcgggttggtttgcaaaagatggcttgggttgcagagcacggaaacgaagaagatcaccgcacgtgcgggtctccacatgctccgaagaatgtctgataggttcacacgcttggtcgaattagactactcccagttcgcttcccatcgcatctatcccgacgtcaccgattccgacctcgctgtcattgctagaggcttcccttgcctgagaaattacagattctggaatgaaagccattggcgtaggtcttaccctattgcagtcgttggacgtgacactctgtacaaggctgacggacatgggattatcgctctctccaaaaactgtcatgacttagaggagttgagattggaactcacaagtattaccgatgatggactcataagccttgcaagtggctgtcatcatatcaagattttaaacctctatttatgccagcgggcttgttctcgtctcaagacattgaaattgatggattgctacgaaattggggacggaacaatattatccttggccaagttctgtggtaatctggagactctaaacattgttggttctgaggatgtctctgccgatgccatgaagacactggctactgcttgcggaagcagccttaaaatcttaagtatggatggatgtccaaacgtttctgattatttagtgagttgtattttatgtcaatgcagaaaccttgaggccttgggcgttaggtgctgtgaagagttgactgatgtggcttttcagcttaaaagcaatgtggagcctggattgagtttgcagatgttggatattagttactgtgaaaagatcagtgttgggtatatgcattctttccttggacatctcttactgttcaatggttgtcgtgattcacatgcgacagaagctctctccaaaaactgtcataactttgaggagttgagtgtgagagggtttattactgagcttgcaagtggctgtccacataatcagacatttgaaattggggatggaaccatattatccttaaccaaattctgtggtaacctggagacattactcattggtgattgctggctactgcttgtggaattagcagcagccttaaagtgttag

SEQ ID NO: 11341 - DNA, 1644 bp, Glycine max
  Peptide Sequence Number=SeqID_103026
atgctcacagttctggttctcctctcactccttcttaccatctccacttcccacaatatatcataccctcatttccaacaactcaatgtcaaacaaataatcctcacagaaaccaaactctacccaaacccaacccaaccctccaaacacccccacaataaaaaactcaacagtgccaccgaagcatcttcatcagcaaaatataaactgaagctagttcacagagataaagtccccacctttaacacctaccacgaccaccgaacccgattcaatgcacgaatgcagcgagacaccaaaagggccgcctccctcctccggcgcctcgctgccggaaaacccacctacgccgcggaggcattcgggtcggacgtggtttccggaatggagcaaggaagcggagaatacttcgtgagaatcggagttggaagcccacctcgaaaccagtacgtggtcatggactcaggcagcgacattatatgggtccaatgcgaaccctgcacccaatgctaccaccaatccgaccccgttttcaaccccgccgattcctcctccttctccggcgtctcctgcgcctccaccgtctgcagccacgtcgacaacgccgcctgccacgagggacgctgccgctacgaagtttcctacggcgacggctcctacaccaaaggcacactcgcactcgagacaatcacgttcggaagaaccctaatccgaaacgtggccatcgggtgcggccaccacaaccagggaatgttcgttggcgccgccgggcttttgggcctcggaggtgggcccatgtcctttgtgggccaactcggaggtcagaccggcggtgcctttagttattgtttggtcagcaggggaatcgagtcgtccggattactcgaattcggacgagaagcaatgcccgtaggcgctgcatgggttcccctgatccacaacccgagagcccagagtttttattacattgggctttcgggcctgggagttgggggcctgcgggtgtccatatccgaagatgtttttaaactatccgaattgggcgatggtggggttgttatggacaccgggaccgccgtgacgcggcttccgacggtggcgtatgaggctttccgggatggttttattgcccagaccacgaacctgccccgggcttcgggagtatccatttttgacacgtgttatgacttgttcgggtttgtgtcggttcgggttccaaccgtgtcgttttacttctcgggtgggcctattttgaccctgccagctaggaactttttgatcccagtcgatgacgtgggaactttttgcttcgcctttgctccttcttcttctggtctttccatcatcggaaatattcagcaagaagggattcagatttcggttgatggagctaatggcaccaagcgcaaacacttacatcaatgtggtaattttagcggtgaaaatgatagatacttctcttgtccagtcctaatggctttgttagcactttacaggcccatcataaaacacagccttcagctatatagcagtttggaggacaaaaatgcccttgtggacttcaaaacagatcaagttacgacttggatcaagcaagcctggcctcgcctgccaacttgtgcaaccgatgtcagcaggcactga

SEQ ID NO: 11342 - DNA, 699 bp, Glycine max
  Peptide Sequence Number=SeqID_103027
atgtcactgaaaggcagtgggcactatttgattcccatattgattgtttaccgaaaagatcttgtgaaacttgatggatcagacccattattactctatggatatggattgtatgagctcataagtggtggtggtgaaatggggaggcagtggtatgaaaatggaaagctgttgaagaaaaagaacactttcactgattttattgcatgtgctgagtatttgattgaaaaaaattctgttctaaggaaagactgcatcgaaggaagaagtgctggtggtttgctaattggtgcagttcttaatatgagaccagatttatgcaaggctgctgttgctggggtaccttttgtggatgttgtgacaacaatgcttgatccaactattcctctcactacctcagaatgggaggaatgggatgatcctagaaaggaggaattctacttctacatgaaatcatattcccccgttgataacgcgaaggcacagaattatccaaacattcttgttacagaaggattaaatgaccctcgggttttctattctgaacctgcgaagtttgtggcaaaactgagggatatgaagacatactgctgtttaaatgcgagcttggtgctggacatttttcaccctcagatttctcgtattttctgcgatttgagaagccccaggaagatgccttcacttatgcatacatcatga

SEQ ID NO: 11343 - DNA, 633 bp, Glycine max
  Peptide Sequence Number=SeqID_103028
atggctaggaaaactaatgtagtttttgactcattagggatctcatctaccatggatgtgagactgaaaagtaaggtctatggattttatgatgaatgccagaggaagtatggcaatgccaatgcttggcggtattgtacagatgtgtttgactacctaactctttctgcaattattgatggaactgtgctttgtgttcatggcggcctatctcctgacattcgaacaattgatcagataagggtcattgatcggaactgtgaaattcctcatgagggtcctttctgtgatctaatgtggagtgatcctgaagatattgaaacatgggcagtcagtccccgtggagcaggttggctttttggatcgagggttacttcagagttcaatcacataaataatctggatcttgtttgtcgagcacaccaactcgttcaagaaggccttaagtatatgttccaagataaaggccttgtaactgtatggtctgcacctaattactgttaccgatgtggaaatgtagcttctattctgagtttcaatgaaaatatggaaagagaagttaaatttttcaccgaaacagaggagaacaatcagatgagaggacccaggacaggcgttccatatttcttataa

SEQ ID NO: 11344 - DNA, 1596 bp, Glycine max
  Peptide Sequence Number=SeqID_103029
atgagcaagtatggcttgaaccttaggccgcctaagccaaagaagcagccgccaaggccttccctcgccaacccttttggctttaatgaagatgatgagaatgatgttgagagagaaattgctctccaggctagcaagaataaacgtctcaaggaagttgaggagcagcaaaagaaagccctggaggaagatccatctgtatttgattatgatggagtctatgaccaaatgaaagagaaagttgctcgtccattggtacaagatcgtgaagagagaaagccaaaatacatccaaaatctgattaaaaaagcaaaagagcgagagcagtatcgtgagattgtttatgagaaaaagattgccaaagagagaagcaaagatgaccatctgtatgctgacaaagacaaatttattactgaagcatatagaaagaagcttgctgaacgagagagacaaatggagctagaacgactgcgtgaactccaagaggaaagagacgatgttaccaagaagaaggactttttgcttgatttttatgctaacctagataaaaatgttgcttatggcgcgaaagatgctgaagcaaggaaacgtgaaaatcaggctgagcatagagttccagagacccatgagggagtgagccttgcatcaaatgagcacgaaaattgtaatgtgtcagaggaagtgcaacattcattgggcaactcaagttcaccagcggggtccccaagagtaaagcttgaggaggatcagggtgaagcttctaatccttctgatagaagtttcaatcccttggaaacgaagccaaatcctgaggcttctatggaggaaaagggttcagctgaactgccatcagattctcaaccaaagcccgatcatcacaaaagaagtcaagatgctgtggctgcagcaaaagagcgctttctggcacacttcaaaaaagatgacttagtgtggagagttacgaaatgggaagagtacagtatcatcaagaccgatagcctcttcaaaattgaccatacagatgttcctctttcctattatactggacttcttggtatgcctggtatgactgcttatgcaggtttctatgaagttggggtccctaagaaaggagattatgtgtttatatcttcagcatttggtgcagttggccaacttgttgggcaactagcaaaattgatgggctgctatgttgttggaagtgctggaagtaaagataaggttgaaattttgaagaataagttcgggtttgatggggcttttaattacaaggaggaacaagacctggatgcaactttgaagaggtactttcctgaaggcattgacatatactttgacgatgttgggggagacatgcttgaggcagcccttcttaacatgagaaggcgtggacgaattgcagtggccggaatgatctcacagtatgatcttgatgagcctcaagaacttagtgaatatcatatacaagcagatcaaaggaagataacatatgttgaagacatagctgagggtcttgagaacggtccagctgcactagaagcaatgttccaaggccgcagtgctggcaaacaagtggttatacttgctcatgaataa

SEQ ID NO: 11345 - DNA, 841 bp, Glycine max
  Peptide Sequence Number=SeqID_103030
atggtgaacgtggtggaattgcagaaacagttgcagagtgggaatgtgaatgttgatgccaacggggaactcatgtatgtcaaggtcatgaccgatgaacagttggaaactctgaggaagcaaatagcagtttatggcaccatttgtgagcaacttattgagatgcacagaacactctcagctcaacaggatcttgcaggggttagattgggaaacatatactgtgacccattgatgacatctggtgggcacaaaataacatcaagacaaaggtggacacctacacctgtgcagcttcaaattcttgaacgtatatttgatcaagggaatggaactccaagcaaggaaaaaatcaaggaaatcactgctgaactgggccagcatggccaaatttctgaaacaaatgtgtataattggtttcagaataggcgtgctcgatccaaaagaaagctgcaaaatgtggctgcttatagcaacactgaatcagaagtggagactgaggttgattctaaggataagaagacaaaagctgaggaagagtttcagtcccaacataataataacataagtacaacttctggaggggctgaaaagttgtgcttccagaaccctcaagtacactctgattacttgcagtacttgaaccctgcagattccaacaaaccatattccatgttccaaacagatgacaatctgaaatccacaagaaatttgagtcatgtgtctgttttcaatgaggtgctgtcaaactcaaggagtgagcatataggtgggaaaatggaagttggtgggagtgtgagctacaatttattccaccaaacaggacacttcaatctagcgg

SEQ ID NO: 11346 - DNA, 759 bp, Glycine max
  Peptide Sequence Number=SeqID_103031
atggcagtctatagaattgcaattgggtcgcctagagaggctagcaatcctgctgcaatcagagcagcatttgcagagtttttctctatgctcatttttgtctttgcaggacaaggctctggcatggcctatagcaaacttaccggcaatggaccggcaactcctggcggtctcgtagttgcatcattgtctcatacatttgggctttttgtggcggttgctgtgggggcgaacatttctggtggtcatgtcaaccctgcagtcacatttggtgctttcataggaggaaacataaccctcttgagaagtattttgtattggattgcacagttgttgggttcagttgttgcttgcattcttctcaaggttgctactggtggaatggaaacatcagctttctctttgtcgtctggtgtgtcagtgtggaatgcactggtttttgagattgtgatgacttttggcttggtacacacagtttatgctactacagtggacccaaagaaggggaatgtgggtgttattggcccaatagcaattggatccatagtgggtgccaacatcttggttggtggggcttttgatggagcatccatgaacccagctgtgtgttttgggccagcattgattaactggtcatggactcatcactgggtctattggcttggcccattcattggttcagctactgctgccattctctatgataatatcttcattggtgatgatggtcatgaacccctttcaaatagtgatttctag

SEQ ID NO: 11347 - DNA, 846 bp, Glycine max
  Peptide Sequence Number=SeqID_103032
atggaggatccgtttagcaatttgccagatgaaattctaagctgcatagtttcttttctgccactagaaaccagcctcatatctactaggtggagagacctgtggaaccaagcccttgttagacatggaagcacacaagacgacgtagctagtgttgttgctggttttctgtctcgttttgaagagcttgatccattaaaacatcctcgcaaacttcattttcacttttctgatcaagacactgcactctttgcatccattgcaaccaacagtaagcttcttcttgatttccctgctgggatcaaagacctcaaaaagcagtatgagctcaagtttatactcaacaagcatcacatcacacacaacactgtcccccccactttcttagtcaaaactctttatttgaaatcagtgagtcatttgactagtgagttgatttcctccatcgtttcaaatttagagcatcttgagaagttggtgattgttgagtgcaccgggttgcaatctttgttcattgagtctgaatcaaagcttcacgagttaaccatattagattgcccccagttgaagtctctccatcttagaacttctaagcttaaaagtttcagacttgatggacctcttccaacgatttggccagaatcccatttcaaccttagccatgccatgcttaatttcagacttggaccaagctgtgctgacttcaaggctcaatatttcaaccaaacactgttgacaataaagaattgtgaagctctcactttatgtgagtggacttttcagggagagcctccaaagatagagacatcggatgagagttgcttgaatgtagtgatcgtgcagtga

SEQ ID NO: 11348 - DNA, 3288 bp, Glycine max
  Peptide Sequence Number=SeqID_103033
atgggagttcaacaacatgaagcgctttctgaaggcaatgagcctgctgaaaatgcttgtgctagtggtttcctgaaccaaggtgctcttgccagtgagtctgcctacagcgatccaagggtaaacactgaaagtagtgaagttaatgaaccgggtgacaattcttataaggaaagtaatacaccacatatctatagacaagatgttgtgaaaaatactatcagtggcatgattgggattgtgacagaagttgctggtgattctgattctgattcagatagcagcgtcactgacgacgaaaatgatactgaggatgaggatggtgatgatgaggaaggcgatggcattaataatgctagtagaaattctgaaagtaatggtgctgctgggcattgtaaaaccgatgctcttctggctgaccagctgcatgtactgtggatggacaaatctgaatccactctaaatttcagcgacgttgaagttgttgatcgcggatttttacatggggattttgttgctgctgcttcagaccctactgggcgagtgggtgtagtggttgatgtcaatatatgtgtggatctgttggcccatgatggatctataataaaagatgtctcatcaaaaaatttaaaacgaattagggatttcactgtcggtgattatgtggtgcttggacattggctaggaagaattgatgatgttttggataatgtaactgtcttatttgatgatggttcagtttgtaaggtctcaaaagcagatccattgaatcttaaaccaatttctaagaatattcttgaagatgggcattttccttattacccagggcaatgggtaagggctagctcctcatcagtattcaagaattcaagatggctgtctggcttgtggaaagctaataggctagaaggtacagtcactaaagttacagttggatcggtgtttgtttattggatagcatctgcaggttatgggccatattcttctactgccccagctgaggagcagagtccaaaaaacttaaaattgttgtcctgttttgctcatgcaaattggcaattgggtgactggtgtctcctaccctcatctgaactgtcatcctcagcttccatggataaaggcatatcaaaattggaacttaacaattctgctaacaatgaattagattctaatcagacaggaagtggatgtgattcagaagaagctacagttgaggaaacaaatgggaataaggatactatggaccttgatccagctgatgttttggaagggaatgatggaaatgataaaagtaatccttcacgtgattctagctcatgcagcagttctatctctgtatcaaaggaacctgtccatgaagcttggcctcttcaccgcaagaaaattaggaaagttgtcatcaggaaagataaaagggcccgaaagaaagaggaaagctttgagaaagctcttttgattgccaacacaagaacaaaagttgatgttgcatggcaagatggaacagtagagcgtgaactaaattctacaaaacaatatgtggtagagaagacctccggtgatggtgaggatatttctgaagctaggcgagttggggttgtgagaagtgttaatgccaaggagcggacagcttgtgtgaggtggttaaaaaaagttgccagagcagaagatcctcgagagtttgacaaggaggaagttgttagtgtatatgagctagagggccatccagattatgattactgctatggggatgtggttgtccgcctctcacctgtgtctgtctgttcagaaacagcttctgttggagagtccactgagaaatcaatgcagaaaactgaagagagtgggattaaaatcgatgtaaatatccaaactggtgaaacttttgtgcaattttctgacctctcttgggttggaaatataactggccttaagaatggtgatattgaagttacttgggctgatgggatggtatcaatggttggaccccaagcaatctatgtggttggtcgagatgacgatgatgaatcaattgctgctgggagtgaaataagtgatgctgcaagctgggaaactgttaatgacgatgaaatggaagtccttgaggattccagagaggatattgagagggaaaattcaagcagtgttacttctgaggcagaagaaagtggagagaatgattttggtaggactgcagctctctctgttcccctagcagcatttcgatttgtcactagacttgccagtggaatattctcaagaggctcaaggaacttggattctattcccttggagataaaagctgaacgtgaacatccatcacctgtagttaatgatgagtctacttcacagaaacatattgcaattgatgctgataattcaggcaataagaatgaaaggtatgatgaggttgtttcagaagcaactgaaactctggaagcaagtgcggcactttgtagcttgggaaatgaagatgctcctgcaactgcaagttgtgataatgacacttgcagtttgaaacattttgacataactaaagatccatcggaccactattttattggtgcaaatggacagagtaacaaccggaaatggttcaagaaagtgcaacaagattggagcatattgcagaataaccttcctgaggaaatctatgtacgagtttatgaagatagaatggatctcttgagagcagttattgtagggccatacggaaccccttaccaagatggactctttttctttgattttcaccttccgccagaataccctgatgttccaccgtcagcatactatcattctggtggttggcggattaaccctaatttgtatgaggaagggaaggtttgccttagccttctaaatacatggacaggcagaggaaatgaagtatgggatccaaaatcttctagcatccttcaagtcctagtttcactgcaaggcttagtactcaactctaagccttacttcaatgaagctgggtatgataagcaggttggaacagctgaaggagagaaaaattcattgtcatacaatgagaatacctttttacttaactgcaagactatgatgtatcttatgaggaaaccacccaaggcttgtgatgcttatatgaaaggtttcttgattggctcgctgactagagaagcctctgtaagtgaaaagagcagtcagaattcaacctctgtgggtttcaagttgatgttagccaagatagtgccaaagcttttcttgtcactatgtgaggttggagctgattgtgaggaatttaagcatctgaaagatttgtag

SEQ ID NO: 11349 - DNA, 210 bp, Glycine max
  Peptide Sequence Number=SeqID_103034
atgggatatatagtttccactaccaaccaaccaaaagacaagcatgcacgtgcatatgttgaaatgtggaaggagctagagaaggaaaacaaggaattcttcgagccttacatgaagtcgaaagctaaagacgacagaatgtctcaggaagagacaaaccagataatacagaagatgatgtcagagttagattcctctaaagatgactaa

SEQ ID NO: 11350 - DNA, 831 bp, Glycine max
  Peptide Sequence Number=SeqID_103035
atgtcctctttaacgttcacaacggaggtagcatccagcttcctcggcctcgcttatcacaatcccaaacccttcactctctcactccaaaccactcttctccctcttctacgcagaacaaccactcattcccgatcgctaacatttcctctccgaccctctcgccgcttcttcgttacctccgccaccactgcacctcctcaatccgaggattccgacgtttccaccgtcattcctcccgacaatcgcataccggcaaccatcatcaccggctttctcggctccggcaagacgacactgctgaaccatattctgaccgcggaacatggaaagaaaattgcggttattgagaatgagtttggtgaaattgatatagatggttctttggttgctgcgaaaactgctggtgccgaagatattatgatgttgaacaatggctgcctttgctgcactgtcaggggtgaccttgtcagaatgatttccgaattagtcgcaaagaagaaaggaaaatttgaccatattgttattgagactacaggtttggcaaatcctgcaccaataatccagaccttttatgcagaggaaaatatttttaatgatgtcaaattggatggtgttgttactctggttgatgcgaagcatgctggttttcatcttgatgaggttaagccaaaaggtgtggtcaatgaggctgtggaacagattgcatatgcggatcgtataattgtaaataagaaaataaacagcttggctaacttaaagcggacagagtatggaaaagttaacttggattatgttcttggcattgggggctttgatttggagaggtag

SEQ ID NO: 11351 - DNA, 945 bp, Glycine max
  Peptide Sequence Number=SeqID_103036
atggcgaggatcaaggtttacgagctgaggcagaagacgaaggctgatctgttgaatcagctgaaggacctcaaggccgagcttgccttgcttcgtgttgctaaggtcaccggcggtgcacctaacaagctctctaagatcaaggtggtgaggttgaacattgcccaggttttgacggtgatttctcagaagcagaaggccgcgttgagggatgcctacaagaacaagaagtacttgcctctcgatctccgccctaagaagaccagggccattcgcaggaggcttactaagcaccaggcatcattgaagacagagagggagaagaagaaagagttatatttcccactgaggaaatatgctatcaaggtacaacaagatctgttttgcttgcgccgcgaaggtcgatggcaaggacgctctcatcgcgcgcgtttgcaaccagcagcagacctacaaacagaattgaaagccagacatttgaaaattgagccattggatcttagttggagaaaaagcacccaatctaggaggaaaacagaacctgaatcccaaatgaaagtaggtgtaggaattagtgctcgaagatgggcggagacagagcactttggcagcaacgagaatggtgaagaggaggaggaaagggtggtggagatttgtgtccctgaccgtggtggcacacacaacagaaagggagaagcggatgtcgaagggaaggatgtcgcggggtttgtgtgggaccagttattagcagtcgggagagggtcggaggagagcgacgtggtttctgctgttggtggatgcggcgtggtttctgctgttggtggtggcttagcagaggaagaagataggttggttaccttgggaagtagaggcggcagcgagtttggccgtgacagcctcgaggtggtccacctaggcgacgaaaagttcgatgtatgccattga

SEQ ID NO: 11352 - DNA, 603 bp, Glycine max
  Peptide Sequence Number=SeqID_103037
atgttgacaatttatttggggtcagttgtttcaggaatgattctttactactcaaaattgaatgttgaagcatctttttcgttatattattattctaattatatattgactctcctgccatcccctcttgataggtctctgtttgcctctaagataatacaaactggagattgcattttaaaggttccttacagagtgcaaataactgcagataatctccttcctgaaatcagatctttgattggtgaggaagttggaaatattgcaaaacttgctactgttattctgatcgagaagaaactgggtcagggctctgagtggtatccttatatcagctgtcttccacaacaaggagagctgcataatacggcaagtttttgttctttttcttactttgagtggtgtttgttcctggtattttggactgaaagtgagttggagatgattcgtccaagttcagtttatcaggaaactattgaccaaaaatctcaaattgaaaaggactttttggcaatcaagcatcttggaataaaatttttgaatgttcccatcaaagttttggagattctacctacaaggacttcatgcatgcatgcacactag

SEQ ID NO: 11353 - DNA, 213 bp, Glycine max
  Peptide Sequence Number=SeqID_103038
atggtacatatatatgtttccatacaggatgattctgaaacagttgccatgatcaaggaattgttagagactcgaattcgaccggcagtgcaggatgatggtggggacattgaatatagaggttttgacccagatactggaatagtaaaacttagaatgcaaggggcatgcagtggctgcccaagttcatcggtgactgaaatcaggcattga

SEQ ID NO: 11354 - DNA, 4587 bp, Glycine max
  Peptide Sequence Number=SeqID_103039
atgagtgttgaaaacggtgtgcagagaccaccagcgacttgcagttgcagtgcgaactcggaatggcattgcagaacctcgggtgtggatacgacgtgtgaggaaggcgacacgaaggggtgggcaagaagcagactaaaaagtcacgactttacatcgaacggtcgagatcagaggataagaaacacggaggaaaaagggccacgtggaaggagaggacacatggcgatgcgtcccgtcggtggaatagaatatatagaaaccaagataagcttccgttgtcacaaaatctataacgttttcagagtatttaatttaccgcgctttgatttctccgcgccctgcgattctcggtccacgctacttgtttgtctgtatcttggaagtgagagcaaggctaggattgttttacttggaaaggagaagcgttttagaagatataaatgcctaccgatgaccggggtaaagtcctatgctgggcaatttagtggtttaattgcaggtgtgcctatcaagaaaaggaggttccctacgtttcagccttcttcttctcctgtgtctggggaaccatgttctctcactgaagaaaccgagttacagcgtaaagaaaattcaatcacttctcaaggatcagctttaccaaatgctgcaggtgcaccaatcaagaaaagaaggttcccgtgtcttccgccttctttggaagaggcttcacgttcagaagaaagtgatgccttgcgaaaggaacattcaagcacatcaccgggttcaactctttctcccagttcttctggtctatctgatgctaatggaatctctgcgtttgaagataagaaagcaagtattgatgttaccaatgctaacatggtgcaaagcaactcctgcttccttacacccaaacttgagcaatcaaatgtcggaactcaatcatgtactttaaatgtcatggatagcaaagagaaggtgatactcagtgaaggtagcaataaaaaattggaatcccaaactatcaaggggaatcctgaactcttattggctgcaaaggaaggtcttgctcttagcattggagctgatgtaaccaaacaaaatgtccaagatatttgtaaacaagagactcctttagtttcaggaaatactagtttatctttaagcttaaaggagcacctctttccggctgttgcaagtatggagaacaatcctcaaaaaatagagaaagcacaacctgtttcattggaattgtctttaagcaaagaagactgcagtactcacagtttaaatactgatcctaaaactgatagtgacactactcgtgttcattctaacagggcaaactgggatctgaatactacaatggatgcgtgggaagaatctgggaccgaagctggctcggttaaaacaagtattgatgggctgaaaatttctgatagttcacttgatgaaaagcagttagtgtgctctccagggatgacatcgccagcaagtgttgtgtctgtaaagccaatgtgtgaagagagtcagaaaaaaactttcacttttccatctggactctgtggaccgcagtttaaatttgttgactcaagtaatctatctcttgcaccatttattcagaaatataccgaggagccctctagattatctgttaagctgaattctggtagtgctattccgaatgtgagcttgtcaagtgtggcttcaaccgtgggtgatgcgaatacttctagttttaggttggtaaaaccagaaccatttgatgagaactcaaaaagggatttgaaggatgttaatgcctctactgtgggttccttagatagtgttactgttaaacaagaacttgttcaggcttccgctgccaactcttcaaagttgtcaaatgttagcaatctattgaaagttgatgctgcctccgttaaacaggaaccagatcacaagggtaatcaggaaggatccaatgctgcagtgagtaaaatggatcagttgaataaagattcgcgacaagaattggataattcttctccttccatggcgatgccagttatgcctgatacaacacaaatttctgccgagccagcttgtgctccagtgaaacctatgtgtactgcagagttatcaaccagtgaaaacacagtaagtcagattgaaaattctagtcctacagaaggagtcaatgttgagaaagtttgtgatggagcttgtttaaatgctgaacaggttatcatagaaacagttgctatgcctatggttgataatggtttggtgttgaacaatcctggtctgcaaacttcttctgttagtactgaggaagaaaatgctgctgatcgcgatgcttgcagattaaaactcatgaatgagcctccacctgcttcacgaggcaatggtgaaggctgtgcaagtgatgaagaaaagataaccctatctactgatatgttggaggatgattcttatgattctgattccgagtcagacgagaatcatgctgtaactattgctgtggataccgagtgctatgttgaagatgatgattatgaggatggtgaggttcgagaaccactggatccttccacagcagaagacgtatgtgaggtaagagaagtagagcatcctgatagtaactttgtaaataaacagatggagaaaggaatggtaagtggtgattgtcccacttcatatcaggtggtggaaaagaacaatatgactgcaattcaaagtgaaataaataatgaagttgttgatatggacattgaaatgcatgagaggtctggtaaggtcgttgataaaaatgtgtgtgtgcaagagtcattggatgatgagaagtgtaacattgctactcatgggaacaaaccagttaatgttttgcaaatgaaagcattagatcttttagaaggaaaaaatgtctgtgaagctctggtgacagaatcaccttccaatcaagccactaatggaagccatggggttgatgttcagtgtgctgatgaggttgtcaaaacaactgacatagttaaacaaactgacttagattttgaaactatggaagtgtctgcaaatgctgatgatgcagccaaagatgttaataatggtggtaatctagggagaattatagatctgtctcgagctacaagttcttcatcccctggtaaaactaggcccatgtcaggcaggtcactgtcgtctcgagctggaagagatgtattgtctgacacacttgatggggataaattacacagaggaagagatgaagtttacattgatggccctcacaaattttctagagaaagacatcaagatatctcccctagaaaaactagaatgaattttgttcgaggtagaggaagacttaacaatcgattagattcagttcgaaatgattgggaatctgaccgtgaattttctggtgagttttataacggaccaagtcagtttcggggacccaggcctaaatatgcatctgcttttgccgatactgatatggagtacaataacgttgcacctgatgggtcatatgttggtaatggtcgattaggcagaaagccattgaatgatgggtcttacattgcaccaaggaggcgttcatcaggaggaagagatggcatccaaattggtcatagaaatccaagaaacattagtccaaatagatgtattggagatggctcggacttggttggagtgaggcataatgaaaaatttatgagaagcttgcctgaggataacatggatgctatgttcacacggccccaaacatttgagggaatggatggccggtttacaagagggagtaggaatttttcttcaatgcagagaaggggtcctcctcaaattcgttccaagtcacccatcagatctaggagtcgctcacccggtccatggtcatctccaagaagaaggtctcctagaagaagatcccctgatggttttggtggacatccagaattaacccatagaagatcaccattttacagggttgacagaatgaggtcacctgatcgtcctgttttccctgcggagagagtggtgaggaggcatggctccccctcttttatgtcaagaccttctaatgatatgagggacatggattctgcaagggaccatggccatccgaggtctggtcgaattttaatcagaaataggaggtttgatgttgtagatcctcgggaccgtgtggataatgatgatgaatactttgggggccccatgcattctggtaggttacttgagcttagtggtgaaggaaatggtgaggataggagaaggtttggtgagagacgaggaccagtgcgttctttcaggcctccctataataataacaatgttggtgagagttttcaccttaatgctgaagacggacctagacattaccgattctgttcagatgattcagattttcatgaaagaggaggcaacaacttaagggaaagggactttgaaagaagaatcaagggccggccagctaatgtgccacctagaagaacaagaaatatggatgagcaagaagagaatttcaggcatggtggtggtggtggtggtggtggtggtggacaggtttggagtgatgacagtttagatgatatatcacgggtgaagaggaaaagattttga

SEQ ID NO: 11355 - DNA, 240 bp, Glycine max
  Peptide Sequence Number=SeqID_103040
atgaaactcttggtgagttttgaacgaaacaaaccgcagagtcagctaaacctcgaagcttcagaggaagagaaaagggtcatagaagtggcgagggagatacgggtagggtttgggttgcgacgaaatgggtatggcgaaacgagaaacacgatttctgtgtttgaaaagaaagagaagttgaagaaagagaaaatctctttcgtttgggtcggttttgtttttgttgacttcatttaa

SEQ ID NO: 11356 - DNA, 1605 bp, Glycine max
  Peptide Sequence Number=SeqID_103041
atgaagttcagagagaggtatctactgtgggaaaaggttgctcctcttgtacttggaataactgtatttggtttagacttacctgttgagcccaaagatacaattctagtgggactggatgatgcagtgaaggccaagaatgatgctcctggaccagcttcatctgaacgcagatggagactttggcctatgccttttcgaagagtcaagaaaattgatcacactgatagtgtatcaagtgaggaggtatttgtagattctgagtatcattgccaaacttctgttgtcaagccatctccaacatctgctatgcccatttccaaattcattactatttcacaagtaaccactaccattggatttgcttctccaaacaaggctaattcctatagtgttcatggaagtgcattaggtgctaaagaagtggatgctacaaggaagaatcttggatggtcatacgagcctttccatgtgccagaagatgtcaagaagcattggagtcgccatacacctgagggtgctaaacttgaagctgagtggaatgccaagtttgtggaatatgagaagcaatacagtgaggaagctgcagagctgaaggctattattactggcgaattaccagctggttgggagaaagcacttccgacatacacaccagaaagccctgctgatgctacaagaaatctgtctcagcaaaatctaaatgcccttgttaaggttcttcctggtctacttggtggtagtgcagatcttgcctcttccaacatgaccttattgaaatcgtatggggatttccaaaagaatactcccgaagagcgcaatgttaggtttggtgttagagaacatggaatgggagcaatctgtaacggtattgctcttcatagccccggattcattccatactgtgcaactttctttgtcttcactgactatatgagagctgccataaggatttctgcactgtgtgaagctggagttatttatgtgatgactcatgattcgattggacttggagaggatggaccaactcatcagccaatagagcatttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacaccatttcagacaactcatcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaggagagtgttctacctgcttcagtaacagctagagttagcattgaggcaggatcaacatttggttggcacaagattgttggaagcaaaggaaaggccataggcattgatcgatttggagcaagtgctccagctggaaaaatatacaaggagtttggtatcaccaaggaagctgttattgctgctgccaaagaactttcgtag

SEQ ID NO: 11357 - DNA, 912 bp, Glycine max
  Peptide Sequence Number=SeqID_103042
atggctctgaaacttgtaaatctagggtttcactcatcgatcccgtgttctccgaggcccttgaaagatcggttcgtggttcggtgctctaaagtggaacaaatatcgtttactgaatctgaaaactcactcatcgaagcccttcttggcattcaaggacgcggacgttcttcttctcctcagcagctcaacgtctctatctctctcagacacgctgttgagcgtgctgttcaagtcctggaacgtttagggggtgtacctgatccggcagcagcatcaattgaagatggaaaaagaatcctttttaggtttgacagagctgctttttcttttaaatttcttccatttaaagttccgtatccagttccatttaggctactgggagatgaagcaaagggttggttagacaccacatatttgtcgagttcaggaaaccttcatatctcaaaaggaaataagggaaccacatttgtgttacagaagcaaactgaacctaggcaaaggttattgacagctatttcctcagggaagggtattaaagaggcaatagatgaacttatttccttaaagcagaatattggccaagaaccagaactagaagacggtgagtggcagatgatgtggaattcacagactgtgacggatagttggatagagaatgctgtcaatgggctgatgggcaagcagattatcaggaagaatggaggaataaagtttctggttgatatcttgcttgggcttaagttctccatgagtggaaattttgtacaaatagtggagaacctttggatagttaaggggctagatctagaatatgtgaacgaagaggaaggtgggtcttcggccttggacaaggataagcttaaagccatagggcacatacccgccacctccagagagtacatgtgctaa

SEQ ID NO: 11358 - DNA, 804 bp, Glycine max
  Peptide Sequence Number=SeqID_103043
atgtcgggcttgaagcttggcacgactgcttccatctacgttcgaacagcgaaaaccaaaagcaaacccctcttatcatggagaagcccaccccaacacccccgcagccgcagggctggtcttgtcacagattttggttcgtcagtgccccaacctcaacctcaacctcagccaaagccagagccagaaccagaacctgaaccttccaaattgcttacgttgccaacaattttgactctaggccgtgtcgccgctgtcccacttcttgttgctactttctacatggacggttggcgtggaactgctgctactaccagcattttcgtcgctgcatcaatcactgattggcttgatggctatcttgctcgcaagatgaagttaaaatcttcattcggtgcattcttagatccagttgctgacaagcttatggttgctgctacactggtcttattatgtactagacctttggatggtggtgtgtttggacaagcgccgtggctactcactatacctgcaattgccataattggtagagagataaccatgtctgcagtcagggagtgggctgcttcccaggatagcaagcttttagaggctgttgctgtaaataacttggggaagtggaaaacagccacacagatgacagcattaaccatccttcttgcgacccgggactggagccatggaggaggagctgccattgtagtaggctctggtgttgctttgctttatacttcagcagggcttgccttatggtcgttggttgtatatatgaagaaaatatggagggtgttgttgaggtag

SEQ ID NO: 11359 - DNA, 345 bp, Glycine max
  Peptide Sequence Number=SeqID_103044
atgaactcagttttgtcgcaatccttgacattgcagaaaattgcggtcaaatgcggccacaattgcagtcacagagactctaaaaaccttggtgttgcagttcaaatcacagttgcagataatttttttaaaacctcagatagaagtacaggactattaagttacaaaattatgccactttggtgggaatcaacattgtggacaaacacttcagcaccatttctgcagaacccgagaatgcacttccgccagcatgtggttgggaaagaaaatggcagcagttttcaaaaatggaaatgctggtggatctccttgacttggaagtatttggcagcatcgaaataa

SEQ ID NO: 11360 - DNA, 564 bp, Glycine max
  Peptide Sequence Number=SeqID_103045
atggctagagagatggatgagattttaaggcagcagattgcacagccagctaatagttgcatttatgattctaaggatggtgtctcatttcttgataatgttatctttcctctctatgatattgtttccgcagaagctgcaaacaatgataatgggaaagcacctcattcctcgtggaggaattatgatgattttaatgagtatttctgcttagttggccctggcggaaaagttctccattttttcaaaagccacaacccagatcaaaggacctacggcggaactacgccggaaacagagatggacaacaccagagatacagaagaaagaattggcgggaccaaaaagacatctttttacttcacacgattcactgaagatgtaattgaaaaagagctgtggtatcacttcagaaagatgggagatgatgtacacagattagaaagacaactcgacaacattgtacttggaggcctaaaattgtatgtgaacatcccaaaatttgggagggcgatggtgagaagagtaaaaccagcagacagacccaagggatatgttaggtga

SEQ ID NO: 11361 - DNA, 1374 bp, Glycine max
  Peptide Sequence Number=SeqID_103046
atggctgatgtttcagattcacgagaacaccccgttcttggttcagcgcaactgttggtggagctggaatctgcgctgggcggtgagaaaacggtgacggcgcaggcttcttcttcttccttaggcttggggattgaggttatcgacgaaacggcgttgctagactccgttgcgaagaagaacggaggaaccaagaacaatcaccagaagtctcagccctcaaataagattgggaacagaaagtactcgcgtaaggagttggagggtctgagattcctgaacatggcccgacagcgcaagttctggaaagcaattcacgctgcctttcaaagcaccgtggccatcgagtatgacactttagcctccactcccctgccgccccataacaaaccaatcctcagtgcagtgtgttgtgaaaatagggatagtgaaaaagggactcctgttgacccttcttgtagtcataatcttgtgagtgaggatgggtgctcagttgcaaaagagtgcagtgaagaatatgatggtagtgacgatgattatgctagcatccagaggcctgcctttatggttgatggagaacctaattttgattctggtccaccagaagatggatgggaatatcttaggcgtgtcaggtgggaggcacatcaaattccgaaagtgaaggtagcaaaacttgatagaggtaaacttaacaaggaacaaagtgcatacatgccccagattcctgatattgccaattgtccagagtatctgctgccattgaaagagtgggaggatgtgtttcttgctgagttttctgcactgagaaggaatttctcatgccttgatggttcaagtgccatacattctgaaaatcttcatgttcattcctcacaactagttgggaacaattgtggagaattttctagtgctatgagcagagatgtgttacttaataatcatttgagaattgggaagacaaatgatcaaccatctaactcgactgctgaaaataacgatagaacattgtctccagagaatcctgaagcaaaaagttcagccgatcaaacttgcagcagcagctcccccactctgccattgctttctgtaatcttagcaatggactctgtagcccgggtatcaagtttgttgaaacgaattaggttgctagaggctgcaggcactatgacaaggaatgattgcatgtggctttttgctctctgtgcaacagttgatgctccactagatgctgacacttgtgcttctctcaggagtctgctaaggaagtgtgccagcatacgtgccggaaaggctggattggatgaggaggttgtaatgttgaatatattggctacaatttcggggaggtattttggacaatctgaaaactga

SEQ ID NO: 11362 - DNA, 1476 bp, Glycine max
  Peptide Sequence Number=SeqID_103047
atgacgatgaccaccatacaatcgacgccaggaagctcagggtatttggatttgtttcctgagcgcaaaatgtcatttttcaagaatccttatattctgggactcagtgctgtggctggcattggaggcatgctttttggctacgacacaggtgtgatatcaggagcccttctatatattaaagatgattttgaaggggtcagagaaagtgagttggttcaggaaacaatagtgagcatggcaattgggggtgcaatagttggagcagcaggaggaggatggataaacgatgcttatggaagaaagaaggcgactctgattgcagatgtgatatttattattggagcaatagggatggcagcagcaccagaccctcatcttctcattcttggacgccttcttgttggtttgggtgtgggtgttgcctctgtcacctctcctgtctacattgcagaagcatctccatctgaaatcaggggttctttggtcagcaccaatgttctcatgatcactgctggccagttcctttcctacatcgttaacctttctttcacgcgtgtgagcggcacatggcgatggatgctcggtgtctctgctttccctgcaattcttcagtttcttctcatgctcttcctccccgagtccccaagatggctctttatcaagaataggaaaaatgaagctgttcatgtcctctctaagatctactacgaccctgctcgctttcatgacgaagttgattttctcaccactcagtccgcgcaagagcgccaaagtatcaaattcggtgatgtttttagatctaaagaaatcaaactagcattcctcgtcggagctgggctgcaggctttccagcagttcacaggaataaacacagtgatgtactacagccctaccattgtccaaatggctggtttcaactctaatgagttggctcttcttctgtctctcatagttgccgccatgaatgctactggaacaattcttggcatttacctaattgaccatgccggccgcagaatgttagcactttgtagcttaggaggagtgtttgcatctttgatcgtcttgtctgtctcatttttaaacgaatcatcatcttcgagtggatggcttgcagtgctgggtttagtcatatacattgcatttttctcgccggggatggggcctgtgccatggacggtgaactcggagatatatccggaggaatatagaggaatttgtgggggcatgtcagctactgtgtgttgggtttcaaatttggttgtgtctcagagctttctttcgattgttgaagctatagggataggttccactttcttgattcttgcagctatatcagtgcttgcctttgtgtttgtccttatatatgttccagagaccaaaggattgaccttcgatgaagtagaactcatatggaaggagagagcttggggcaacaactctgactcgagaaaccttcttgctcaagaatga

SEQ ID NO: 11363 - DNA, 1047 bp, Glycine max
  Peptide Sequence Number=SeqID_103048
atggatcagtgttctctggaagatctgttacactcaagtctctccttccgttcaagtacacaaccctcaatttggcatgtgggctgggcaatgacgcttggtgagatactgagttcaaaatctgaaaggtgggaacttcaactcaaaggagcatgggtgggggttggtttcactcatggtgtgctgaacacggataacatgagcattttgggtcttacaatagattatggcccatttggatttttgggtgcttttgatcctaaatttaccccaaattctacagatcttccaggtcgaagatactgctttgcaaaccagcctgacattggtttgtggaatattgcacagttcacaacatcactacaagctgctcctttaataaatgaaaaagaggctaactatgctatggaaagatatggaacgagatttatggatgattatcaggttataatgaccaaaaagcttggcctccctaagtataataagcagatgattaataaacttcttagcaatatggccgttgacaaagttgattacacaaacatctttcgtacgctttcaaatgttaaagcagaaacaaacattccagatgatgaactgttagtcccactaaaatcagtactgttagatattggtaaagagcgtaaggaagcatggaccagttggttgaaagcctatatacatgaggtctctaccagtggcattcctgacgatgaaaggaagatctggatggaaataggtgattttggagaagttcgtaggctgctcaaattagtggagcatccttacgatgaacaaccaggaatggaaaaatatgctcgcttgccaccaggtggaggtgataaggacaagcgcagagagacacttgacaaggaagataaattaaaaaagtctgtcagcatcaatgagtttctgaagtcccccgagtgtgaaagttactataacgcgggtggtcgcagacgtggtgcaagaggaggttatggtggctatgcaactgctaacattacagctccatcaattgaagatcccactttgagggtcaagtga

SEQ ID NO: 11364 - DNA, 648 bp, Glycine max
  Peptide Sequence Number=SeqID_103049
atggctctttcctctgataccttgtgcaatcattttggtcgccatgctttgagaaagcgacttgaagagcttggttatgaacttaatgacgaccaagttcagactttattttggtgttttaaagcagtggctgagcaaaaaaagagggttactgatgctgacctcagagcattggtatcagatgaagtttttcaagcagagcctgtctggaaacttggtgatttgcaggtgacttgtggaactcttggcctttctacagcaactgtcaaacttttgagtagtgatggtagcacacacgttgcctgttccattggtacaggaccagtggattcggcttacaaggctgttgatctgattgtgaaggagcaagtaacacttcttgagtactcgatgaatgcagtgacagaaggcattgatgcaattgccactacccgggttgtaattcgtggggagagtgaaacaagtactattactacccatgctttaacgggagaaactgttattcgaacatttagtgggactggagcgggaatggatgttgttgtttccagtgtcaaggcctatattgctgcactaaacaagatgtcgggtttcaaggaatcctctcaatctgctgaaaaaatttcaatttcttcattgaagatttga

SEQ ID NO: 11365 - DNA, 1035 bp, Glycine max
  Peptide Sequence Number=SeqID_103050
atggccactttcgagcaattttggagcagaaaaacgttactaggtcttgctttgggacagtttctttctctcctcatcacttccactggtttcacctcttctctattggctaaaaaaggaattaatgcaccaacttctcagtcgtttctaaactatgtgttcttggcaattgtctatgggattattgttctatacagaagggaagcactcaagattagacgacaggaagctattggtggtggtatgtttataattatcaatcctttcattttaaatgataaacatctggtgaaacaaggtttgatattggtggcaaaatggtattattacatacttcttggattggttgatgttgaagcaaattttcttgttgtgaaggcatatcaatatacatcactaacaagtgtgatgctgcttgactgctggtccatcccatgtgtcatgctttttacatggattttcttaaaaacaaaatatggattcaaaaaggtcactggtgtagttgtttgcattgctggccttgtcctggttgtattttcagatgtccatgcaggcgaccgggcagggggaagcaaccctagtataggggacattcttgttattgctggtgctacattgtatgctgtcagtaacgtcagcgaggagtttctagtgaaaaatgctgatagagttgagttgatggcaatgttgggactctttggtggcattattagtgccattcaaataagcatacttgagcgcaatgagctcaaatctattcactggtcagctggggcagttcttccttttgttggatttgcggtggctatgtttatgttttactctttagtccctgtcctacttaagatcaatggttccactatgttaaatctgtctctattgacctctgacatgtgggctgtcttaattcgcatttttgcttaccatgagaaggttgattggatgtactatgtggcctttggtgctgttgttgttggtctcattatctactctggtgcagccaggctggaagctcaaaacactaagcacgcctga

SEQ ID NO: 11366 - DNA, 1752 bp, Glycine max
  Peptide Sequence Number=SeqID_103051
atggcgtcctccccttctttggcggtggccgtcgtcgtccttctattgttcgcagcagcagcggccgccgatgacgcctcctgccatcattccttgcaattgaccaagataaaaagctggatcgatgggaataaagatgtggactataatggtatgactgcaaaattcggctcttatttgcctgaagatgccgatcaagctgccaaaactcctgctcttttttctgatcctatagactgctgttccgcttcagcttcaaagttatccggatcagttgctctctgtgtacggggcacttgtgacttcacaaccaaagctgcatttgcacagtccgccggtgctactgccgccttgatgatcaacgacgccgatgaactctttgagatggagtgctccaatgacactagcgtaaatatttcaattccagttgttgagataactaagtcaacaggagacgctctcaacaaacttttgacgtctaaaaggaaagagatggatttgattgccaaacagtcatggccgattgatctaagggaaagaatcgagaatctgataatgaacgttggcgttcttcctagaatgaaattaatggctggggttgtggaatggacaatccttgattggaccatactgttgcagtggacccaaaaagagaaatttagagtacctggttcaggagttgtttggcaagtggttgaccaggctgatcagaggaatggaggtactatgcagatgaaagatcagtatgctgctattctcaccagagtgttgggattacttgatcatgtcggagagcttctaatggggtcagatgagagaacccatgcttgtctcagttgtgctaccaaaggctttggggaagatggaataggagagcacccatcttgggtggaggttttgttatatgctccaactcgcccagttgtagactactcagttgcctttttgtggttgatggctgttggaacagttatatgtgcttcactatggtcggatataactgctcctgatcaaaatgatgaacgctacaatgaattgtctcccaagagctctatgtctgaagcagggaaagacgattctgaggacttggttaacatagatacaaagggtgctatcatcttcgtcatcactgcatctacttttcttgtactactgttcttcttcatgtcgtcttggtttatctgggtgctgattatacttttctgcattggtggtattgagggcatcggtttgatgataacagtcctacagttggctcggttgcctaatattaaggttgctcgtggtgacaaggccggtggtgaagcaattcctatgcttttgagatttcctcgtctttctgatccttggggtggctatgatatgattggatttggagatattctctttcctggtttgcttgtttcctttactcgtaggcctcttcttcacatatctggggctatatatgatgaacggtcatggacaacctgcactgctctacctggttccatgtacactagactcctcctcgtcttcgtccaaagagccttctcgagtttagatggcaactgggaaatggaaatgttctctctgacagtgtttaggacttcggagagattccaggaggcagaagaagatgcattagcagttgggaggatgaggaaggttgcacttggcagggagttggagggcgagtttaggatcaattccgagagaaggcaagagtggggagttcttgtaagggcaaaggcagggcaagtctgcatgtga

SEQ ID NO: 11367 - DNA, 399 bp, Glycine max
  Peptide Sequence Number=SeqID_103052
atggttggaacattctcgcaaaacatcgtgaccctgactggtctccctatgatcttacttagtgagagtgacctgacaaacccattgtgtggtgtgtcttgttatgtactcctaagcaccccagagtggtttttcactgacatgagacactatgcagtattgcaggcattggcactggaagaggatgatattccagaaatgaaagatgaaacattacctgacgaggaaggtttagccagaccagcagtggtaagggcattagaagaattcaaaacctctgtatatggggataattatgaagaggaaaataagcctggcactgggaagcctactgaagcctccaagaaacaaaaagcaattgctgagtttgcaacaaaagagtgtgaaaactatgactga

SEQ ID NO: 11368 - DNA, 1881 bp, Glycine max
  Peptide Sequence Number=SeqID_103053
gaaaaggtcatctttgtcacgtgtgaagatgatgaaaaggttgctgatatacaaaggctgattgggtcatatgtgagattggaagcatcaactgctggggttaatctgaagttgtcctcttcagttgacatagaagacaattcttccattagaagttcttctgatgactgtgtctctggagttgaggttccttctttttcttctggtagaatctccaattttgatcagggtgcttcttctggaagagttatcttgcttcctgatgcagagctacagacttcaggtgcaaaggctgctgcatgtggtcacttatcatcattgtctgcagtttctgataaagtttacagtgatcagggagtgcctgcttcttttcgagttccttctggggcagttttaccatttggatccatggaattggagctagagaagagcaattcgactgaagcattcaggtctatcctggaaaagatagaaacagccaagctggagggtggtgaacttgatgttctatgccatcaactccaggaattaatttcttccctgaagccatcaaaagacataattcaaagcattgggagaatattcccaagcaatgcacgtttaattgttcgatccagtgccaatgttgaggacttagctggaatgtcagcagctggactttatgaatcaatacccaacgttagtccttccaatccaacagtttttggaaatgcagttagccaagtatgggcttcactgtacactcggagagcagttttgagccgccgtgctgctggtgttcctcagaaggaagcttcgatggcaatactgatccaagaaatgctttcaccggatttatcatttgtactacataccgtgagcccaacaaaccaggataataattgtgtggaggctgaaattgcttctggccttggtgaaactctagcttctggaacccggggtacaccatggcgtatatcatctgggaaatttgacgggcaagtgcaaacattggcttttgcaaacttcagtgaggaattgctggtacgaggtgcagggcctgcagatggggaggttatccgtttgactgttgattacagcaagaaaccactgacagttgactcagttttccgtggacaacttggtcaacgtctttgtgcagttgggtttttcctggagagaaagtttggttgcccacaggatgtggaaggatgtcttgttggaaaagacatctttatcgaagcacatgcttatctattgcaccagagctatgttctccagcatgtacgtgatggaaatggaatgaagttcgacttcgacaaattgttggatatgaaatcagccgttacggttgaaaggaagccaaatttgaaggatttgaataggtttggtttgattgaagggatagaggataagaagttgagagaattatgggagggacaggaccttgttattgtgaatgtagatgactccagagctgtattagctgcccaagatcgtagcaatggttctcttattgctgtccagttgagcactgaccacaagccacatcttccaagggaagcagagaggataaggatttgtaaaggaagggtcttcgccattaagaacgaaccagggattgctcgagtatggctccccaacattgattcccctggccttgccatgtcacgtgcttttggagatttttgtctcaaggactttggagtcatctctgctcctgatttctcatatcaccgcctcactcaaagggatcaatttgttgtcttagccacagatggggtatgtgatgttttatcaaacgaagatgctgtgaccattgtggcatctgctccacgctacttagactccaacctcaacaaaaccaccaatagcctcctcctcctcacttcactaatttga

SEQ ID NO: 11369 - DNA, 1428 bp, Glycine max
  Peptide Sequence Number=SeqID_103054
atggattctctgcgtgtctatgcgtcttccattcatctctgtccttctcggaacagacaacataaccctagtaaccatttcagattcctccttccatctatccctccccctccgcctcaccttcgccctctccatctccgattgcctccgcttatctccgctgtctcctcctccccccaaactcaaactagggacgaccaagaccaagaacaagaacaagaacaagaacaaggaaagaacaagtccctgaagaacaaagttcgtttgcaagttcgattagatcaccaggttcaatttggcgatcacgttgtcattcgcggatctaccaaagaattaggctcctggaccaacagtgtgcccttgaattggacccaaaatggatgggtgtgcgacttggaatttgaacaagggcaggggacccttcacattgagtttaaattcgtcaccgtcaacaaggacgacactttagtctgggaagctggagaaaacagagtgttgaaagtgccaggggcaggtaattttgccaccgtggctacgtgggacgccactcaagagactttggagctacattctttggatgatgatgaacaagtacaagatgcagatattaatgagtctgtttccgaatcagaggcaagtccctttgttggtcagtggcaaggtaagcctatttcattcatgcgatccaacgagcatcggtcccatgaaacagaacggaaatgggacacttcaggtcttcaaggcctgcctctcaagttcgttcaagccgatcaaagcgcaaggaattggtggagaaaggtactgcccttccctcaccctaacataactgctctatgctggaagtctgcaaggggaagatcgattggaggctctcctatactctgctatctatctcaaggtcttgttctctctctctctcttcattttcaatcatcttatctatgttcttcttatcgaatatcatcatctgagcccttcttagatcatctcgtgcagtggataaacacagggcaaatttcttgttttgaagatggaggtcaccaccggcccaataggcatgctgagatctcaaggcttatatttcgtgaactagagcgacacactagtcgcaaggatatatctccacaggaagttctagtcattcgtaagattcatccatgtttgccatctttcaaggctgaattcactgcatctgttcctcttactcgaattagagacattgctcatcggaatgacatcccacatgacctaaaggttgttcttttcaaagtcaactgttttctgtattgcttagtctccagtgacgaattaagcatacaatacggaacaagcttcaccgaaatgctggacctgaagatttggttgctacagaagctatgcttgctagaatcactagaaaccctgcagaatatagtgaaccgttcgtga

SEQ ID NO: 11370 - DNA, 1092 bp, Glycine max
  Peptide Sequence Number=SeqID_103055
atgaagttacttggatggatgcatagaaaatttcgccagaatagcgctgaaccgttcaaagacttgatcatcggagggaattcttgcgatgaggagcacaactatccgaaagcaagctttgggaattacaaacatgtgaaacaacaaagtcatcatcaaaaagagctaagaaaatcattcgatcatgatgagtatgaggaagattcagcgggagctatgtatgagctgttccatgggttcctggcaattggaactcttggttcggaggcatcaacgacgccaacgtttgccatctctttggagaacataaccgaaaaggaagatgaagtgaccgagaatgaattgaagctgataaacgatgagctagagaaagttctggtactgggagaggataatgacgagccatcgtcaatatcatgtgggagaagcagtcatggaagcataataactctgagcggaggaggggggaagcctgctgcagctacgttgttggaaggagatcaatcaaatggaaatgcagtttgtccacttcaggggtatctgtttggatcagcaattgaactgtctgaaacaacaacaacagttacagtggcaaagaaggagcacaggacttcacttggggagctgttccagagaaccaaattggcagaggaaaacaacaactttggcccaaaggaagcagataaatctgccatgcatctcatgaagaaaaagctcaagaaaaaaatgcgaagctccacctccacaactgttgattccgcttcagcagacagaaaactgcataagattctccatatgtttcacaggaaagttcacccagaaaattcaacatcaggtgcacaaaagtgtgataaataccaaaagaagaaaacaatgaatgagggatcagaggaagatatattaatgatacagcccaaaagagcagaactgtcaaaggaaaattacacgcgacagtataagatccaaccgaatccattccagtttacacttggctgtgaagaagattcttctgagaataaggaacactggatcaaaacagatgccgattacatgattaagggaaaaataaaagacaaagataatagaggttaa

SEQ ID NO: 11371 - DNA, 750 bp, Glycine max
  Peptide Sequence Number=SeqID_103056
atggctttagagcaggagggtcagaataggaacacaaacggcgtagtggatgctggagatgagggagggaaagcgccgagactgcctcggtggacaagacaagaaattctggttctgatacagggaaagagagacgctgagaacaagttcaggaggggccgaaccgcgggtctgccattcgggtcgggtcaggtggagccgaaatgggcatcggtatcttcctactgcagaaagcatggagtgaacagaggtccggttcagtgccggaaaaggtggagcaatttggccggagactacaagaagatcaaggaatgggagtctcagatacgggaggagacggagtcgttttgggtcatgaggaacgatttaagaagagagaggaaattgcccggatttttcgataaggaggtatatgatattcttgattcaccagcggccttggctctcgctctttcatcctcatctcctcctcctccaaccacaaccaaaacaataacactccctgctgaggagcctctgcctcacctctatgatagtaatcggagcgcgcccggtgacggtgaggatggcttgttctcagattttgaacaagatgaagtcgctgccagttcgaagaagaacaaggacattcctgctcccattcctatctcagagaagctataccaaccactcctccgtcgatgccaagctgaaggtaatgctcaatatagtgcacatttccctcattactctacttttactttagtctag

SEQ ID NO: 11372 - DNA, 1425 bp, Glycine max
  Peptide Sequence Number=SeqID_103057
cggaagtggagcagcgaatctggtgggaatgtgatgtcgtcaccatcacacacacactcgcagtcgcgtaacgggcattctcgttcctcttcgctcaccctcactggaggaggaatttcaaccgtcaaaaggactcagaatgttgctgccaaagccgccgctcagcgcctcgcccaggtcatggcttctcagactgccgtcgccgccgccgacgacgacgacgatgaagacgatcttggatttcgctacactgctcctccacctctctctctttccaggggctctgctaaatctccatctcctgcgttagctcggaacctcgtagaagaatcaatgtatcttcgcccagctccaactcctggtaatagaccaccgctaagcctcaggactccagctcctgttccgcccttagaccctcccattcataataataagcccaaagataaaagatttccgtttgatactgcactccttcaaccaaaagattcaggatatcagcgtgaggcttctacactttgtgatgaggttgatatgctgcaggaagagaatcaaagtattctagacaagctcagactcgaggaagacagatgcaaggaatcagaggccagagttagggagcttgaaaagcaggttgcttcccttggagaaggtgtatctttggaagccaaactcttgagcagaaaggaagcagcattgcgtcaaagagaggctgcgcttaaaaatgccaaagactctaaggaaggagttgataaggaaatcacatctctacagactgaaattgagaatgcaaaagttgagaccgagactgcagtgagacagttaaatggagctgaatctgaagtaaaagctcttcgatcaatgactcaaagaatgatattaactcagaaagaaatggaagaagttgttctaaagaggtgttggcttgctcgttattggggtttagctgcaaaatatggtgatgatgcaatagagaagaggagcaaacttgttcctgacttaaatgatcttactggagaaggaaatattgaaagtatgctttcagttgaaatgggactaaaggagcttgcttctttaaaggttgaggatgctattgtgcaagcattagcccaacagcgacgtccaaattctgctcgacaattagtctcagaattgagtccagaggaatctgaggatgttcttttcaaggaggcttggctgacatatttttggagaagagccaaagctcatggtatagaggaggaaattgctgaagaacgtcttcggttttggattagtcggagtgggcattcacctacctcacatgatgccgttgatgttgagcaaggactttctgagctgaggaagttggggattgaacatcgactttgggaagcatccagaaaggaagttgatcaggactctactattgcacgaaagctgacttga

SEQ ID NO: 11373 - DNA, 168 bp, Glycine max
  Peptide Sequence Number=SeqID_103058
atggatgtacatgcttatattactaatatccaataccagcataggaaacacatagatggtagcgtggaattgattggagttttactttatggaccaggagaaggttcttctgttctacaatccgtgaggctcctggttcgtcccttgttgatgactggacatgcctaa

SEQ ID NO: 11374 - DNA, 639 bp, Glycine max
  Peptide Sequence Number=SeqID_103059
atgggggagggatgttgtacgcagccttacccttgcatatgcaaagaggctgtttccggattcgaacccatgaccaacaagtcaccaaggcacaactttaccgctgcaccagggctcgccaacggaaagcccttggaggagaatactttccttgattttttggatctcaataacataaacacctctttttctttccctctcactctaaccttactacttggcctctcaatctacccaacttcccatcgccataatacttgtccatcacctcctgcatgtgcaattaattgcctactcgtattgatgctggtttgttgggatgtattagagtattgtacagagagtagcagtattcaactgcactctcagctaagtgtgttagccaggtcaagcccagtaaggtcatcaacggtggcacaaaacaatgtgttcttcacttattcttttcctaagattgcacataagcttgatgattcgacttttctgctatggcgtcagcatgttgagccagtcatcaaatctcatcgtcttcaacgatttgttgccaatcctcagattcctctacgttttctctttgaagaagatcgtgaatctggaattgagaatcctgcatatgaagcttgggaacaacaagattag

SEQ ID NO: 11375 - DNA, 456 bp, Glycine max
  Peptide Sequence Number=SeqID_103060
atgtctccctctttcctcattctctttctagccctaattgtagaggatgcggcgaggaagagaaacgggttatggagcctaggcgttgcttccaccgtcacagcggtcgctgcatcaatgcttgtaacaacagcaactgagatgaggctagacggtggcctcccccgcgacggttttggccggagagaaacgaagtgtgataggaaggtaacgggaaggagagaagaaggaaataagagaaaacaaagggtggcaaagcttccagctgtggacggtgagagaggagaggggcttgagaaggtagaacggagaggtgttgcttatggtggttgggttgtggcgttgggaataggcttgggttcagctgctaggatttgcggagatgtcggagaagtggtaggcaaatttgcttccatgaacaaggtaatggtgggggaagatggagggaagagatga

SEQ ID NO: 11376 - DNA, 279 bp, Glycine max
  Peptide Sequence Number=SeqID_103061
atgtgggaaagtgcgagaaagattcacgatgtcggatacaatgtccaggacatcctgcctgaaaatactggaattgctaaaagcattgaagctgcaggatccacgatgtcggatacaatgtccaggacatcctgcccgaaaatactggagttgctaaaagcattgaagctgcaggatccacgatgtcggatacgatgtccaggacatctggcccgaagatactggacatataaatctgttatatctttaacagattattgtgcagttagcaagagataa

SEQ ID NO: 11377 - DNA, 1092 bp, Glycine max
  Peptide Sequence Number=SeqID_103062
atgttatcggggttgatgaacttattgagggcctgctttcggccgggttcagatggatttacacttgcaggttcggatgctggaggtagacaggatggactgttgtggtacaaggactcggggcagcacttgagtggtgaattttcaatggctgtaatccaagccaataacttgctggaagatcagagccagattgaatcaggctgtttgagctccaatgagtctggcccttacggtaccttcgtcggtatctatgatggccatggagggcccgagacatcgcggtttatcaatgatcacctatttcaccatctcaagagatttacttcagagcaacaatcaatgtcggtggatgtaattcgcaaggcactccaagcaacagaagaggggtttatttcagtggttgccagacagttttctctgtcaccacaaattgcggctgttgggtcatgctgtcttgttggtgttatttgtaatggaaccctttacatagcaaaccttggggattcccgggctgttttgggaagagcagtcaaggcaactggcgaggttttagccatgcaattatcagcagagcacaatgcatcgatagagtctgtaagacaggagctgcatgcttcgcatcctgatgacccaaatattgtggttttaaagcataatgtatggcgtgtgaagggtcttattcaagatatgaagaattacttcagaaagacagagctatgccgagcattagtaaaacagacctgggtgggggtggagagagagagagataaagtttctagatctattggtgatgtatatttgaaaaaggccgagttcaatagagaaccactatatgctaagtttcgacttcgtgaaccatacaagatgccaatactaagctcagaaccatcaatatcagtgcatcatttgcagccacatgatcaatttattatatttgcatctgatggactctgggagcacctcagcaatcaagaagcagttgatatagttcaaaacagtccccgcagtgtaagatacatatttttctactgtgctagattgtgctatgtcattaacagaaagattaaagtggatacatgtatggattag

SEQ ID NO: 11378 - DNA, 2715 bp, Glycine max
  Peptide Sequence Number=SeqID_103063
atggcggcgccgactccatcgtggcagcctcaggagcaagggttcaaggagatctgcggcctccttgagcagcagatttcgcattcttcttccgccgataaggctcagatttggcaacaccttcagcgctactcgcacctccctgacttcaacaattacctcgccttcatcttctcccgtgccgagggaaaatcagtggaggttcggcaggctgcggggttatatctgaagaataacctcagaaacatgttcaaatctatgcagcctgcataccaacagtatgtgaaatcagagttgctgccttgtcttggtgcagcagataagcacataaggtctacggcaggaactattattagtgttgttgttcaaatagaaggagttgttgggtggcctgaattgttgcaagccctcgtaagttgcttggatagtaatgatctaaatcacatggaaggtgctatggatgcgttatccaagatctgtgaggatattcctcaatatcttgactctgatgtaccagggttagcagaacgccctattaacatatttcttcccagattgtttcggtttttccaatctcctcatgcttcattgagaaagctatcattgggttctgtaaatcaatacattatgttaatgccttctgccttatatgtatccatggatcaatatcttcaaggtttgtttattctcgctaatgaccctgttgctgaagtacggaagttggtttgtgcagcatttgttcagctaattgaagtccgcccatctttcttggagccacatttacggaatgtgattgaatacatgttacaagtcaacaaggatacagatgatgaagtagcccttgaagcctgtgaattttggtactatttgtttgggatgtctgcttattgtgatgctcaactgccacctgaaaacttaagagaattcttgccccgtcttattccagtattgttgtcaaacatggcttatgcagatgatgatgaatcagttattgaagctgaggaagatggttctcaacctgatcgagatcaggatcttaaacctcgatttcacgtatcaaggtttcatggatcggatgaagtagaagacgatgatgacgatgttgtcaacacatggaatttacggaaatgcagtgcagctgctcttgatattctttcaaatgtgtttggagatgagatccttccgactcttatgcctattgttcaggctaagttgtctgctggtggggatgatgcttggaaagatagggaagctgctgtcttggctcttggtgctataggtgaaggttgcatcaatggtctttatccgcatctgttggagggtattgggcatccgaaaggctatgaacagtttgataatgttcttatgggtcttctacgaagaattttggatgataataagcgggttcaagaggctgcttgttcagcttttgcaacgctggaagaggaggctgctgaagagttggcaccacgcttggaaattatactaaagcacctaatgactgcatttgggaaatatcagagacgaaacctcagaattgtatatgatgctattggaactctagctgaagctgttggaggagagctgaatcagcctgtttatcttgacattctcatgccaccattaattgagaaatggcagcaactttcaaattcagacaaagatctttttccactcctggaatgctttacatctatatcacatgctctgggtactggtttcactcaatttgctgaacctgtatttaggaggtgcataaatataatccagacccaacaatttgctaaggttctggctgatcctgccgccaccacaggggttcagtatgacaaggagtttattgtatgctctcttgatttgctttctggactagcagagggtcttggcagtgggatagagagtttggttgcacaatgttctttgagggacctacttctgcattgttgtgtggatgatgctcctgatgtaagacaaagtgcctttgccttacttggagaccttgcgcgagtgggggactgggtggaaataagtttgggtctacccaaacatgtgtgctcggttcatttggactctcgtttgtctgagtttcttgaggctgcagccaaacaactggagatttctaaggtaaaggaggctatttcagtagcaaataatgcatgctgggcaattggagaattagcagttaaggttcatcaagaaatttctcctgttgttttaactgtaatttcatgcctggtcccaattcttcagcatgcggagggactcaacaagtcgcttatagaaaatagtgcaataacactggggaggcttgcatgggtctgtccggagcttgtatcaccacatatggagcatttcatgcaatcttggtgcactgctttgtcaatgatacgagatgatgttgagaaagaggatgcttttagaggtctatgtgctatggttaaagctaatccttctggagctctaagttcgctagtttgcatgtgcaaagccattgcaagttggcatgaaataaggagtgaagatttacacaatgaagtctgccaggtcttgcatgggtataagcagatgctgcgcaatggagcatgggaccagtgtatgtctgctttggagcctccagagctgagtctcggtccaagttttcagacagggaagttccacaagccttcaagatctcatttgatgggagtttcccatgagaaatgtacaggggaatga

SEQ ID NO: 11379 - DNA, 174 bp, Glycine max
  Peptide Sequence Number=SeqID_103064
atgccttttagaggcttgaaaagtgcaagaaaacgaattgtattttctgtgttttctggaaaacgcaatgaactcgccaagcaagcatgctgcgctaaatggcttctaggaaacgcaagagtattggttcaagacccacaacacaatatgatacaaggagattttcctccctag

SEQ ID NO: 11380 - DNA, 237 bp, Glycine max
  Peptide Sequence Number=SeqID_103065
atgctagttacccatgtccgggccatccgacaaggtcagtgcactctaccccccatgacatacactccatacgacgtatgttcgtggccaaaagctagtgccaaagaccctggaaggataacgtttacaaagtctctttctcaaaagtttttcaaaggaagcataagacatacaatggcggttccaaagtcagaaaagatgcaaagacaagatgaaactaacaagaaacaagcgtag

SEQ ID NO: 11381 - DNA, 141 bp, Glycine max
  Peptide Sequence Number=SeqID_103066
atggtgactaaaggttggagctttaatggaggcttcaatggagaggaagaagaagagaatggaaacgaccacgtgtcatgctgtggttgcttcaattcccgcccaaaaatatcacttcttgctacagtgccaaacccgtaa

SEQ ID NO: 11382 - DNA, 360 bp, Glycine max
  Peptide Sequence Number=SeqID_103067
atgcaccccttgtgtcatccagaggcggcgggcccgatgatacgcggagataccttacggttatccgcacccttttgtcatccagaggcggcgggcccgatgacaagcagagaccaaaatttggtcattctgcacccttgtgatcatccagaggcggcgggcccgatgatacgcggagataccttacggttatctgcacccttgttgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatga

SEQ ID NO: 11383 - DNA, 426 bp, Glycine max
  Peptide Sequence Number=SeqID_103068
atgtcctcgccttcagaggactacacgtcttcaccttcagagggcctacacgccctcactttcgtagggactacacgccgtagtcctcaccttcagagggctacacgctcctcgccttcagaggactacacgtcctcaccttcagaggactacacgtcctcaccttcagagggctactacagggctgacacgccctctaccttcagaggactacacgtcctccagcttcagaggactacacgtcctcaccttcagaggacacacgctctcactttcagaggactacacatcctcgccttcagaggactacacgtcctcaccgttcagaaggctacacgccctcacctttcaaaggactacacgtcatcgccttcagaggactacacgtcctcaccttcagagggctacacgtcctcgccttcgtag

SEQ ID NO: 11384 - DNA, 345 bp, Glycine max
  Peptide Sequence Number=SeqID_103069
atggggttgaaccaagcacatgcttctaagaaaagaaccataatcattgtaatcataaggaaagaacgcactttacaaagcccttaccgaacgcgtgccagagctagagtaatgagagaaatagaggaggtgcaaaagcagatgaaggctgacatggaggccatgaaagagcaaatgaccacaatgacgaaagccatgatgagtatgataaaaatgatggaggtcaacacagctacaatttttgccgcaagtaccaccactgaggtggacccaattcacccatctggcctcaatcaagtaaatcctccagtctcgaatatggtagtgcagggaggcgaagcgtaa

SEQ ID NO: 11385 - DNA, 303 bp, Glycine max
  Peptide Sequence Number=SeqID_103070
atgtgctgcaaggcgattaagttgggtaacgccagggttttccccagtcacgacgttgtaaaacgacggccagtgaattgtaatacgactcactatagggcgaattggagctcccccgcggtggcggccgctctagaactagtggatcccccgggctgcaggaattcgatccttggtctcagggaagtgacgacagaggggagctgcttactaagcgaggcggagaggcgggtctcaagcaagaggcttcttgctggcagcacgtattcagtaatccacccagctaagctaatcaatgcataa

SEQ ID NO: 11386 - DNA, 162 bp, Glycine max
  Peptide Sequence Number=SeqID_103071
atggtcatcatcatgcccatcatcatcgtcatcgaaggacaagatctcatgaaatgcaatgtttatgaaaatcaagattggaatgctcgtttatttgcccagaaactagaaataacaggcaaattcaagcaacacaatggccagcagcaatattgtatataa

SEQ ID NO: 11387 - DNA, 541 bp, Glycine max
  Peptide Sequence Number=SeqID_103072
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtataagctagggttcaaaagaactcaagataagcgtgataatcaagaagaaagtattatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11388 - DNA, 399 bp, Glycine max
  Peptide Sequence Number=SeqID_103073
atggcaatccaaggagatgatagcgaatttggaaagaagatggaggaacacaaacaacagctggcacctaagccagcacttgaacatgtttttgattctgtaaaacttgaagagattaatgaggagactgaagatgataaggaagaagaggcaccaataaaagagaaagaaaaagaaagaataaaagaagaagaaaaagaaaaaaagttgaaaaagaaaaaacaaaaagagaaaattgttgatgatgagatgaggaaaggcaagagtgaggcaaacactgacaagaagaaggatactactccaaatgaaggcaaggaagtaccttatcatttggtaccttcccggaaagagaaagaaagacatttggtcagatttcttgatatattcaagaaactataa

SEQ ID NO: 11389 - DNA, 249 bp, Glycine max
  Peptide Sequence Number=SeqID_103074
atggctagaaccaaacgatatggccagatgacatcaaaggtggcaaaagaaatttcggatagaattgactcgttagaagagcagatgacacagggtagttttgttccccatggtcgggatgacatcttgaatacggccattggcaaaccggaacatccaggtcgagttcgtgcagcgggatcaggtatgacccttactcaattttatggtagggcaacacgtacgtcgagtagtcctcagcaacactaa

SEQ ID NO: 11390 - DNA, 384 bp, Glycine max
  Peptide Sequence Number=SeqID_103075
atggcctcctatggtgtggcgtctcctctctctcttcctttctccattccgctgccattcatcttccaagaagcaaaggaatccattgatgaagaagatcctaggcctacaagctcaaatggagcttacatcaatagcacacttttgttttcaaggtttggaaaaccagaaaactttagaaagatttttgcaaaggaagaagaagaagaagttcaagaagatgttcaaagagattcaaaggttgtaaaagaatatgtggaaaagttgtttgtaaagattgtaagtaagtctcttaaaaatgcaagtcaaggtcttgcttttatagactcttcaagtctagtcaagaaaaccattagaagagttataacttttagaaaaatatga

SEQ ID NO: 11391 - DNA, 237 bp, Glycine max
  Peptide Sequence Number=SeqID_103076
atggccgaccatcatcattctgatgtcatcggacttgtttgtctctggatgataaaggtgcggataaccatgagtctcgaccggaagacgctaacatctccggaaaaggtgcagatgatgacgttagtgacaaaatgctatcaggcttctcggtcggaagacgctgacatctcaagggaaggtgcagatggtgacgttagtcactacatgctatcgggctttgagtcttatggatag

SEQ ID NO: 11392 - DNA, 306 bp, Glycine max
  Peptide Sequence Number=SeqID_103077
atgggacaccttagtgatcaaggggttcccacagaccctaagagaataaaggtcattcctgattggcccactccaccaagtgtcgagggaaggagcccagagtatgaagaacctcgggatttgaggtcaaatcctttccaaggtggaggggatgatgcaattctacccccaaaggtattggatagaagactccaagaggattgggctagagatactaaagaaggccctagggttctcatgaaccttagggtagattttttgagcccatggaccaaggttgggtcctctcttctttgtaaatattag

SEQ ID NO: 11393 - DNA, 348 bp, Glycine max
  Peptide Sequence Number=SeqID_103078
cattccttcccaccatatggcttgccccccgactatgcgccacccaatgtggtgcacactcccgatgagaatgtcaataactccactcccatactcattgagagccaacaaactcagtttgatcatgcacatgtcactcaacccatgggggagacacatgaaataccccaccacaatctagccaactttgagccttgcctcggatatgcccctgaggggaagcaagtccctcctgctatggtggaaaagggaaagtttgatcatatagaggaaaggctaagggtcattgaaggaggcagaggttatgcctttactgacatggaagatttgtgcctagtacccgacgtg

SEQ ID NO: 11394 - DNA, 375 bp, Glycine max
  Peptide Sequence Number=SeqID_103079
atgatgacaataatagtagacgcattaccagtattctactatgaaaagatggtgggctacacaccttcaagctttgatgatatggtcttcaccgacgaaaggatcaaagtgggtctaaaaagaggcaaatctgataatcttactttgataaatgcaaaaaaagctggggcaaataaagagggtgagaataagggacaagcccatgctgtgactgccattcctatacagccaagtttcccaccaacccaacaatgtcattactcagccaataacaaaccttctccttacccaccgcccagttatccacaaaggccatccctaaaatcaaccacaaagcctacctaccgcacttccaatgacacacaccacctttag

SEQ ID NO: 11395 - DNA, 234 bp, Glycine max
  Peptide Sequence Number=SeqID_103080
atgaccggccctctcgatgagtcgatctcttgctttctcaaaagggtggacccttgggtactagtacctatcacctttagaggactacacgtcctcgccatcagaggactacacgtcctcaccatcagagggctgcacgccctcaccttcagagggctacacgccctcaccttcagagggctgcacgtcctccccatcagagggctgcacgccctcaccttcagagggctagac

SEQ ID NO: 11396 - DNA, 423 bp, Glycine max
  Peptide Sequence Number=SeqID_103081
atggcattacgggccaatgcacctctaccttatccacagttgataactttgtttttgcgtcattttcaaattccgcttgatgatgagccatttgttcaagtcaagcgttcctttgcaattggtgctggtgttgtgacttcctttggttaccgtatggatcggaatggtcaatggctgaagaaagacgcactccctcctcaagatgagcatactccttcacctcctcctcggcgtgaagattcagcactcctgaatgaagtccttaccgaattacgaggtcttcgttcttatgttggtgaacatttcgactcattggatacacgctttgccagcatggatattcgcctcacacaagttgaagaagatgtctccttcatccgtacttgctttgatccaccaccaccgcctccatcatcctcttag

SEQ ID NO: 11397 - DNA, 217 bp, Glycine max
  Peptide Sequence Number=SeqID_103082
atggagaataacgtggccactgctgccgctgttagttcggctatcgaagcagacccaactctcccagctaccgcgcaccatcctctcccaaacgcggtaggacgagaaagaagcatactagggcacaccagcaacccctatttgggatacaactgggtggcttacccttatggattaccacctaattacacgccaccagtcatgcatgatgacgcgg

SEQ ID NO: 11398 - DNA, 624 bp, Glycine max
  Peptide Sequence Number=SeqID_103083
ccacaacgttctcgacgcgcgaaacagcctgtcccggctgatcgcagactcgcaggccggagaagaagtcgtcatcaccaagcgcgggaagccggtggcgaagctcgttccgatcggccccgtcgacctggtgcgcagtggacggctcctcgtcgagtggatcgaccagcacccggtgccgccgcggttgtcgcgtccatcggccgagctcgatgcccagatcctggagagccgggactcctgggaatgatctacctcgactcgtgcgtcctcatctacgcgctggaagaccacgggccccgaggcgacgccgtccggaaagctctgcgaacggtggaggtggctgtggcttcgagtccgctggcgcttcaggagtgtctggtcggtccgttgcgcgggcgcaaccccgagctgcgagatcgctatctcgcgatgttcgagcgtctcgaggacgtcgcgctcgatgcagcggtcttcatccgtgcggctgagctgcgagccgatttcggcctgagaacccctgacgccgtgcacctcgcggcagcgcagatcgccgggtgcaccgaattgtggacgaatgacaagcgcctcgcggccgcatcccacgggctcgcggtcgacgtc

SEQ ID NO: 11399 - DNA, 321 bp, Glycine max
  Peptide Sequence Number=SeqID_103084
atggctaagtttgacccagacatagtcctggagtataatgctaatgcttggcccacggaagagggagtgtgggacatgcggtcatgggtgaggggtcagtggattccctttgacgcagatgccctcagccagttcctgggtgacccgctagtgttggaggaaggtcaggagtgcgagttcagtcaaaggaggaacagggccgacgggttcgacgaggaggccattgcccaactattgtgcacaccggggcaggatttcgcccggaccgctgccgggaggcgagtgtggatcatgtgcaccagcatgaccaccttgacatag

SEQ ID NO: 11400 - DNA, 534 bp, Glycine max
  Peptide Sequence Number=SeqID_103085
atgaagcacttcactgacaccctcatcagtgccaacataatagcagctagcactgtcaaaataatagtcatttaccctccgccgtttttccagctgcaacctcaatgtaaggtcttcaacttgcttttcaagcttatttttggcagcttggagagctcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11401 - DNA, 150 bp, Glycine max
  Peptide Sequence Number=SeqID_103086
atgaggaaagagattagtggcagtggtgagaaggtgagatgtggtaaagaggaagatggagagaagagagtgagtgaggggagaaggaagaaggcatactcaactgaaaagaaaaggactttattcggtcctagattcatcttgaaatag

SEQ ID NO: 11402 - DNA, 396 bp, Glycine max
  Peptide Sequence Number=SeqID_103087
atggtaaatgagcatgagaaggttgatgatgtgaaaaaggaagaaaataatcttcttaactgcaaagatgttgaaatacaaagtaccaagagaagtcacaacaggagcacaagtgggtcatcactccatcactacatcgaggtggaggagaaacccctttcgaatttgaaattcacgtctccatcttccctccagataaaaggaggattaaaaaaagtgaggttcaaattccagattgtgagaatgcaaatgagcgatgcggaaaattggaaaagaaaaaagagtgagtacccgatttggcttaaggcagcaataatggatttgaggttggagagcttgtcagcatcaacagggctaatgatggacccgatttggccattgctgccatggaagtaa

SEQ ID NO: 11403 - DNA, 225 bp, Glycine max
  Peptide Sequence Number=SeqID_103088
gatgtaccatctgtgggggagctcatgaatctggatgttgtatacctattgaagaacaaaccacacatgaagtcaattacatgggaaatcagcccagaatcaattttaatgcaggtggattttctggattccaacatggccaacaatacgatcaacaacagggacaatggaggaaccaccctggaaatcaattcaatagagatcaaggtggaatttatagcctaa

SEQ ID NO: 11404 - DNA, 396 bp, Glycine max
  Peptide Sequence Number=SeqID_103089
atggttcaaagttcagagattttatgccacgtaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11405 - DNA, 310 bp, Glycine max
  Peptide Sequence Number=SeqID_103090
atggcacgcaacgtgtttgcttcgtgcccctattttagggacctacatgggagggagctaaaagggcttttagtgataattcccaaggtggtcatatctctcttgatggtctctagaggtatcatccccttcgaagaacatattgcggcagtagcgactactagcaataatactggagtcgccaactgtcacaatctacccttcggcgggagggcgacgcaagggctcacgggtgtgtcttccatgggaggaagatgcgcggagtcgccaccaacgtttattcgaggaaaacgtcagaaaaaccagaaag

SEQ ID NO: 11406 - DNA, 761 bp, Glycine max
  Peptide Sequence Number=SeqID_103091
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttattgaacttctttctgtttgggaaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11407 - DNA, 576 bp, Glycine max
  Peptide Sequence Number=SeqID_103092
atgggtgaagtacaagaggtgcaaaagcagatgaaggctgacatgatggccatgaaagagcaaatggccacaatgatggaggccgtgatgagcatgaagaagataatggaagccaatgcggttgcaattgccactaccagtgtcattgctgaggtagacccgactcccctgtctggcctcaaccaaataaatcatccaacctcgcataggaacaagcatgccttcccaccatatggcttgcctcccaactatgcaccacccaatgtggtgcacactcccgatgagaatgtcaataaatccaatcccatactcattgagagccaacaacaccaagctgatcatgcacatgtctctcaacccatcagggagacacatgaaataccccaccacaatctagccgacttcgagcctcgcctcggatacgcccctaaggggcaaacagttggtggtgtactgatgcaatcctatcccgcaagggcattgggtagaagactccaagtagattgggctagagatccaagggaaggccctagggttctcatgagccttagggtatattttgagcccatgggctaa

SEQ ID NO: 11408 - DNA, 228 bp, Glycine max
  Peptide Sequence Number=SeqID_103093
gggtcagtgttaagggtttacgacatagggttagtgatggaagcttgcttgagaagcttctatggaggctggatctttgagcttcaattaggtccttcagtggtgattctccaccatggagatgcggcggaagataaaggagaagagcttagagaggaagcttcaatggaggaagagaatgagagaaagtggcatggaaaattgaaggaggaaagggagagaagttga

SEQ ID NO: 11409 - DNA, 480 bp, Glycine max
  Peptide Sequence Number=SeqID_103094
atgaccatgattacgccaagctcgaaattaaccctcactaaagggaacaaaagctggtaccgggccccccctcgaggctatgatcttcaatgtatcatccacagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11410 - DNA, 48 bp, Glycine max
  Peptide Sequence Number=SeqID_103095
atggccgaccagcaggctaccaaatccaaagccaaaggacgcacctag

SEQ ID NO: 11411 - DNA, 679 bp, Glycine max
  Peptide Sequence Number=SeqID_103096
cagagggctacacgccctcaccttcagagggttatacgccctcgccttcagagggttacatgccctcaccttcagaggactacacgtccttgccatcagaggactacacgtcctcgccttcagagggctacacgccctcaccttcagaggactacacatcctcgccatcagaggactacacgtcctctccttcagagggctgcacacactcaccttcagaggactacacatcctcaccatcagaggactacacatcctctccttcaaagggctgcacgccctcaccttcagaggactgcacgtcctcgtctttagagggttcctcgccctcacctttagaggactactcgtcctcccctttagaggactacatatcctcgccttcagagggctacatgcccttaccttcagagggctgcacatcctcacctttagaggactacacgttctcgccttcaaaggactacacgtcctccactttagaggactacacgtcctccccttcagaggactacacatcctcgccatcagagggctacacgtcctcaccttcagaggtctacacgccctcatagggctacacgccctcacattcatagggctacacgtcttcacctttggagggctgcacaccttcgctctcagagggctacacgccctcgccttcaaagggcgacac

SEQ ID NO: 11412 - DNA, 213 bp, Glycine max
  Peptide Sequence Number=SeqID_103097
atgtcccctaagatgtctttcattctgtggaaatctctccaagtttgggctcacattcgtgatttggctcctttccgcgagcatttcacttctttacagcgcattactgactctttaattaggggcagatccacatcaggtattcaaggagaattacgttgtctggctatagcaattacaattactgcatctggctatctaggaacaagctga

SEQ ID NO: 11413 - DNA, 358 bp, Glycine max
  Peptide Sequence Number=SeqID_103098
taaatgggccctttcagccgaccaagacggtgtggacgacactgtctgtgaaaaatacgacattagcaaggagaaatgggccaagttttgccagagacgcagagacccttcttgggaggatgtgcggaaaaaggcacagaccatccagaagcaaaacactgccccccacaaactggaggaagctgcccagtttggaaccgctgacggcgtcattgaccctccatctcccatcagacgccacgtgaagtggaagatggtctgcatcaagaaaactgggcagatgacgtctgaggcagcaaaggaaatcgctgagaagatcgcgtcacagggatcgttcgtccctcatggacgtcaggat

SEQ ID NO: 11414 - DNA, 507 bp, Glycine max
  Peptide Sequence Number=SeqID_103099
atgtcctcaccttcagagggctacacgccctcgccatcagaggactacgtgtcctcaccttcagagggctacacgccctcgccatcagagggctacatgtcctcaccatcagagggctggacgccctcacctccagaggactacacaggactacatgtcctcaccttcgtagggctacatgccctcacctttagaggaccacacgtcctcgccttcaaagggtcatgtaccttcaacttcagaggactacacgtcctcgccgtcaaagggtcatgtgccttcacctttgtagggctacatgccctcaccttcagaggactacacgtcctcacctttagaggactacacgtcctcgccatcagaggactacatgttccccattttcaaaggggggcatgccctcaccttcagaggattgcacgtccttgccatcataggactacactccctcgccttcgaaaggcgacacgtcctgaacttcagagggctacacgccctcgcctttag

SEQ ID NO: 11415 - DNA, 433 bp, Glycine max
  Peptide Sequence Number=SeqID_103100
atggctcctccaaacctatggatccctgcactgtctcttcttgttgcagtgccagcaattcttgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 11416 - DNA, 465 bp, Glycine max
  Peptide Sequence Number=SeqID_103101
atgaagcacttcactgacaccctcatcagtgccaacatatttggaaaaggaaggcagaagaagcactgctggccagtggacttccatacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11417 - DNA, 266 bp, Glycine max
  Peptide Sequence Number=SeqID_103102
atggaaattgttggacacagtacaagagaaagcttatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11418 - DNA, 884 bp, Glycine max
  misc_feature (44)..(44): n is a, c, g, or t
  Peptide Sequence Number=SeqID_103103
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctgacaacggtagcggaatgccggtatccaaagttggcgtaaccttcgatagcacggctaagacaactggtgctacgcctttgttgagcaacaccagtgcaggcgaagcaactgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11419 - DNA, 305 bp, Glycine max
  Peptide Sequence Number=SeqID_103104
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcctgtcgactcgggtgcattggatacgatgagtacatgcttcaactccaatatgagctggtggttgagatgagctcatgtagctag

SEQ ID NO: 11420 - DNA, 144 bp, Glycine max
  Peptide Sequence Number=SeqID_103105
atggcagaaaccagtcaaggtagggtacttaaggatgaacgcaagcggggatggggtcacgaccgaccgatcgttatttttttctgtgggaaacaagcagggaatgtcgctgcaaggcagccccgtatcctttttattttgtag

SEQ ID NO: 11421 - DNA, 471 bp, Glycine max
  Peptide Sequence Number=SeqID_103106
atgacgttgctgctcagcaacatcctgcccagcgatcataactctgacctccctctgtcgaagtgtcagctagtgtatgccatcctgacacggatgagcgtccatgtggctcagttgatcgctgatgccatttatttgtttgcaggtatgccacctaccaggcaccctctagacctagataagtctaacagggccctggggtttccaacgttgatcacgggtctctgccaatcattcggggttcgcgtcacacctagtaaggctgcagacgcaccgccaccacctcatcaggctggtccaactgggtcatttggcatggagcgggggcaggtgcagatccatgagagtctctaccagctcagcctcaatcagcagagtcagggtttcgctccttttgcgtgccctactccagatcagttcagggctgaggttgcttggcctgaggcccaggcaggggaggcgcccgcagag

SEQ ID NO: 11422 - DNA, 204 bp, Glycine max
  Peptide Sequence Number=SeqID_103107
atggtggtcatcgtgcccaaggaacatctagttgtctatgctttaaaagttattgatgatgctccacggcctaaatcaaaggctcctactaggtggattgtcgttaagtattttaacgatcctagaccattggagccagagagattaaaggccctacggatcaagtgggcacattattatcttcgagttagagctcaaagctag

SEQ ID NO: 11423 - DNA, 144 bp, Glycine max
  Peptide Sequence Number=SeqID_103108
atggatgaacgtccacgtggcccaggtatggcgcctactaggcaccctctagacccagataatttcaacagggccctggagtttccggtgctatcacaggcctctgccagtcctacgaagttcccgtcacccccagtaaggtaa

SEQ ID NO: 11424 - DNA, 267 bp, Glycine max
  Peptide Sequence Number=SeqID_103109
atgaaagccagctcgatctctcgaacttccgcggcggccctccgtcaaagtgcatcatctctctctcacttgcggcatcgtctctctcattgggcagaggctccgcttagttttgttatgatgctgaggcgcctgtgtgttgtgttgatgatgttgcataagaagaagaatggcagtgaaaacggcaacaacaaggagaacgaagacaccaccatcaccgatgtcttgaaggtcgaagtgcactacgaaggttgcgctcccgtatag

SEQ ID NO: 11425 - DNA, 471 bp, Glycine max
  Peptide Sequence Number=SeqID_103110
atgcaagagacgctcctcagtctttccgaacaccaccaccaagacgacagcaacaacaaagacatcgagctgcttctggttccgccgccgtgccgccgccagccgcggatggcgcggcgcgtgtctccgggcgcggtggaaaaagccctcccctgcggcgacatctacagcggaagcctctccggcaacgtccctcacggcaccggaaaatacctctggtcggacgggtgtatgtacgagggcgagtggaagaaaggcaaggcgtgcggcaagggccgcttctcgtggcccaccggcgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 11426 - DNA, 415 bp, Glycine max
  Peptide Sequence Number=SeqID_103111
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataggcagcggggaagccacaaaagcctacagcaggccgggcgggcgcggtggctcgcgcctgtaatcccagcactctgggaggccgaggcgggtggatcacgaggtcaggagctccagaccatcccggctaacagggtgaaagcccgtctctag

SEQ ID NO: 11427 - DNA, 165 bp, Glycine max
  Peptide Sequence Number=SeqID_103112
atgcgctcagcgagtcgtttgtctccttccaggcttagcgtgattttggctctaagcgaaaattcacttactcgcgctaagcacgaaaatggaactaagcgtgacgtcgaggagcttctttgctatggaaggctaaaccctcagttggggattcttgttgggtaa

SEQ ID NO: 11428 - DNA, 687 bp, Glycine max
  Peptide Sequence Number=SeqID_103113
atgtgcaacctctttgaggggcccattgttacaaccaaacacaatgatgatgaacaatatgtttgggagtctgatgctggaggttctttcactgtcaccagggataacactggtgaggttcttggaaggggtactaagatcactctctacctcaaggaagatcagcttgagtaccttgaggagcgtcgcttgaaggatttgatcaagaagcattctgagttcattagctacccaatttttctttggattgagaaaactaccgagaaggagatctctgatgatgaggagggtaaggtggaggatgttgacgaagagaaggagaaggaagaaaaaaagaaaaagaagattaaggaagtgtcacatgaatgctccttggtgaacaagcacaagcccatttggatgagaaagcatgaggagatcacaaaggaggagtattctgctttctacaagagtctcaccaatgactgggaagagcatttggctgtcaagcccttctcaggtgagggacagttggagtttaaggctatcgtctttgttcctaagagggcaccttttgacctctttgacacaaggaagaagcctaacaatattaagctttatgtccgccgtgtctttatgatggacaattgtgaggagttgattcctgagtatttgggctttgtcaagtgctttgtcaagggtacctag

SEQ ID NO: 11429 - DNA, 366 bp, Glycine max
  Peptide Sequence Number=SeqID_103114
atggaagccagcgaaaagaaaagcaacgattttttaataataaaaaatagaacgcagcacgtgccagaagaaagcaaacatgcagagacgaaaatcagcaaacaacaaaaaactgacaaacacacacatgcacaacagagggacaaaactcaaaccttcaactacagaaaaccggaaatcacgaacccgaaaccacagcctcacgccaaaatgctaaacaacatagcaggtgtattgaagacggaagccatcagcagctctaaaactcaactgaaaacaaatgcaaaaagtgaaactgaagaggacacaaaaatgaagaagaaagaatggaaactgagcataaatgagcaggttcgaagttgctag

SEQ ID NO: 11430 - DNA, 675 bp, Glycine max
  Peptide Sequence Number=SeqID_103115
atgactttgaaattgccttattaccctaaattagttcaagtcttttataacaacttggaaattcatgatggagtcatattttctgaagtacacaaaatacccattgttgttgatcaatccttgttttactccctaaccaaactgagcagtcaaggtgtgccttttgaaggaatcttagttgatgattattctagtcatgatgctcgtaaaattatttgtgttgaaaatgctgataagacaggtcgcttacttgctggttcctttacctttgaatgtcgtgttatgcattttattctctgtcatgtgttgcttcctcgttctactaaccttgctcaagcctctgagaaagatttaattttgttgtgggcactgcaaactgatcgtcaaattgactgggcacatcttatttgttaccgtatgcataaggcattatgggcaaatgcccctctaccatatcccgatctggattacctggctagtgctcccaaggaacgcactccatctccaccacatagggatccctcctctactttactgaatgatgttctcaacgagattcaagatctttgtgcatttgtcggagaaaggtttgattccatggattctcacatcactcctcttgaggatgacatgggatttatccgtcgttgctttgatcctccaaccgatccttag

SEQ ID NO: 11431 - DNA, 530 bp, Glycine max
  Peptide Sequence Number=SeqID_103116
tacctattttcttcagagggctacatgtcctcgccattagaggattacaagtcctcaccttcagaggattacaagtcctcaccttcagaggactgcacgtcctcgccttcagaggactgcacgtcctcgccttcagaggactgcacgtcctcgccttcagaggactgcacgtcctcgccatcagaaggctgcacgtcctcgccatcagagggctgcacgtcctgaccttcagaggactacacgtcctcaccttcagaggactgcacgtcctcaccttcagagggtcatgtatcttcaccttcataggactacacgtcctcacctccagaggactacatgtcctcgcctttagaggactacacgtcctcgccttcagagggctacacgccttcgcctttagaggactacatgtcctcgcctttaaaggactacacgtcctcgccttcagagggccacacgccctcgcattcagaggactacacgtccttgccatcagaggactacacgtcgccaccttcagggggctacac

SEQ ID NO: 11432 - DNA, 396 bp, Glycine max
  Peptide Sequence Number=SeqID_103117
atgctttgcaccctcgccagagcacgcaagtgggacctcgtggagagtttatggaccgaaatgaatgcgaaaggggttgcccctgtgaattccacttatgggaccttgattgatgcttatagtaaacgtggactcaaagaggaagcacttgcttggcttcagacgatgcaaagtcaaggaatggagcctgatgaggtcaccatggggattgttgttctcttgtacaagagggtcggagagtttcaaaaagctcaagagtttttcagaagatggataagaggtgcaccttttagattaggtgtgtgtcataccctaatttcgtctggggagctaggtggcaaccacctcccccgttttgctaaaaatgggcttccggggcttccgggacatccgtaa

SEQ ID NO: 11433 - DNA, 338 bp, Glycine max
  Peptide Sequence Number=SeqID_103118
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgattttatgtctctggaaagcttgcccagcgcaaaggtagcaaccaaatctgccaacagataggtcaaccagacacagacatgtag

SEQ ID NO: 11434 - DNA, 84 bp, Glycine max
  Peptide Sequence Number=SeqID_103119
atggctctcagttatttcgtcaccatttttgcaacttaccatttctgtagtgtgcgccctcgtccgcacgaccttttcaaatag

SEQ ID NO: 11435 - DNA, 441 bp, Glycine max
  Peptide Sequence Number=SeqID_103120
atgtatgttgccctgcacctccaagcacaaccatcgtcatcacaaatgacaattagctttgttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11436 - DNA, 351 bp, Glycine max
  Peptide Sequence Number=SeqID_103121
atgaaatataagagggataaggaagaaaaactagaaaaacaaatgaaaaaaaaggataataaagccttgtctacaaaggccaaggggaaggaaaaagaggaaaaggattcctccaagaatattgttaagaaggaaaattattttgcaacaaaaggtgatatcaaaagagcactccttcttaaacaatctttctaccttctcctaacaagggaaacatcccttagcactgtcatacctcttgagcttaaggttattcctcaagtaaaggagttgttggatgagggttttggttcgtattgtgatccaccaaatccctatgataggtggtatgatgaatgtgttgagtggtga

SEQ ID NO: 11437 - DNA, 450 bp, Glycine max
  Peptide Sequence Number=SeqID_103122
atggtgaaagttggaacctcttacgtgccgatcaacgtctcattttcgccaaaagttggcccagggcttcccggtatcaacagggacaccaggattttttatttgcccgaagtgcttccgtccgtgtatttttcggccggcagaaggcgtcagaaggtgatgctgctatcaagcttatcgatttacgtcgtacctcgagggtttggggctccagggcttctgtttctcagcttccctcctgttcagctactgacggggtgggggcgtcattcgcctaattcgagtgagctaactgcacattgggaaggttgcgatcggtgcgggcctcattgcccgctattacgccagctcgggaaactggggatcgtgcgcaaggctgcattaagtgaggtaacgccggggagaggcggtttgcccagtcacgattgggtaagcggcagtgaattgtaa

SEQ ID NO: 11438 - DNA, 878 bp, Glycine max
  Peptide Sequence Number=SeqID_103123
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaaagtggtcggccaaaaaggaagcaaaaatgatgcatgaaatctggtggtcactgccgctgacgctgatcgtgtttttcctcgcccgcaggctggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11439 - DNA, 657 bp, Glycine max
  Peptide Sequence Number=SeqID_103124
atggcaaaagcacagtcgcagatgggcgacacgattcaatccgtagagcaggcctttactgaggccatgggcaatgtcagcaaacaacaactgcagacatttcaagcgacgctggaaagtcagtcaactcagcaattgcaagcaattgaagaaaaactctcgcatttaagtgagatacagcagcaattagtgtcttcagccgagcagtctttgcgcgaaacattggaaaagaccacggagcaatcgttaaacgacgccatcatgcctttgattgaacgacagcaagcgcagttagaagggcgtgtgcaagtattgcgtgaacaattggaacagggcctggatgtccatttacagcaactgcaggaaaatagtcgccaaactttggctgcaggtcaggaagttgctgcgacagagttggcggcagatttcaaagtgtctttgcagcaggcctttgccgaattgaatgcctcacaactcagtgagttcaggcaaaacatgcaatctgaactgctagcatctgaaaccgccttacaggaaaaagtggcggcaatggtgggtacgcaattgcaggagatggaagccgaaatgaacaagcggcttaaatcccgtatcctcgaagtattgcagggcatcaaatttgtgatgccgacgatttag

SEQ ID NO: 11440 - DNA, 767 bp, Glycine max
  Peptide Sequence Number=SeqID_103125
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgggcggcccccatgatgtgcaaattcaaaacgagcacgccttcccgtcatttggcttgcctctcaactatacgccacccaatatggcgtacactcccaataagaatgtcaataactccactcctatacccattgaaagccagcaaccccaaactgatcatgcacatggcaagcagttggtggtatacccctacaaaaccctttggagggccctcagtatcacccacgactgcacctcttgcattccacagcggttaaaaaccctcatgactatggcaggaatgggaaagttggatcatctagaggaaaggctcagggccattgaaggaggtgaagattatgcctttgctaacctagaagagttgttcctaatacccaaacatggtcattcccaagttcaaagtgccggactttggcaagtacaaggggactactcgctccaaggaccatctaaagatgacctaatggttgcctgtgttaggcagtatcagtacaatttcgatatggttctgaataggatgcaactacagaacag

SEQ ID NO: 11441 - DNA, 267 bp, Glycine max
  Peptide Sequence Number=SeqID_103126
atggcttgcacccacattccggattcaacaagcgattctcctcaaatttcagccagctcgtatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtggtcttcgtcattggaagtgcggtagacagactttgtggttga

SEQ ID NO: 11442 - DNA, 261 bp, Glycine max
  Peptide Sequence Number=SeqID_103127
atgaacccaggcctaactcacaaaaactatccccagtggagtcgccaactgccgcaacctacccttttgtgggcgaggctcacgggtgcgtcttccaaaggaggaaaatgcgcggagtcgccaccaacgtttatttgtggaaaacgtcagaaaaaccgaaggaaaccggtcatgaagaatattccagattcgggagttgtatttacgtttgaggaaggtattatcacctctcacgtttgtcccaaaggacaacaaccttaa

SEQ ID NO: 11443 - DNA, 329 bp, Glycine max
  Peptide Sequence Number=SeqID_103128
accttgcaccttacacttcagagccctacaatgctcaatggaacgccccggggcttctccgtgacaagcacacgttgcgttcgagtcgtattcttggagaaatggaggttgatgaacctcggctagggctttctcgctgcaaaattcatttcttggttggtgttttggtttatgctaaagggatggcctttgtggataactgggcggtgggtaaggagaaggtttgtaggaaacttggctgtataggaatggcagtcacagcacgggcttctccttcatcctcaccctcttcatttgccgcagttttctcattcgtccaagcaggatga

SEQ ID NO: 11444 - DNA, 737 bp, Glycine max
  Peptide Sequence Number=SeqID_103129
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccatctagattggcattgaagcctgatggcttatttttagcagctattcttgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11445 - DNA, 492 bp, Glycine max
  Peptide Sequence Number=SeqID_103130
atgtataaagccatgctgtacccctaccaccttgggcacatgtcatcaggacctcctgaggctgtgtcacagcacaaagctctgggaaagcaattctccctagagcctccagtgggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11446 - DNA, 219 bp, Glycine max
  Peptide Sequence Number=SeqID_103131
atgcagaccaacatcgtagaagtggaaaactttgttcagcacagtgaagagagacgaagtagcgcgttccagcgcgaagtgaagaagtatctggaacgttatccgttaacccaacatgtcgacgtactgttgaccgatctgaacggcagcttccgcggcaaacgcatcccggtcggcggcctgaacaaacttgagaagggctgttacttcccggcgtcg

SEQ ID NO: 11447 - DNA, 300 bp, Glycine max
  Peptide Sequence Number=SeqID_103132
atggggatacaaaagaattctcaggcggaatgggaagaatcaaaagaattctcagactgtgtcgttttgaattctttgacaagggagaagggagacacaaaagaattcaggcggttagtcctttgttcttttggaaaagggagaagagagacacaaaaagaattcaggcaattagtccttggcgaattctttttggcaaagggagaagagaatgaaaagatgaatagcacaagttttcaaggtttggaaaaccagaaaacttcagaaagcttttggtacaaagaagaagaagaagtttaa

SEQ ID NO: 11448 - DNA, 180 bp, Glycine max
  Peptide Sequence Number=SeqID_103133
atggctccgaaaaagctttccacgaagaggtctaggagagacgccgcggcagaagggtccagtgccgccctcgagtttgatagccaccgtttccggagcgccgagcaccagcagcgcttcgaggccatcaaaggatggtcgctccatagagagagatgccctcagccagttcctgggtga

SEQ ID NO: 11449 - DNA, 459 bp, Glycine max
  Peptide Sequence Number=SeqID_103134
atgccgatctccccctgcgaaagtatcggttggtctgtgccatcccgacataggggttgcacccacaagacacccagtggacccggaggagcccaacagggccctggggtttccagctctggttacgggcctctgtcagttctacagggtgcccatcccccccagcaagggatcgcgcccgcaagacacccagtggacccggagaagtccaacagggtcttgggatttccaattatgattacgggcctcggtcaattctatggagtgcctgtcgcccccagcaaggtcatcaggccccctactaaccgagttttcatcaagaagtactgcgtccctaggcaggcgcaggacgatacaccccaacagcctggggatggccggcagtgggcaacagacacaccgccgccacctccagagcaccttagttcatccacaaaaaggttagagcgttgcctatga

SEQ ID NO: 11450 - DNA, 228 bp, Glycine max
  Peptide Sequence Number=SeqID_103135
atgtgtaggtttagaataggtagcaaaatacctttggcaatttacactttgggtatgatagcaaaatacttggatgtattagaaataccaagatgtgcacatgtgcaacttttggtaccccaaaatgctttgagtatgcatgtatgtgaatttagccaaggaggaaatggccccgaggaagcttgcctcaaagaggtccaggaaggacaaggcagcagaaggaactag

SEQ ID NO: 11451 - DNA, 353 bp, Glycine max
  Peptide Sequence Number=SeqID_103136
atggctaagtttgaagccctgctccagagattgaaggccttgtgcctgccagtgattatcaccttggatgacatcacgtcgttgctacatctgcctatcgtagggacattccacagcttcgagcaacttcatgtcgatgacactgtcgatatattggtggaattaattgaggtcaacgctgcaaagatgaaagctgagatgattcaatcacgagcgtatttgttgcatgtgcttggatgcacattctttgctaacaagagtgccatgcacgtgcacgtggtattcttggatatactacgagacttgacgcacaatgagacttacgcttcgggcgctgctgcacttgtgcacat

SEQ ID NO: 11452 - DNA, 884 bp, Glycine max
  Peptide Sequence Number=SeqID_103137
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgatgctcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11453 - DNA, 330 bp, Glycine max
  Peptide Sequence Number=SeqID_103138
actccagatgagacaagaatagaaattttgttggacttgaggcgcacgatgaaggacacgagaggtgaatgggatgaccgagtctttgatgccaagacgaaaggaggcgcagtcagcagtggcgcagttgaaccttccgttgttgttggagcatttggtttgagcccagaacgcacccgactatatggagatggaatgtccacagagtttgatgctcctgaagccaactcgaaacctgttgttgataactgcggctttttatcaccggttagggttactggccataccgtgtatgtgcacttgtttgtgaaagtcaccttggctccttga

SEQ ID NO: 11454 - DNA, 306 bp, Glycine max
  Peptide Sequence Number=SeqID_103139
gggttagaggacttgacacattctcttttgtacacaaccttgttgctagatgcaacaattgcatcagctaaggaggacattacaacgtctgtgtttaagaatgtgttggaagaggctcatcaactatggaatattggaaaaagcataggcatggaggcagggctaggtagaggtattaaatgggcctctatcaggaacttggtggggaaactcaaggtggaccttctctgtttgcaagaaacaaagagggactctcttgataaggcagcttgtcaggctttgtggggtcatccagagattgattag

SEQ ID NO: 11455 - DNA, 672 bp, Glycine max
  Peptide Sequence Number=SeqID_103140
atggcgaatgccgatgctgaaccttctaccaccagcttggaccgcctcgaggccgccatggccaaactcgccgcagcccaagctttcatggattccaatctctatgcatctcaactttgtttcgcagtgacccaagcctccatgatcttcaaacttgatctcattatcctgaaactggataccatgatatctcgccaatgctccccgtttccttcttcggtgcagtcatcgtcgccgccagctcctctgccgaacgtttattattaccaccccagccagtaccctcctccgcctcgctctcacccttatcctcaagaatggggtaacccaaactggccattgacagatgccttaatgttgactccccttcttatgccgatcgcgattccatgtcccgcacctaggcaacaaagccccacacccatctcgactccgcttcccatggctggaaaaggagatggtcctgctatcggaatcgattccagcaccacctacttccccgtcagagtgtggcagcaccaccgtgtcgacatcaacctccacctacttctccaccttcacttttgttttgattgtccaaccttgaggacaaggttggcttttccagcagagggtaataatagcaatactgatggaaataacaacacaaaaagcctcataccactaccttag

SEQ ID NO: 11456 - DNA, 1755 bp, Glycine max
  Peptide Sequence Number=SeqID_103141
atgaacacagcaaaatctggtgtccgtcttgtaaaaagtcctgatatcgtgacccgtgcacgaggcatactattgcacgaagcggatgaaatccgccaattggccgaccggttaggcagtgcctttgaagctgcggtcaacttgattcttgattgccgaggccgcatcgtggtcacaggcatgggaaaatccggacacataggcggcaagattgcagccacactcgccagcacaggcacccccgcttttttcatgcatccggctgaagccagtcatggtgacttgggcatgattacggctgaagatgtcgtcattgcgctatccaactccggagaaagcgatgagatcatcaatattttgccagccatccgccgtattggcgcacgcattttgagcatcaccggtagcgaaaattcaaccttgtcacgtgagtctgaggtgcacttgagtgcagcagtgagccacgaagcctgcccactaggattggctcccacagcaagcaccacagccgcccttgccttgggcgatgcactggccatctgcgtactggatttgcgcgaatttacagctgaggatttcgcacgctcacaccctggaggcagcttaggccgacggttgctggtcaggattaaagatgtcatgcgtaccggggacgcgatcccatacatttatgaacaagcaacggttcaggatgccattacccaggtttccagcaaaggcatgggctttactgcgattgtggatgccaagcttcatccgggcgaaacccacactgagactgcaatcacactggtgatgaataaacgcccccgcttgttaggcacgcaacaaatggcggttgaagcagtcaacatgatggagcaatataagattaatggatttctagtcatcgacgagcaacaacaattgacggtccaggagcaaggactcagcatgagccgcttgagccgccatgatccagactacatgctgcataactttgtcagcacccgcactaacgctgctgggatgaccaaatacgtgttagcagcagtagaaatgcgccactttcctgacaatgactatactgaattaaaacgtccacgttttacccaatttgggctggacaaaccttacacccaaatttatgggcagcgtggaaaaatttccgccaatggtaaactggtggagtttaacaaacaggtaaaagtcgtccgccagggcactgctcaaaaaggtgagatgcaactgcaaactgaacggcttatcatggagccagatacggaaaccgcctataccgacttacctgtcacgattcaccaaaaaccggcaactgtcattactggcacgggtatgcgatttgataacaagacagaaaccatgcaattatttaaccgggtacatgtacattacgagcgtgcaccggtcgcaacaaaacctgcaatcccgacagcgcctgccaaagccggcagccgaaggtggtcaggcagcgcgttggctgaagaatcagaccgtgaccagcccattgagctggaagcggataccgtaacggtcaacgatgccaagaaaatcagtgtttatacaggcaatgtcatcctcaaccaggggactttacagatcaaggctgacaaaatgattgtgcgtgaagaccaggatggttttcagcatagtacctgtaccggcaatccaaccaccttcaagcaaaagcgtacaggcaaggatgagtggatgcaaggcagtggccagcgtatcgagtacaacgcccgtatggacaag

SEQ ID NO: 11457 - DNA, 492 bp, Glycine max
  Peptide Sequence Number=SeqID_103142
gtatgccgcctaccaggcaccctctggacccggataagtccaacagagccctgggatttccagcttttgatcacaggactctgccagtcgttcggagtctccgtcgcacctagtaagagacaggcacagggtggcaaccctcaggccccagatgcaccgcctccacctcctcaggctgacccagctgggtcatttgacacggagcggtatttacgacatttggttcgccaacaggcggccaaccacagggcgcacgagcggacccatgactctctatatcagcttagcctcagcctacagagccagggttttgtttcttttccatgccctactccgaatcagttcagggcagaggtcgcatggcccggagattggcctgaggtccaggctgcagagggatccgcagaggctcccggcgagccagatgaggcccgcgaggatgaggagatgtcagatttgttcggcttcttgggagggagtgcagccacatga

SEQ ID NO: 11458 - DNA, 228 bp, Glycine max
  Peptide Sequence Number=SeqID_103143
atggatgacaaccaattcatggggctccgaataaaattggagaatggagaactggcgaacagcgctagacaatcaattcgcggggctccagacacgttggtggaggatgcatgtatgacaatcagttcatggggatccgaaaaaaagtggagaatggagaattggctaacagtgcttggcattcaattcgtggggctccagactcgttggtggaggatgcatgaatga

SEQ ID NO: 11459 - DNA, 495 bp, Glycine max
  Peptide Sequence Number=SeqID_103144
atgaccatgattacgccaagctcgaaattaaccctcactaaagggaacaaaagctgcgtcctcgtccagaacgcgtactcgctgaccctcttcaccgatcttctcggccagcacgaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11460 - DNA, 558 bp, Glycine max
  Peptide Sequence Number=SeqID_103145
atggcggaaatctgcacgccgctgccgggcgcggtttctctgcttaacgccattcgtggcaacgccaaaatcggcatcatcaccaacggctttagtgccttgcaacagaagttggcgttgccaaaccgaataagaaaattttcgattatgcgctggaacaggcgggcaatcctgaccgttcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11461 - DNA, 351 bp, Glycine max
  Peptide Sequence Number=SeqID_103146
ggtgatagggcactggtaatcgattaccagttgggtgtaatcgattacatagtgttacctgctactgtacatccgaaggaacccgcacacacacttcagcagcctgtggagtggatactaccgacacctactccatatcgactagttgagccggttcaagtgatagaggtgtcatcctctgaagaggatcttgaagaggacctagaggagttacctcctgaacctgctatggacgcccttgacatacctgaggatgatgaagacccactccctgatgttgattctccagaggatattatgtcagcatttgaggcagactctacagaggagagtggttcagaagccttttag

SEQ ID NO: 11462 - DNA, 255 bp, Glycine max
  Peptide Sequence Number=SeqID_103147
atggtgaaagttggaacctcttacgtgccgatcaacgtctcattttcgccaaaagtggcccatgggcttcccggtatcaacaggcgtgaccaccgcgcctggcaggttaatttacttctgaaggaattcttccgtcttgagaagcagggcggatgtgtcaaggcgttactatgttgggataacgcagggtgtttccagtcgaagtgctgtggcaggagaaaaaaggctgcaccggtgcgtcagcagaatatgtag

SEQ ID NO: 11463 - DNA, 984 bp, Glycine max
  Peptide Sequence Number=SeqID_103148
cgctgctgtttggccgcaacgactatgcgccgtcgccggcccggctgaaaacggtgttgttcaagaacgtcagcgacgccggcacccgccgtttgctgttgctgaaaggagatgccgacgtggcctacgatctgggcgccgaccagttcgactcgctgcgcaacgcgtctggcgtgcgcatcgagcaggccgatgcgccccgggtctattacctcggtttcaacaccggcagcaaagacaacccggcgctgggcaatccggcgctgtggcgggcggcgcgctggctggtggattatcaaagcatcgccgagcaactgctgaaagggcaatatcgcgtgcatcaggccttcttgccgcagggattggatggggcgctcgacgatcggccgtttacgctcgacgtgggcaaagccaaacagatcctgcgcgatgccggtattgccgaaggtacgcgcctcgatcttatcgtcatcaatcagccgccgtacactgacatcgcacaggcgctgcaggccagcttcgcgcaggccgggctgcggctggatatccatccggtggtggagagcgacctgtggggcaagatgcgcggccgcgattttcaggcgatcttcacctactggggcgccgactacctagatccgaacaccaacgccagcgcctttgcctacaacgtgcccgggcaacagcgccgcgcgccgcgcacgttatgccgcgctgcaacgggaactgcaggccagctcgccctatgtagtggcgctgcaggggcaaacgctggtggcattgcgcgacaacgtcaaaggtgcccggttggatatcgccaacagcatgctgtatctggatcgggccgcccgtgcgtgaaatcgcttgctgctgcaacctggaatcgtgagaggttttgtcagggcggacacatcacctcaggagatattatggacaataacggaaacgcttcagtggagcgcgcggcaacctggctcgccgccg

SEQ ID NO: 11464 - DNA, 288 bp, Glycine max
  Peptide Sequence Number=SeqID_103149
atggataatgaggagggagtgcaagaacagatgaaggccgacctatcggccttaaaagatcaaatgacttctatcacggaggccatgctaaagcttcagaaaactatagaagataatgctacggcgattgcttccaatacagctagggaagcaggaatcggtgctacagcccgcaataaacttgggctgagacagaaacacgacgggtttctcggagatatagtcctcaagcttacccttatggtttgcctccggacttcactccccgtaccgctccagacgatttga

SEQ ID NO: 11465 - DNA, 839 bp, Glycine max
  Peptide Sequence Number=SeqID_103150
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggcatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11466 - DNA, 444 bp, Glycine max
  Peptide Sequence Number=SeqID_103151
atgaccatgattacgccaagctcgaaattaaccctcactaaagggaacaaaagctggctcttaaactcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11467 - DNA, 155 bp, Glycine max
  Peptide Sequence Number=SeqID_103152
atggcatttgtgcgcaatacacaatgcctagtacaccacaacaaaatagtgtatcagaaaggcataataggaactttaagggatatcgttaggagtatgttaatcaattcaactttactcgtatctttatcgatgtatgccttgaaaactgtcat

SEQ ID NO: 11468 - DNA, 519 bp, Glycine max
  Peptide Sequence Number=SeqID_103153
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatccaggttctggtcgtgagtcagctattcgtgcgcttgctgccgctggtcttgaagtaacagcaattcgtgatgtgactccgtgccacacaatggtgctcgtcctccaaaacgtcgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 11469 - DNA, 147 bp, Glycine max
  Peptide Sequence Number=SeqID_103154
atgtcggctgaaaaatatcagtcggggctttacgcctaccaatgtcggctattgctaaaggcccaagtggagaaggacggaggcctaagtggagaaggacaaagcccccaagtggagaaggatgaaggctcaagtggagatggatga

SEQ ID NO: 11470 - DNA, 528 bp, Glycine max
  Peptide Sequence Number=SeqID_103155
ctccgtcggggggttgttgttgtcagatacagaccggagagggttatgctccagttcgactacgtccagtgcattcctacacatcctgtccattcatgggtgtcatatgatgacgtggacgatacttggacgcactactcagaccatctggcagcagtaggtgatctatgtgttgtgccaggtcagtgtgcgcttgattacatggactggttcttcgtcatatcgcatttattcatgactgcgccacagacggatccttctcgagatgcatatgtgacgcaacccagtcatatccctcatgaggcaacatcggcatcgacacatgcagatcctgatgcggacgagcccagacatgcagtgaaggcttgccatgcgattgcggaggcgttggagcaacatctaaatgcgccaggcacatccacacatgaagaggtcatccaaaaatgccttaggattgtcaggggtgtcacagaagaccgcaatgtgtatgtgaggtctcgacataggcgccgcccggatcaacaatag

SEQ ID NO: 11471 - DNA, 222 bp, Glycine max
  Peptide Sequence Number=SeqID_103156
atggaaaggatccaaaagtccccatttagtgccaactcccaagggtggtttcatgtaactttactggcctctagagatatcatcctcttagcaataatgcatcaccaaaagaggaaaactctagatgaggtctcactgttatcaagcaagtcggagacccagcatgaccacagatcgacctccactctttatggctcacatagacccgggtacaaggcctaa

SEQ ID NO: 11472 - DNA, 396 bp, Glycine max
  Peptide Sequence Number=SeqID_103157
atggccgagagaaattccgaggagcattgtggggtagcaacaatgagctcaagctccgaagagaggaaagagaccgagttagctgcttgcgcaaggtccaagaggagtttggctcaacacttggaagccacggagcaaagcatgctagctatcatagggcagtacaagggagacttgaaccagtctgtgacccatgaacaaaagctagtggaggattttgcacaagtgtacgccgaaaaagaagcaagagggagggtgattgatgcattgcatcaagaagcgactatgtggatggataggtttgccttgaccttgaatggaagtcaagacctcctgtgtctattagccaaagcaaaagccatggccgaagtgtgtacggcccccgaggagatttaa

SEQ ID NO: 11473 - DNA, 231 bp, Glycine max
  Peptide Sequence Number=SeqID_103158
atggataactcagagccctacactggggcaatgaaaggcaccatgcgtgagcctcaagcgaacctatgggtagggtggaccctgggtactagtaccctcaccttcaaaggactacacgtcctcaccttcagagggctacacgtcctcgccttcagagggccacacgccctcgccttcagagggctgcacgccctcgcctttagaggactacacgtcctcaccttcatatga

SEQ ID NO: 11474 - DNA, 288 bp, Glycine max
  Peptide Sequence Number=SeqID_103159
atgccttcgagtaatgccgccgcgtggactgtaggcccggtaaggcgtagccgccaccgggcgattaatactgcagcataccgtgctgcatcaggaaaccccaccacgaatggcaagcgccagcagtacgggcgccgtgccggtgaccagacccacggtggcgaagaccggcaccatggccgccacgtaggccccgccggaggcaaagaaatagcgaaccagtacgctgagaaacacgataatcacgatggtcatattaccggcgctgaggaaatccagatgcgctga

SEQ ID NO: 11475 - DNA, 423 bp, Glycine max
  Peptide Sequence Number=SeqID_103160
atgaagcacttcactgacaccctcatcagtgccaacatattttatttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11476 - DNA, 150 bp, Glycine max
  Peptide Sequence Number=SeqID_103161
gggggcggagcctatggaaaaacggctttgccgcggccctctcacttccctgttaagtatcttcctgacggacattccaggaacacagactcatctcaacggcctatgttgatcgaacttccgctgcagtcccgggggatccagttctag

SEQ ID NO: 11477 - DNA, 441 bp, Glycine max
  Peptide Sequence Number=SeqID_103162
atgaccatgattacgccaagctcgaaattaaccctcactaaagggaacaaaagctgcggaaaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11478 - DNA, 659 bp, Glycine max
  Peptide Sequence Number=SeqID_103163
atgtctactgctcctatcaggaatccaaagagatatgggatactcaaatacactgtcgaggacgtggtcaaaaaaagattcttgtcgcaccgttggaccatgaacaaagaaaaagacatcaagtcctggacagactataaacaacagttaaagcacagacataaacaaatgtcaatgtcaaaccttatcacccacattatcattgaagatacaaataagaaggaaagtgttgcggcaaggaccaaagcaacgcctgccaaggaaaacacggtacaagaaaaactatttcataggaggtatagagttttgagaaatgacaatcctcctaagcttatggctaacctggttaaaggagatgacattattgctatgagtatgtttacctcccacactactgtgagggatggagaagaacaagtttatcttagtgattcaagaactactctggttcaaggaaagggaaaagttcttctcaagctcatatatgggaaaccactagctttgaatgatatgccacatgtttcctctatcagagttaaccttgtttctatagcattgttggaaaagggtctctttgtactcaatgtttctgaagtgattaataagaatgcatattcttatgatgtatggcattctagattaggacatgttaatccaac

SEQ ID NO: 11479 - DNA, 379 bp, Glycine max
  Peptide Sequence Number=SeqID_103164
ggatcgtgcccgcgagacacctagtggacccgaagaaggccaacagggtcttggagttgccagctctaaatatgggtctctgtcagttcaagggagtgtctgctgcccccagcaaggtcatcaggccccctaccaattgagctttcatcaagaagtactgcgcccccaggtaggcgcagggcgaaacaccacagcagcattgggatggccgagcgttgcctacgacacatggccgaccaataggcaaccaagtccaaagccaaaggtaagcaagtacttggtccatgaccgacaaatcattaggcgtccagctcaagacgttaaagaagcgctactaggaggcaacctagtaacttttaaatttctgcttgctatttga

SEQ ID NO: 11480 - DNA, 802 bp, Glycine max
  misc_feature (44)..(44): n is a, c, g, or t
  Peptide Sequence Number=SeqID_103165
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgtcatgttggtgcgcatgatccgcactcgtctcttgcagcggcacgggtgaaatcttgccccggtatgcatagtagctgtgtgatagcctccctctctagttgtgctcgcacagttggccctcctccaatattagggggtggcccaggaaccgtgtggatgtcgaccacactgaaaatgaggacacgtagccctctaaaggtgagggcgtgcagccctctcaaggcgcggaggtgtagtcctctggaggtgagggcgtgcagccctctgctggcgaggacatgtagtcctttcaaggtgagggcgtgcaaccctctgatggtgaggacgtgtagtcctctcaaggcgaggacgtgtagtcctctcaacggtgaggaggtgagggcgtgcagccctctgatggtgaggatgtgtagtcctctcaaggcgaggacgtgtagtcctctcaacggtgagg

SEQ ID NO: 11481 - DNA, 512 bp, Glycine max
  Peptide Sequence Number=SeqID_103166
gattggttggaggagcaggcctcacagggttcctttgtcgcctatggacgtcaagtcggtgccacaatcaagcaatactttggaccagctccaaggacctcccacaggtcttcgtccatggctcccgaagacctaaagcagcttatgcaaaaaattagggaccagctagaagagtcgatcacagaaaaaggactcgcactgcctcctgagactgaggttggtccttcaactgcttgtgtcagcacaaaggagagttgtgttgatccctcagggaacgatccaaacacgggaagactttatgaggggtccacaaccgttcacaacattcctttgcgccatgatcaagtcaaggttggtgctgaggaagttacagatgtagatgttcacattcctgtacccactaaagagggagctgtaggaccagcaaaaccagcagataggccgaatcatgatgtcgatgatctcctatatctaatgacattgaccatcccacagctttttcttaagccgtt

SEQ ID NO: 11482 - DNA, 770 bp, Glycine max
  Peptide Sequence Number=SeqID_103167
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgattcgagagttgtttatgcacgaggaaggtattagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11483 - DNA, 285 bp, Glycine max
  Peptide Sequence Number=SeqID_103168
atggccaagcttatcgattacgtcgacctcgatggtgtttttgaggtgccggtccagtggcttctgtttctatcagctgttccctcctgttcagctactgacggggtggtggccgctctagaaaaaaggctggcccgggctgcaggaatagtgatacagcatatatctcgagatttcgctcatgactcgctacgctcggtcttcgactgcggcgagcggaaatggcttacgaacggggcggagatttcctggaagatgccaggaagatacttaacagggaagtga

SEQ ID NO: 11484 - DNA, 288 bp, Glycine max
  Peptide Sequence Number=SeqID_103169
atggtgaaagttggaacctcttacgtgccgatcaatgtctcattttcgccaaaagttggcccagggcttcccggtatcaacagggacaccaggatttatttattctgcgaagtgatcttccgtcacagctgtccctcctgttcagctactgacggggtgggtgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 11485 - DNA, 291 bp, Glycine max
  Peptide Sequence Number=SeqID_103170
atggaggccatgaaagagcaaatgaccacaatgatggaggccatgatgagcatgaagaagataatggaagccaatgcggttgcaattgccgttaccagctctgttgctaaggtgaacccgacgcccccatctggcctcaaccaaatgaatcatccaacctcagatatgtgggagggcgacgcgagggctcacgggtgcgtcttccaagggaggaaaatgcgcggagtcgccaccaacgtttattcggggaaaacctcagaaaaaccgaaacgtgtggtctacgaactttaa

SEQ ID NO: 11486 - DNA, 854 bp, Glycine max
  Peptide Sequence Number=SeqID_103171
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggtcttccatgcctgggaggctgtgaacgtagtccatcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11487 - DNA, 435 bp, Glycine max
  Peptide Sequence Number=SeqID_103172
atgaagcacttcactgacaccctcatcagtgccaacatacctcccaggcatggaagaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11488 - DNA, 79 bp, Glycine max
  Peptide Sequence Number=SeqID_103173
atggaagttggaagtggaagttactggaagttggaagttggaaatgaaagttattggaagttgaaagttgaaaatggag

SEQ ID NO: 11489 - DNA, 651 bp, Glycine max
  Peptide Sequence Number=SeqID_103174
atggtccaggtgctgctggccgcgtcgcgttcggagaacgtggaactgcgccagtcggccctggaactggggggcctgcaggccaaggtgatggacgtggaggccttcgcggtcgagaacgcctatgccctggtggccagcgagttgccggtgtccatcgagggcgtggtcgcgctggtcgacatcggcgccaccatgaccaccctcaacgtcctgcgcggcggccgcagcctgtacagccgcgaacaggtgttcggtggcaagcagctgaccgacgagatcatgcgccgttacggcctgagctacgaggaagccggcctggccaagcgccagggtgggctgccggaaagctacgagatggaagtgctggagccgttcaaggaagccacggtccaacagatcagccgcctgctgcagttcttctatgcaggcagcgagttcaaccgcgttgaccacatcgtgctggccggcggctgcgccgtgctcggcggcctgccggaaatggtccaggaacagctgggcgtgccgaccgtggtcgccaacccgctggcgcagatgacgctggggccgaaggtgaacgcacatgctctggcccaggatgcccccgcgctgatgatcgccaccggtctggcgctgaggagcttctactga

SEQ ID NO: 11490 - DNA, 905 bp, Glycine max
  Peptide Sequence Number=SeqID_103175
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttcgggtcgtagtccccgccgatcgacgccagtgcgtcgtgctgccactcgtcgggctcgacgccgaacacctcacggacgaacgtcacaggctcgcggcgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11491 - DNA, 367 bp, Glycine max
  Peptide Sequence Number=SeqID_103176
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggctattatgcttggaatccatattgtgtga

SEQ ID NO: 11492 - DNA, 455 bp, Glycine max
  Peptide Sequence Number=SeqID_103177
atggcttccatctcggaggtcatgttaaaactccagaaaaccatagaggataaagccacgacaaccgcctccagtacagttagggaagcggagccggtgctgcagcccgccttgaatctgggcctagacagaaacacggtcgtgttcggtcgaaggtatagtccgcaagcttatccttatggcctgcctccggacttcaccccccatgccaccccggaagatttaagccaagcccctactttcgaggggcaactcccaccttatgaagactatcccgggcaagacgatggggaaggatatacccatcttggccccctgctccacctcaaagatccgtccccacatgaactaccccaaccgaacatagtccgccatatcccggcctcacccacactcgtaaaagaatctgtccccttcgcggaagataaggggaagattgaggcgcttgaagagag

SEQ ID NO: 11493 - DNA, 729 bp, Glycine max
  Peptide Sequence Number=SeqID_103178
tttctgtgggagccttacacagcaactgttatgtcgatgttgccttccatttgtttggttggtattgtggcgtggtgcgcagtggtgccactcatttgtttccatgttgtagagtggcaccaacccgatagagtgttgcgacaatttggaatgcaacaacctattctggagtctccttcgcaaccacagaatatccatgggctaacgctaaaaggcaaacaagatgaaaattggttccagctgcgaaaaacaaagatgtttgtcggcccaaacatagctacattgggtgaagttgcggagacattgcagtatatggtgtcaccacaagggcggaacacatggacagttgatgatctcgtgccttatgtggagaaaataacaattttatccgaagagcaagagaggatcactgagcctgtggcatatggtccagcatcagagcatcgattttccccacaaaagtttcacatgcttcagtcaagtgttgaaactcgagccttagacagacgaagggagattgttcaagcgaaagatttttcccgagggatggagcaacgtggccatggaagggattacacgccaccaacattttctcagtatccttcgcagatgtatcaatatcctttcgaaggtcatgacactgatatgtctgcaagcgaacattcgtttggtggtgttgcggaaacacatcctcatttttcatggtcgaccatgacaccttcgcagtaa

SEQ ID NO: 11494 - DNA, 236 bp, Glycine max
  Peptide Sequence Number=SeqID_103179
atgagcacagggagctcagaagagggggtgactatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11495 - DNA, 501 bp, Glycine max
  Peptide Sequence Number=SeqID_103180
atgaccatgattacgccaagctcgaaattaaccctcactaaagggaacaaaagctgttcagtgtctgtttactggttcaaaaggactagtacaacaaccagttcaggcgttcagccaaatattacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11496 - DNA, 1332 bp, Glycine max
  Peptide Sequence Number=SeqID_103181
ggtatatccttcgtggtacaagtagagggtacatctacttgggttgttgtaactgagaatatgagagggtacatcttttgtggatcagttcaagtggagagtacacccacttggttgttcaaagagaacaagggagggtacatcccttgtggatctttgcttgtaaaggtttttacaaagttgaaagaaatctcaaggaccgcatgttgcttagggactggatgtaggcacaggccacttgatccaacaaaatgtaaatgggttgacagcaacaccgacgtgcggactgatgattcagtggttctacacgggaaaacaattggtgttaatgtagaaaatgatgattcatgcattgatacttatgttagtcctttttccacacaaatgttacctaacgtcgtcggagaagaagaagatgacgatgctgaatttgatatccttgaagcatctgacccgacaaggacagtgtcgatgacattgtatgtgaaaaatactgcattaagaaggagaaatggtcctaattttgtcaaagccatagagacccctcgtgggaggatgtgcggaaaaaggcacaggccatccataagcaaaacactgcccccacatgttgtctcatgggggtttgaatatttagaaaagaagctgatggctgagaagacaaagaaaaaactggaggaagctgatcaatccaaaatcactgaggcaatgattgatcctccatctcccatcagacgacatgtgaataaaacccaagtagatgtaccctctacttgtaccacaaaggatgtaccctccaatgtgttaagacaaagatctcaggctgttaaacctttgatactttgtgaatggggatacaaaagaattctcaggcgggagaagggagacacaaaagaattcaggcggttagtccttcgttcttttggaaaagggagaagagagacacaaaaagaattcagacagttagtccttggcgaattctttttggcaaaggcagaagagaatgaaaagatgaataacacaagttttcaaggtttagaaaaccagaaaacttcaaaaatcttttggtacaaagaagaagaagaagattcattggaagagcaagcgtcacagggttcctttgtcccccatggacgtcaggatatctggactgctgccattgggcgaccagaacaccctggtcgtgtgcgtactgttggacccaatcagggactagttggaggagttgatcacagaaaaagtgactcaacagctgatgttatccttcagtcagatgcagtcccagcttcagtcatagatgcaatcacaaggacttgcactgcctctggagcctga

SEQ ID NO: 11497 - DNA, 165 bp, Glycine max
  Peptide Sequence Number=SeqID_103182
atggtgtatacgaatggcatcattgtggatgtgcaagaacctgattctggagtgaattggggttccctcctaattactacagggagagttcggtatcactttcctaggtatgatggaaagtgtggtggagttggtggtggtgggggtggtggagatgggtattga

SEQ ID NO: 11498 - DNA, 513 bp, Glycine max
  Peptide Sequence Number=SeqID_103183
atggtgaaagttggaacctcttacgtgccgatcaacgtctcattttcgccaaaagttggcccaggttgcttccgcggtcaacagggacaccaggatttttatctgcgaagtgcttcaccaagtcacaatttaatgtgcaagcaaaccgtgcgtcgagggggggccaactgtaccagtgttccctttagtgatgatggtgttaatttgagggctccatggcgtatcatggtctatcagctgtcccttcctgttcagtatgaggaattgttatccgtccaattcggcaaaagcataccgagccggacatcaggggcaagttgctcacccggtggcggagaactaaaaggtgcccccggtgcgtcgcagaatattgatacaggatgtttaatattccgcttcctcgtctcactgactcgctacgctcggtcgttcgactgcggcgagcggaaatggcttacgaacggggcggagatttcctggaagatgccaggaagatacttaacagggaagtga

SEQ ID NO: 11499 - DNA, 374 bp, Glycine max
  Peptide Sequence Number=SeqID_103184
atggtgaaagttggaacctcttacgtgccgatcaacgtactcattttaatgactcccggtatcaagacagcattatacagctttcttctggaagtgattgtccatatcaagcttattcgcaataccgtcgactcgggtggcccggtaccaacttttgttcctttagtgaggcataccgccggacatcagggcaagtgtaaagcgggtgctgacgtgacgcgtaaccaccacacccggttaattgcttgcgctcagggcgcccgtccattcgaccatgtcgggggagtgtataggcttaatgttgggtacactgcagggtgttcagtgaacgtgcttcatgtgcagagaaaaggcgcaccggccagcatgaatat

SEQ ID NO: 11500 - DNA, 495 bp, Glycine max
  Peptide Sequence Number=SeqID_103185
tatcatgcaactagtggggttagcaagtgcacactttgcctgagtaatcgtcagcacccaactgctacttcctgtggtcatgtattctgctggaactgtatcacggaatggtgcaacgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11501 - DNA, 555 bp, Glycine max
  Peptide Sequence Number=SeqID_103186
atgcctctttctcccaaagaattttttgaaagcaccaaagagagcatcgctgcgcttcccacgccggcgcatcttcgcatgccccattggctcaagaagctcaccaacggtagcatcacccacaagcagttcatcctcatccttagttttttggttggggtagcttctggcatagcggcaaatcttctcaagtgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11502 - DNA, 491 bp, Glycine max
  Peptide Sequence Number=SeqID_103187
atggcagacactggagcagcatcgaattttgagattagtgtggacttggatgacgtccaggcagaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11503 - DNA, 731 bp, Glycine max
  Peptide Sequence Number=SeqID_103188
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11504 - DNA, 444 bp, Glycine max
  Peptide Sequence Number=SeqID_103189
atgaagcacttcactgacaccctcatcagtgccaacatagtgcaaagtatccaccatgacgcagccccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11505 - DNA, 354 bp, Glycine max
  Peptide Sequence Number=SeqID_103190
atgtcttctagaaaaagaaagagcattggtgcaaggccgacaactcaatatgacacaagaagattccactccttcgaggcctggaccagatacacagacaatgtgctaggaagacatatactagctgagagaaaggtagaaatataccatatggagttggatgagttcaaggatgaattggagaggtgtaacttccataagcgcctctccaatttagttgacagcaccatcgacctagccttggtgaaggagttctatgccaacctctacaatcccgaggggccttgcccaaaacaagtcaaaatccgaggccacttgataaaattgatgaagatagacctgggatcgctctag

SEQ ID NO: 11506 - DNA, 408 bp, Glycine max
  Peptide Sequence Number=SeqID_103191
atgggtaaagtagaggaggtgcaagagcagatgaaggccgacatggaggccatgaaagagcaaatggccataatgatggaggccatgatgagcatgaagaagataatggaagccaatgcggttgcagttgccgctaccagcactgttactaaggtgaacctgacgtccccatccagcatcaaccaaatgaatcatccaacctcatatatggtaggcaaagatttgggaagtacgggcggcccccatgatgtgcgaattcaaaacgagcacgccttcccgccatatggcttgcctctcaactatacgccacccaatgtggcgtacactcccaatgagaatttcaataactccactcctatacccattgagagccaacaaccccaaactgatcatgcacatgtcttttaa

SEQ ID NO: 11507 - DNA, 408 bp, Glycine max
  Peptide Sequence Number=SeqID_103192
atggcgcctactaggcaccctttggacccggagaagtccaacagggccctggggttttcggctttgatcacaggcctctaccagttatacggagtgcatgtcacccttagcaaggtaatccgactgccgatcacccgagccttaatcgagaagtactgcacacctaggcaggccatttggtttgccagtaggcggccaaccaccatggataggtgcagagacatgagtgtctctatcggttcagcctcagccaagcagttcggagctgaggtcgcatggcctggagactggcccaatgcccaaacaggggaggagcctgcagaatcccccggtgagacggacgaaccccatatggacgacgataagactgacctactcggtttcttgggagggagcggagccacatga

SEQ ID NO: 11508 - DNA, 432 bp, Glycine max
  Peptide Sequence Number=SeqID_103193
atgaagctttactgccatgtcggctcaggcaacttaacgaaggcacggcacgggtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11509 - DNA, 815 bp, Glycine max
  Peptide Sequence Number=SeqID_103194
agaagcagctttttgcatggaagatgtcatcgatgaatataacatctcctgtgaggataagcaacctggtgatcctcgatgtgcagctttactatgtgaggctgttgacttcatcaaaactcaaatccttcgccttcaaagtgcgtacaagattcaggatgttaaatcgcttgttcatgctgaaagagatggtttccaaacccatattcctttagaaccaagactaacaagttctagaggaaatcaagatgtcacctggcagaaacttcgaatggatcctctctttatcgaggaagatgatgttgtggggcttgatggccctagagatacattgaaaaattggttgacaaagggaagagaaaaacgcactgtcatctctgtggtgggaattcctggggtgggaaaaaccactcttgccaagcaagtttatgaccaggtgcgtaacaatttcgagtgccatgcattgatcacagtgtctcaatcctactctgcagaaggactgctgaggcgtttgttggatgagctttgcaaactgaaaaaggaggaccctcccaaggatgtttctaacatggagtcgttgaccgaagaagtgcttaagctagaagagccattaactgaagaagaatcattgaaattgttttctaaggcatttcagtatagttccgatggagattgtccagaagaacttaaagatatatctcttgaaattgttagaaagtgtaaaggtttacctctagcaatagtggccattggtggtcttttgtctcaaaaagatgaaagtgcacctgaatggggagagtttagtagagatctaa

SEQ ID NO: 11510 - DNA, 860 bp, Glycine max
  Peptide Sequence Number=SeqID_103195
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaatagtagtgctggctatgtaatttgtactgattttagtaagaggtgggcgatgcttgatgttttattgtcttgtaactgtggacttttggttctgatctttcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11511 - DNA, 352 bp, Glycine max
  Peptide Sequence Number=SeqID_103196
atgatgcatgccggccatgcttcagaagccgacatcaacggtcacgttgatggttggattaaagcccaccagcagttgttcgatggctgggtgaaagaagcgctggcggcgcagaacgattgtgaagccatcacgccgtctgctaaggtgaataactctttccaggcgttgagcttacaggtggcgaacagcattattatccctacgcaactcagcgctttagcctatggttatacccaaatggatagttcgtttactcccattgagcagatgctcaaattccgcgccagccgccatgaagatttccctttccaggagattctcctcacccgtctctgtatgcacatgcagg

SEQ ID NO: 11512 - DNA, 303 bp, Glycine max
  Peptide Sequence Number=SeqID_103197
gggggcggagcctatggaaaaacggctttgccgcggccctctcacttccctgttaagtatcttcctggcatcttccaggaaatctccgccccgttctgccaacatagtaagccagtatacactcctggcgttagcgcccaacttaatcgcaaacttgcagcacatccccctttcgccagcgttggccgattcattaatagcgaaagctgcccgcaccgatcagccgtttcccgaacagttgcgcagcctgaatggcgaatgggcagccctgtagcgcaagcgcaattaagcgcggcggtgtga

SEQ ID NO: 11513 - DNA, 723 bp, Glycine max
  Peptide Sequence Number=SeqID_103198
ttggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11514 - DNA, 384 bp, Glycine max
  Peptide Sequence Number=SeqID_103199
gtagacagcaccaaagcacgtcttgagcaaatcccacaaatcctgaaacgttttcgtcaggcggtattagctgctgcggtgctcaacgatctaagattccccataccagatattgaagaacaacacgaaatcgtccgccgcgtcgagcaactcttcgcttgcgccgacaccattgaaaaacaggtcaacagcgccctgacccgtgtcaaaagcctcacccagtcaatcctggcaaaagccttccgcggcgagcttaccgcccagtggcgtgcggaaaaccctgatctcatcagcggtgaaaacagcgccgccgcgctactggaaaaaattaaggccgaacgcgccgccagcggtggtaaaaaaacctcacgtaaaaaagcctga

SEQ ID NO: 11515 - DNA, 174 bp, Glycine max
  Peptide Sequence Number=SeqID_103200
atggggatgggatactggcgtattaactttgcgcgagcctggcgtgattttaactttaatgacgacgtctctttccagctggggaatatggcgcaagcctgcgcagaaggccaggtagtgaacagcgaggagagctgggcaaccgatgtgctggtgcaagttatcgcaccttaa

SEQ ID NO: 11516 - DNA, 416 bp, Glycine max
  Peptide Sequence Number=SeqID_103201
ccacactgggactgagacacggcccagactcctacgggaggcagcagtggggaattttccgcaatgggcgaaagcctgacggagcaatgccgcgtgaaggtagaaggcctacggttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgcc

SEQ ID NO: 11517 - DNA, 2715 bp, Glycine max
  Peptide Sequence Number=SeqID_103202
atggcggccttcgaccacttcgggaacatgtacgacgttgctttcaagccccgcttgcttcaaaccctcataagagaccacctccccgatgagaaacgccccttttcgaacccttcagaactctccaaagtcgtgtctttgatcaaaacgcactctctcctctctgagtcttttgcagattccacgcgccccaaactcatcgaagcatcgaaatccgcactcacttcctggctcaaccgcatttactccctcctttccaccaccatgccagataaatgcttggcggggatctctctgttgggggttacttgtgaagagtgcagctctgagcgtttcctagaatcttactctgtgtggttccaaaagttgctgtcttttcttcagtcacctgcagattctcatttagtgagggtagctgcctgtgcttcaatgtctgatttatttgcaagatcacaagtattacagctcttgtgccatattgcatgggttgctgatttgcaggggttgcagtttgcgggtggttatcagagccatgccttgcccgcaagtgatccttgtgcagcttggaggttcaccggaggaacaattggtgtcaatggaggctggttaggtggatatcccaagatcaagaaagattcatcttcctgtgctgtgaaagttgttcagcctactttgaagatgttgaatgatgagaactcagaggcaatatgggttgaatctgctattgctttaaaacttttgtctggaggatgcagtcttgatatgtcaaaggtaatgtgctcatcaaatttcaaaatgcttctctctgggaaactcacacattgcctcgcactgcttccaaaatcaaaaggagatgaagaaagctggtctgtgatgatgcagaaaattttggtgttaataaatgatcaattaaatttagcctttcatggtctagaagaagaaaccctgcgtaatgaggttactaggctgttgcttttgccaggaaaacatcctccaccacgattaggaggctatatattggcagaagaagttcgcaacaaggcatcaaaaacgtctgagcaatcactgatgtctaatgcctctagacttatgtttggctgctgtctgatgcttaaaaattcatatcctgttaaggtaaatgtgcctgttcgcctgttattggcttttgttgagagaattctgatggtaaatggctctttgccacaaatgtcattgccattcatgactgccaagcagcaagagaacatttgttcggaacttccagttttgcacttgagtagcttggaattgcttacggctatcataaaggccatgggcagtcaactattaccacatgctgcctttattgtacgtatcattacaaagtacttcaagacatgtaaactgccagaattaaggattaaggaagtgatcaacaatgcttttgctgatttaagtagtatcgagcataagaatggtggcatattaaatggttcttattcaaatgcctctgctggaacactgctaccgccaagtcatagaaaaaggaagcacagcagtacaactggttctcttcaagagcatggtgaaggtggtttgagtgtggaagttcccaagaatcgtccattgattccaatgtctctgagaattgctgcacttgagacattagagtctcttattactgtggctggtgctttaaaatctgaaccatggagatcaaaagttgatagccttttgatagtcacagcaatggattctttcaaggaaggatcagttggtgaagaaagaagcgtgtttcaacaaaaggaacctgctgcaactaccacagatttgcagcttgctgcattgcgtgctttattggtatcctttctttcatttgctcgggtacgacctccatatttagcccagggtcttgaacttttccgtaaagggaggcaacaaactggaacaaaactagctgagttctgtgcccatgctctgttaaccttggaagtgcttatacatcctagggcacttccaatggtagattatgcctatgcaaataacagttcttttggtgaagctcacagtaatctccaacatgaatattttggctggagcaacagtacgccatatggtttaccacaagatcctcctgactatgatgatgatctgtgtgctagatggcttgaaaatggcaatgaagccgatgaatcattggataaaaatacaaaatacacccaagagccttctgaagcttgcagagctagtgatcctgaagtgctttccatgcatgtatcttctggcaccaatatacaggagaggactgagatggtggtgtctgagactgccacctgtgcaaatgttgaaatgaaaacggttgaggatgaaatcaatttcaagtcggatcaaccaggagaatctgtggtgcaatttcaggaaactgtttcttgcactacaaacatcctggtggctgaaactcgcagtgatgtagctgatgataaagtgtctgagaagattgtttcagacagctctgttactcgtaatgaagccagtcataaggaatcaggacaaggaagctcggctaataaagacttcaaatttgcttctctgagtggtagtttatggcatagaacctcaggctgtaaaaatatttttgaggaatttgcttttcaattggatcatgacaaggcactggcggatgaagatgattttcctgatattgtggatggagacccagattctgattccgaataa

SEQ ID NO: 11518 - DNA, 818 bp, Glycine max
  Peptide Sequence Number=SeqID_103203
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccagtggagattacttcactggcggtatatctgatctcgagtgttggacgaccaggactgtctctttcgtactggacagcagtggccaaacaagtgcgattgctgcagacacaggatggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11519 - DNA, 779 bp, Glycine max
  Peptide Sequence Number=SeqID_103204
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaatgctctcgatctcctgacctcgtgatccgcccacctcggcctcccaaagggctgggattatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11520 - DNA, 746 bp, Glycine max
  Peptide Sequence Number=SeqID_103205
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggctctcctggactcccctgtctgctaggaacgtggccacagccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11521 - DNA, 261 bp, Glycine max
  Peptide Sequence Number=SeqID_103206
gattgtcatcatcaaaaagggggagattgtggaagcaatgacttccaagattattttgatgatgccaaagaatcaagagttaagcaagttccaaagaatcaggcttcaagaatcaagtctcaaagaatcaagattcaagagcaattaagtttcaagattcaagattcaagaacaatcaagatcaagattcaagagaagaaatcgagaagcaacagtcaagacttcacaagggaagtattttttcaaaaaatccaaacatag

SEQ ID NO: 11522 - DNA, 845 bp, Glycine max
  Peptide Sequence Number=SeqID_103207
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatgactcagcgcattgcatatgtgaccggcggcatgggtggcatcggaaccgcgatttgccagcgcctggccaaggacggattcaaggtggtggcgggctgcggcccgaattcgccgcgccgcgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11523 - DNA, 827 bp, Glycine max
  Peptide Sequence Number=SeqID_103208
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatactagtgtcattacactgcaggttctgtggcatgaggaatttgaagaaggctgcaaggctgcctgtaatgggctgagagagaccacccagggaaatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11524 - DNA, 167 bp, Glycine max
  Peptide Sequence Number=SeqID_103209
atggggaaatggctccgaagaaactctccacgaagagatctagaagagacgccacaggagaagggtctagtgccacccccaagtttggtagtcatcgtttccggagtgccgagcaccaacagcgcttcgaggccatcagaggatggtcattccacagggaaaggcat

SEQ ID NO: 11525 - DNA, 474 bp, Glycine max
  Peptide Sequence Number=SeqID_103210
atgaccatgattacgccaagctcgaaattaaccctcactaaagggaacaaaagctgcttacaaggtcacgtatctctcgtggatcaactaagccgaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11526 - DNA, 267 bp, Glycine max
  Peptide Sequence Number=SeqID_103211
atggggtcctatggtggtcacagttcgatcgaaaagggtgctatgccagtttgggtacattcagagcatccctttgtcacctatgaagggtggatgcatttctcggaccacgtaatagctttgggtgacctttgtgtagtgcctgggcaagtatctacggattacatggagtggcttttccagatatctcacccattcatgataccgacccaagcaggtgaccagctcagacatgcacctgctccagaccatgaggactacatgtag

SEQ ID NO: 11527 - DNA, 1173 bp, Glycine max
  Peptide Sequence Number=SeqID_103212
atggtcgaaaccttccaggccggcgtaaaaccgaccttcgttgaaacgctcgacgcggtcgacgtcgccaaaacctccggcatgccgctggcgccggtgatgatttatggcgatgacgtgacccacgtgctgaccgaagagggtatcgcctacctgtaccgcgcggagagccttgaagagcgccgggcgatggtcgccgcggtggccgggatcaccgatattggcctcggggtggacgccaaacgcgtcgccgcgctgcgccagagcggcaaagtggtgtacccggaagatatcggcattcgccgtagtgatgccacccgctcgctactggccgccggcagcgtcaccgagctggtggagtggtccgacggactgtacgacccaccggcaaaattccggagctgcgcgtgtctgattgacgaagcccgcctgagtccgaaaccgggtctggtcgatagtcgcggcaacggcgcgcatcaggatctcaatctggacctgatggaacgctccgcccgcagcctgcagccaacctttcacgcactggcgcagcaaagctggcagcgtccggcggatatcgccctgcgcgaaaccgtcggccgcctcggtcgcgaaggtgaagcgcagatgatgatggcgacaggtggcgttaacacccaccgcggcgccatttgggcgctgggcctgctggtcagcgcggtggcgatgttgggtggagagggtcaatcacaggcgatcgccgggaccgccgccgcccttgcccgcctgcctgacggtttcgcgccgaaaagctttagtaaggggctgcgcgccagccgccgttggcaggtgccgggggcacgcgaggaagcgcagcgcggatttccgcatgttaccgccctggcgctgccgcaactgcaacagagccgggcgcgaggcgccagcgagcagcaggcgcgccttgatgcgctgatggccatcatgacctcgctgagcgatacctgcgtgctgtcgcgcgccggcatgaacggcctgcacgccatgcagcaaggcgcccgcgaggttctggcggcgggtggttgcgccagcgtcgccggtcgcgccgcgctggcgcgcctcgatgcgcagatgctggcgcaaaacgcctcgccgggtggcgcggccgatctccttgccgccaccctgtttctcgaccgg

SEQ ID NO: 11528 - DNA, 267 bp, Glycine max
  Peptide Sequence Number=SeqID_103213
atgaggggtaacgttgaacaattacaaaggtttacccgtgcgtggatccttcgattcataggaggtgtcctctttgttaacaaaagtagtagcagagtttccttaagcacgtatgtgtggggacctgccgtggttgcgtatttatatagagagatgtgcagcgccactgattacaaagttaaatcaatcggaggtggttgcgacgtggaaatcaacatattggtaatgatgatcttagagttttcggtcgcaaattggatccgatga

SEQ ID NO: 11529 - DNA, 1197 bp, Glycine max
  Peptide Sequence Number=SeqID_103214
catgaacaccgtaatttgatctcgactatcgccggactgctgtttctcaaacgctacgatcacgcattggatctgattcagcaacagtcagaaagccaccagaaggtgctcgattttattgcgcgtaatttccaggataatcaccttgccgggttactgatcggtaaatattaccgggccaaagagctcggccttgaactggtgttcgacccatcctgtttcgtcgataaacttcccggcgcgctttcgcacagcgaatggatctcgatcgtggggaatcttctcgacaacgcctacaatgccactttgcgccagccgctgggatcgaaacagatcgaatgtttgattaacagcgatggtcatgaactgattgtcgagatcgccgatcagggttgcggcattgacgaggcgctacgcgatcggatcttcgaacgcggcgtcaccagcagcgccagcggcgatcacggtattgggctctggctgatgaacatcatggatagcattactactcttatcgttgaagacgaacctatgctggcggaaatcctggtggataccatcaaacagttcccccagttcaacgttatcggcattgcggataaactggaaagcgcaaaaaaaatgctgcgtctctaccagccgcagctgatcctgttagataactttctccctgatggcaagggattggatctgattcgccacgccgtcagcaccaactacaaagggcgaatcatttttattaccgctgataatcatatggataccatcagtgaagccctgcgtctgggggtatttgattacctgattaagccggtgcactatcaacgtctacaacacaccctggagcgcttcgcccgctaccgcagttcgctgcgttcaagcgaacaggccagccagactcacgtcgacgccctgtttaatattcaggctcgcgagcaaacagagcccgctgaagcgccgctgcgcgggatcgatgaaagtacctttcatcgtgtgctgcagctgttctctgacccgaaagtagtgcataccgctgactctctggctcgcatcctcggcagcagtaaaaccaccgcccgccgctatctggaacaaggcgttaaaaacgattttctggaagcggaaattagttatggcaaagtcggccgaccggagcgtatttatcgcggcaaacatccctatccggagcatgcctga

SEQ ID NO: 11530 - DNA, 179 bp, Glycine max
  Peptide Sequence Number=SeqID_103215
atgatgcaccgagagatcgaggtctatgtggacgacataattgccaaatctaaatccgaggaggaacacctcgtcaacctacggaagttgtttgaaagtcccgagacgtgtcagaaatcaaaaggaagcaggcttgcgcgatccatgaaattcggtaatgtggcggaaattgaaaagag

SEQ ID NO: 11531 - DNA, 105 bp, Glycine max
  Peptide Sequence Number=SeqID_103216
atggatttttacgagttacgaaggaaacttcgagctcatattggtcatgggttgagaacgggaattgaactctatgagctcgaatttcccgttgttcctcagtag

SEQ ID NO: 11532 - DNA, 309 bp, Glycine max
  Peptide Sequence Number=SeqID_103217
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgcaattttgtgctctaaaagagctctgaaatctgaacggaatgaagaaaggaagagagagaggagacgccacttcaaggagaagatgagtctagaagaagctcaccaccataggaggccatggataagagcttggaggaagaaggagatgaatgaagggtga

SEQ ID NO: 11533 - DNA, 863 bp, Glycine max
  Peptide Sequence Number=SeqID_103218
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatgtcatctacagcgcggggacacagagcgtggtgtgcggtatatatcagaagccatcaaagcggtacctgttgactctgactttgttccagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11534 - DNA, 794 bp, Glycine max
  Peptide Sequence Number=SeqID_103219
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacgacgaggcccagatccgcgcgatcgtgcctactcggcgctggaggctttcgaggcggacaaccagagccacatgttctaccgcatctccacccaggggggtgaagtgatctccgggttcggcgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11535 - DNA, 420 bp, Glycine max
  Peptide Sequence Number=SeqID_103220
gcgaacgatcggttaaagctcgtcaaaaacggaagaaaagaaatcgaaattgaacgaaataaaaatgaaagccaagaaacaagaaatgaattaaaagtctcggatttggaaacttacccattgaagaacgaagaacggatgaagaacgctgaaatacatcaccagggagatccaggacacttagaacaacccccttcagcttatttattggaaaaagggggaggaggttgccgcccagctcgcccaggcgagctgggttgcttcctccagaagcaatccagcttcgaaaatactcaggaaggcccaatttcaaaatttcaaaatttctatttgcatccccagtttttgataagttcaccccccttctttcgtaatttacgaaaaagttacgcaagctttacggaagcctataggacttga

SEQ ID NO: 11536 - DNA, 279 bp, Glycine max
  Peptide Sequence Number=SeqID_103221
atggatgagcgttcacgtggcccaggaatggcgcctactaggcaccctttggacccagagaagtccaacagggccctggggtttccggctctaatcacgggcctctgccagtcctacggagttcctgtcacccccagcaaggcgcagggtgacgcacatcaggatgcaggcgcaccgtcgccacctcggcaggccgatttggttgggccactacgtgtggagcggtatctacagcatttggttcgtcagcaggcggccaaccaccgtggacaagtgtag

SEQ ID NO: 11537 - DNA, 815 bp, Glycine max
  Peptide Sequence Number=SeqID_103222
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacgctggcatggcaatgctagccaggatgcccataatggccaccacgaccatgacttctatcaggctaaatccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11538 - DNA, 860 bp, Glycine max
  Peptide Sequence Number=SeqID_103223
gtgcagtgaaaagtaaagataaggagcttaggagaagtagcaacgggatcactggcggctatcataagtggctgagagtccgaacgcaagagttggattggctcctaaagctaaaagctgcaagagaggaagaggctgaaactccagagaagagtgaggaagtgcaaaccctaaaagcagaacttgaaagagcccaagtagtcaaagagaagttcaagtcaacagccatcaaagtccagaataagtacgatgaactaatggacatcaatatggccatcatcgaccagtacaaggaaaagctaagcctagcagtgactcatgagcaaaggctagaggacgagtatgccaaggtatcagtcctgcaagcgaagagggaagcaagggaaaaggtgattgattcattgcacagagaagcaatgatgtggatggacaggttcgcctttactttgaatgggagtcaagagcttccccgactgctacccaaggccaaggcaatggcggatgtgtacttggcacccgaggagatgaaagccgatatggtggccttaaaagaccaaatggcttccatgatggaagccatcctaagaatgaaaagactaatgaaaagcaatgcggccacggctgccgccgccgaggcagatcctactcttccaaatgcctacccctatggcttaccccccaatttcacaccgcccaccatgcttgagaacgtggatcatgctgttcccataaccttcgaaggtcagcttccccagtctatagggggcaccaacaaagagccttgggagcgtgcctcacttgacgtcgactcgtaccccccattcaccgctgagggaccgacattccatgccatgccttag

SEQ ID NO: 11539 - DNA, 812 bp, Glycine max
  Peptide Sequence Number=SeqID_103224
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccatcaagccagatatgttgatcaagtgcaccgtaaagtcttttgatgacacgtatattaacgtctgcattgccgacaatctcgacggccgaattcaggccaccgagattttatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11540 - DNA, 447 bp, Glycine max
  Peptide Sequence Number=SeqID_103225
atggatgataaatggatgcagttcagtgactacattgcacctgtaggacaaatctgtgtagtgcctagccagtgttcgtcagattacatggattggttctacatgatttcacacccattcatgagtccggcacaaccaagggatcttcctagagttcgactagttcagcaatatgacacatttgttgaaccagatgtccatcagcaaccgatggcggcagtagcacctgatgaggcaggcgctgatgtgcatcatcttggacatgcagtggttgcttttggggaaattattgataagttagagaggctattgaacctaaggatcttgaccgaaggaacaaaagcctatattgttgttgaagaatgtgtgggcattgcaagaagattcattcaccaaccagttgtaggtcacagatccaggcgtaggcggcatatggacgatcattga

SEQ ID NO: 11541 - DNA, 887 bp, Glycine max
  Peptide Sequence Number=SeqID_103226
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgaaggaccagcattccattcgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11542 - DNA, 1053 bp, Glycine max
  Peptide Sequence Number=SeqID_103227
atggacgagttgcgtgaacgagccaaaggctacatccagatggaagaaatgttcagattcagaaatgaagtcagacaagctggacaaaagcatgacaagcaagaaggaagcaccaagaacctactcacacaagttgaacaagaggcacaagttggacaagcgccagcctctcccaaaaaggcccaggtacccattaggctacctccgacaaaacctcctaggccgggagagcaatctagccagtcccacaagcaccacctccatgccatatgggacatcaacatcaactatgtcgataaaccatcgccacgaagtcttcctcctatcactttcacggatagagacttcaaggaagacattccaggacttgaagtttcgcctagctccatccaacctcacaccggtccactcctcggcttttcaagggagaaaacactcaacgagctcggagccattgtctacacatcacttctaaagataaagttccccaccttgacgggagagatcatgattgtcaaggccgatcaaaagcaagcacgacagtgctgcgcagaaagcctgaaggtggcaccttatcctcccactagggagcctgtcaagcctcaccccacaacggatgatactactcaggtcatgagcgtggacaaggtctctagtctgggcattgactgtctaccaagcccaaagcctattgaagagcttgtcaagctacaacttagacccaaacccgagcagtgtacgcagctcaacaaggacctcaccaaccatgaacatagccatctgacatgctcaaaatccaccccagcattatctaccacaagctcgccatctgtccccaagaaaaactggtatcacaaaagaaaaggaagatgggagaagaataacgcaaagctattagagaagaagtggacaaacttctcaatgccaacttcattagagaagttagatattccacctggctcgctaacatcgtcatgcatcggtaggctagctgatggagcatctgagttccaggtgctaagcttcctagacgcttactccaaatacaactag

SEQ ID NO: 11543 - DNA, 252 bp, Glycine max
  Peptide Sequence Number=SeqID_103228
atgttctgcggccagtggcaaccaccaagcttatggattcttcgagttgaccttcaagtggtggttgaaaaacatggtcgtcgcctgaagcatgtcgtcgtcagtgtcgttcccatgaaaaggagttcctcatcgtacacctcagagcccggaagtcgcatgatgtgtttgtgtaacgtagaggttccactagtgacatcgtggactgaggataatccagggaggcatttttatggttgtggtctatacaag

SEQ ID NO: 11544 - DNA, 249 bp, Glycine max
  Peptide Sequence Number=SeqID_103229
atggcaggagctggtgacaatggtggtgtatatcatcaactgaacggatttcagcgcttattactggacgcgatgactacacaaatgcaacgtttgttgaaccgtaacaatgaagagctgtacagggttaatgatggatcgaaccgaatagaggagcaagacagaattgagggagtaaaactcaatgcatcctcttttaaaggcaggagtgacccagacgcctaccttgactgggagatgaagatttag

SEQ ID NO: 11545 - DNA, 642 bp, Glycine max
  Peptide Sequence Number=SeqID_103230
atgagatcctgggtaaggggtcagtggatcccgtttgatgccgacgctatcggccagctcctgggatatcagttggtgttggaagagggccaggaatgtgagtatggccagaggaggaaccggtctgatgggttcgatgaggaggccatcgcccagctgctatgtataccggggcaggattttgcccggactgctgcagggaggcgagtgcgaatcatgcgcaccaacatgaccgccctgacccagatatggatgacgttgctcctcagcaacatcctgcccagcgatcataattccgacctccccctgccgaagtgtatggcgcctactaggcatcctttggatccagataagtccaacagggccctgggatttccctcgctgatcacaggactctgccagtcattcggagtccccgttgaacctaccaagatgagcctcagcatgcagagccagggcttcgcttctttttcatgccctactccagaccagttcagggcagaggtcgcatggcctggagattggccagaggcccaagcaggaggggcacccccagaagctcccgacggtggagaagaggcccacgaggacgaggagatggccgatttgcttgacttcttgggagggagtggagatacgtga

SEQ ID NO: 11546 - DNA, 219 bp, Glycine max
  Peptide Sequence Number=SeqID_103231
gtggcctggccaggagtccagccatctcctttgggagggggtgaggcctctgcagcccaagagcctcagcaggaggacattccagaggccgcagagcctacacctcctgagccattcactttagagtctgatccaattattgtacaggttcaggaggatgttataacatcagagccctctctaacagaggcctctccattagagccctttattttttag

SEQ ID NO: 11547 - DNA, 507 bp, Glycine max
  Peptide Sequence Number=SeqID_103232
atggtgaaagttggaacctcttacgtgccgatcaacgtctcatttcgccaaaagttggcccagggcttgcccggtatcaacagggacaccaggattattgatttgcgaacgactgcacacataccttgtcacagcttatcgcaataccgtcgcctcgggcggtcactagctgcgcgtaactccacagcggttaatgcgccgctacagggcgcgctttccattcgccatgtcaggctgcgcaactgtatgatcggcaacgcgcgggcgatcggtgcgggcctttcgctattcccagctggcgctaaagggcggatgtgctcatacggcgattactatgttgggtacactgatgccagggttccgcttcctcgctcactgactcgctaccgctcggtcgtagcggcgagcggaagcttagaacgtgggcggagatttcccccggagactgcaggaatcgatcttaacagggaagtgagagggaccgcggcaaagccgtttttaccatag

SEQ ID NO: 11548 - DNA, 788 bp, Glycine max
  Peptide Sequence Number=SeqID_103233
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcagcctcccaagatggtctcgatctcctgacctcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11549 - DNA, 471 bp, Glycine max
  Peptide Sequence Number=SeqID_103234
atggccccgaggaagcttgcctcaaagaggtccaggaaggataaggcggccgaaggaactagttccgctcctgagtatgacagtcaccgctttaggagcgctatacaccagcagcgcttcaaggccatcaaaggatggtcgtttctccgggagcgacgcgtccagctcagggacgacgagtatacggatttccaggaggagataggtcgccggcggtgggcatcactagttacccccatggccaagttcgatccagaaatagtcctcgaattttatgccaatgcttggccaacagaggagggcgtgcgtgacatgaggtcctggagggccaggagtgcgagtatggctagaggaggaaccggtctgatgggttcgatgaggaggccatcgcccagttgctatgtatatcggggcaagattttgcccggactgctgccggaagacgggtgcggatcatgcgcaccaacatga

SEQ ID NO: 11550 - DNA, 726 bp, Glycine max
  Peptide Sequence Number=SeqID_103235
atggcgaatactgattctactctgccgcacgccgcgcgtgccgcagcagggaaaacccacaccggccgtcttgctgcggccagctccatcggcaccgcgctggagtggtacgactttaccgtttacaacatcatggcggcgctggtgtttaaccatgtgtttttccccagcttcgacccgctggtcgggaccattctggcgttttcaacttacgcggtcggttatgtatcacgtccggtgggtggttttatctttggccatctcggggatgtcgccggacgcaaggcggtcttgatcaccacgctggtgatcatgggcgtgaccacggcgctgatgggcatgctgcccggttatgcgctatggggcatctggagcccgattctgctggtggcgctgcgctttgtgcagggcatcgcgctgggcggcgaatgggccggcgcggtgttgctctccatggagcacggcgaagccagtaagcgcgggcgtaacgcctcgttcgcccaggtcgggccttcctgcggtacgctgattggcaccggctttatcactttagtgacgttgtcactcagcggcgaacagtttcaggagtggggctggcgcatcccgttcctgctcagtctgctgctggtgatgtttggcctgtggctgcggcgtggcgtggaagaaaccccgactttcgtggcgatgcagcaggcggagaaaaccagccacaccccgctgaaagag

SEQ ID NO: 11551 - DNA, 453 bp, Glycine max
  Peptide Sequence Number=SeqID_103236
atgaccatgattacgccaagctcgaaattaaccctcactaaagggaacaaaagctgtcgtgcgttactgatacacagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11552 - DNA, 558 bp, Glycine max
  Peptide Sequence Number=SeqID_103237
atgatcggagacaggaaccggtcatgtatgaataccttgaagaggaaagagtctctgatcttgagaggaactcaatttcaaaggaaccagtcttctgtaggctatcaatgggagtcatgttggcaaccagattatgatgataaagtagaaggagttattaatctggatgacctgctaatgcaatttaaagatacaatagagtcaatgcaacaggcttttagaataactgcaactcagattagtaagttggtggatgacatggctaacactggggccagacaagaggaaaagtgtgtagagattgaaacatatcaagaaagcatttttcaagttacctccatccatcatcagatgaccactgaagaggaagcgtttgaagtctccagtactccagaatactcctgctcgaccgctgctggctatgttagaggaacagagaaaggcagattggaactcactgtagaggatcaaaaagtctcttttgacatctttgaggccatgaaacattcagatatgggagatgcttgttctaaggaggaagaggtggcacaagaacta

SEQ ID NO: 11553 - DNA, 354 bp, Glycine max
  Peptide Sequence Number=SeqID_103238
atggtgaaagttggaacctcttacgtgccgatcaacgtctcattcttcgccaaaagcttcccaggggcttcccggagcgagtcaactggcgttctgtttctatcagctgttccctcctgttcagctactgacggggtggtgcgtaacggcacaaagcaccgccggacatcagcgctggcaagtgtagcgggcgcgtgcccattcgccattcaggctgcgcaactgttgggaagggcgatcggtgcgggcctcttcgctattaatgaatcgccagctggcgaaagggggagtgctgcaaggcgattaagggacgctagcggagtgttcatactggcttactatgttggcaactga

SEQ ID NO: 11554 - DNA, 555 bp, Glycine max
  Peptide Sequence Number=SeqID_103239
atggccccgagaaagcttacctcaaagaggtccatgaaggataaggcggccgaagggactagttccgcccctgagtatgacagtcaccgctttaggagcactgtacaccagcagcgcttcgaggccatcaagggatggtcgtttctccgggagcgacgtgtccagctcagggacgatgagtatactgatttccaggaggagatagggcaccggcggtggacatcactggttacccccatggccaagttcgatccagaaatagtccttgagttttatgccaatgcttggccaacagaggagggcatgcgtgacatgaggtcctgggagtgcgagtatggccagaggaggaaccggtctgatgggttcgatgaggaggctatcgcccagacactatgtataccggggcaggattttgcccggactgctgcagggaggcgagtgcgaatcatgcgcaccaacatgaccaccctgacccagatatggatgacgttgctcctcagcaacatcctacccagcgatcataattccgacctccctctgccgaagtgtcagctg

SEQ ID NO: 11555 - DNA, 633 bp, Glycine max
  Peptide Sequence Number=SeqID_103240
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagcacaacaagaccgtgcagataatgtgatacttagagctgagaatgagtctcttaagagtgagaattatcggttacaagctgcactgcgtaacgtaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11556 - DNA, 355 bp, Glycine max
  Peptide Sequence Number=SeqID_103241
gtttctatcagctgtcccctcctgttcagctactgacggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggatggcatctaagaagaggaaagctccttctacccccacccaggccacatttgatagattcaggttcacatcccaagaggcttgggagagataa

SEQ ID NO: 11557 - DNA, 703 bp, Glycine max
  Peptide Sequence Number=SeqID_103242
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaaggatctcataattttctggaggcaaatgtgaagtccaaatcaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11558 - DNA, 277 bp, Glycine max
  Peptide Sequence Number=SeqID_103243
ggtggacccttgcgtacacgccctcgccttcaaaggactgcatgtcctcaccttcagagggttgcacgccctgaccttcaaagggcaacacatcctcaacttcagagggctgcacgccctcgcccttagaggactatacgtcctcactttcattcccgggccaccccctgatattggaaggcgaccaactatgcgagcacaaccagagagggaggctatcacacagctattatgcataccggggcaagatttcacccgtgccgctgcaaagagatga

SEQ ID NO: 11559 - DNA, 288 bp, Glycine max
  Peptide Sequence Number=SeqID_103244
atgtggtttcctggcagttttcccttcaccagttatcccaaattcgtgaacattaatcagtgcacgcttcgtgttcgattaattgcctctgagcctaacttgcgttcatgcttaatggacgaagggctaactggtggttggattaagtggttgactgttagggacgaattctccataacccaggatgcatcgagaaatcgaggtctatgtggaccaagtctaagaccgaggaggaacaccttgtcaacttgtggaagttgttcgaaaggcttaggaaatatcaattga

SEQ ID NO: 11560 - DNA, 255 bp, Glycine max
  Peptide Sequence Number=SeqID_103245
gaaaaggaaggagaagcttgccacccagctcgcccaggcgagctaggttgcttcctccagaaggcaccgccttctggagaacttcctggaaggcccaagtgggcttggaacttcacggattgtgctacaatgttttcttttgacttctggcatgtctcgaaacttcccgaattgtctaacgatgggtgccaagtacctcgaagtggtcaaacgagggtcgcatcccaacaatggatggtccccagacgaaattag

SEQ ID NO: 11561 - DNA, 177 bp, Glycine max
  Peptide Sequence Number=SeqID_103246
ggatgagttgtccttgtgtggtttagactttgtaaaggattttacaaagatagtggaaatctcaagtgggttgcttgagtactggacgaatacgcgcggagtcgccaccaacgtttatttgaggaaaacgtcggaaaaaaccggaaaagacgcgatctacgaactttttggtgaaag

SEQ ID NO: 11562 - DNA, 207 bp, Glycine max
  Peptide Sequence Number=SeqID_103247
atgtcacgaaactttacggattacgcaaccatccccacgtcgacttctggaatgttacagaactttacggattgcgcaataatatttcctttcgactcccgacatgtcgcgaaacttcacggattgcttaacgatgggtgtcaagttcctcaaagcggtcaagcaaaggttgcatgccatcaaacaatggtctccggacgaaattag

SEQ ID NO: 11563 - DNA, 743 bp, Glycine max
  Peptide Sequence Number=SeqID_103248
gattaagtccattgatcgagtgttcagttgtaaccggcgatcctggacttatatccatatttgtggagaggtggcacagggagaccaacaccttccaccttccagtaggagagttgacaatcacactagatgatgtgtcatcactcctccatctccctatcagtggcgccttccacagcttcccggctctttccgtggacgaggtagtatttttgttgatggagttgctcgaggtgtccagtaaggaggctagagccgagacagcacaagtgcgcggggcatatgtacgcctctcatgggttcgggatatgtatgagatgagatgccaggcacgacgatggattgtagcaactcgtgcttatctcctgcacctgtgcaacaaatgttcatgtggtgcatctagaggcttttcgcgacctgggttagagtgggggctatgcctggggagctacggccctggttcatattgttggatctatgagcattttccgagtgagcatcagtgtgtcaccgatgatgcgtatgaggagacgtccccttgtgcctcccggtggctgacgacgaaggctcatatgaagagaattacaggagcgccgtaccaggcacgttgggatgctttgacgatcacagacgtgtgctggttgccttacattgagatggggtcctacggtggttacagttcgaccggagagggtgctatgccggttttggtacattcagagcattcctccgccgtttgttag

SEQ ID NO: 11564 - DNA, 297 bp, Glycine max
  Peptide Sequence Number=SeqID_103249
ggagaagggagacacaaaagaattcaggcggttagtccttcgttcttttggaaaagggagaagagagacacaaaaagaattcaggcgactcttcaagttgtgaatgtatgtatacatgattttgatgatgccaaagaagaatcaaacaaagttgcttcaaaggataagcatggcttcaagattaatacaagattgcttcaacaaataaagccttgcttcaagattaactcaaaatcaagccttgtcttaaaacaaagtgttttcaagacattcaaggctctggtaattgattactag

SEQ ID NO: 11565 - DNA, 228 bp, Glycine max
  Peptide Sequence Number=SeqID_103250
atgggtattatttggcaccaaatcccaaaaataggagatatgatgaatgtgttgggtgctccatgtggaacttgtaggccttggatcttcttcatcaatggattcctttgcttcttgaagatgaatgacaacaaagtggagaaggaagatgattggagacaccacttcaaggagaagatgagtcaagaagaagctcaccaccataggaagtcatggataagagcttga

SEQ ID NO: 11566 - DNA, 174 bp, Glycine max
  Peptide Sequence Number=SeqID_103251
atggcgggtgtcagtgaagtgcttcgtgcaggaaaaaaactgcaccggtgcgtcagcagaatatgtgatacaggaccactatattccgcttcctcgctcactgactcctaccgctggtcgttcgactgcggcagcgctgaaagtggtaccccaacgggctgcggatctttttag

SEQ ID NO: 11567 - DNA, 399 bp, Glycine max
  Peptide Sequence Number=SeqID_103252
atggaagcatgtttagcagtaggagacctgttacaacaaatgatggaccaaggccagctagaagtcggcgatgaggggggacgcagctccccaaacgacccaacacccctcgccaccgacatcagctctctatcggccaaggtaaccaatatcacggggctgagcggcatgaaccgcagcggtcgcgtattcgcaccctctgacctcccaacacagcccgcaaacgctaaagggaaggcaaaaatgacggaaggacaaaatgtcaaagtgatccccgctccggatggggatattccgatgaaaggtctttccgagggaagagatggctgtgacaagaaagaggtatcgcttgaggaagccggcgagttcttccgcattattcaacaaggcgagttcaag

SEQ ID NO: 11568 - DNA, 831 bp, Glycine max
  Peptide Sequence Number=SeqID_103253
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattacctacactggcagccaccgcagccacagccgcaagccgaactacacgagtagcacggctaacaatactcaccatcgcgtctactccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 11569 - DNA, 435 bp, Glycine max
  Peptide Sequence Number=SeqID_103254
atgaccatgattacgccaagctcgaaattaaccctcactaaagggaacaaaagctggagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11570 - DNA, 498 bp, Glycine max
  Peptide Sequence Number=SeqID_103255
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcgggctatggctggccgaataccgctgaacaggacctgctggccgcctacgaggctgacaaagctagttacgaaatcgtctatgaaacccttaaccgaccgacatgggtagacattccactgtcggctattcgagcaatggggcaggattga

SEQ ID NO: 11571 - DNA, 273 bp, Glycine max
  Peptide Sequence Number=SeqID_103256
atgacaccggtaaaccgaaaggcaggaacaggagagcgcacgagggagccgccagggggaaacgcctggggggcggagcctatggaaaaacggctttgccgcggccctctcacttccctgttaagtatcttccttaggggaaatgtcttccatagtgcagatcgaattccgccccgtggggataaccactttctagagcgctcgccgcatgcgaccgcggtggagctcagcgagaattcgccctatatgatctgtattcacatattctgctga

SEQ ID NO: 11572 - DNA, 393 bp, Glycine max
  Peptide Sequence Number=SeqID_103257
atggcaaaaggctcctttctctttctctctcactcactttctttctctgtacaacttggaagctttctctctctcaaagcagcaaggtcctccaccaccaccacctccaatctccgtctttcacccagagagagatactgtttgaataagttttgggcttttggtggtaatgtggtggctatggataaggactcgtgtggagtggggttcatggcggaactgtctggcatggagcaagaagagactaaaaaagctttctttattttgactgtagagaagagaaacaagatgcaggatatcatgcgcatggatgctgccctggacgcaatgcgtccacttggatttaggacacaactgattctacgaacggtgtatggtggaaatcaaggatga

SEQ ID NO: 11573 - DNA, 477 bp, Glycine max
  Peptide Sequence Number=SeqID_103258
atggacaagaaacaaaaacaaacacaaaccacccaggctgacccaaacttcaggaacaacctaccttttgcttcatccaaagaaagtgaagctgtacaaattgtcagaactgaaccagtgtccataattgctacagaagtctcactgaaagacaaggagcccaaggttcacattgaacacttcttagacatcaattcgctagagaatgttggctacattatcaaagcacatctcatgtgcggcatccaccacttctcgaggacccaaaggttaaatgaggctaaatctcgaagtgctaaaagtggtagttgcgctcagctcaccatttgggctcaacgcacatccatcgctacgcgcaacttcagtgcacttagagcaatagaagaatctggcagagcatcaatatcaaggtcacgcgctaagcacaagatcagtgtgctaagcgcagcggttatcttcaaccaggctcagtcttaa

SEQ ID NO: 11574 - DNA, 879 bp, Glycine max
  Peptide Sequence Number=SeqID_103259
atgaagatgaatatgaatgtggggtacctcatctcccaccagatatttattactgcacaacacgattcctccagatttggattcccagccttgatcacaactctatgcaaggctagaggagtccaatcagattctagatccctggagagcctgagccctgccattaacttggcatacattaagaagaactgttggaatctagatgatccaacagtaacattcaaagggctaaggaaggccaagggtaggagatcagaggcccctactacttcagcaacactagagacaactgcaccttcttcatccacaactccaacacctccctattcgactccagcacagactccagctattcctgctccatttctatttcagcttctagctctttcattatctggaccattagagtttttatttacaatagagatgctccattctatgctccagagcttacacagggggcagaccattatcatgcagagccttcagagcttgggcctgccatccatcatgagcatggatgagtttggcacacagatggcctggccaagagcccacccttctccttctggagggggtggggcctccgcagcccaggagcttgagccaaaggagcccgtagcagcagctgaggagccagtggagggggaggatgaactcactcctcctgagcccttttattatgatacaaatgtacacatcgctcaggaggaggaaagttctacttatcaaatgccagagccatcccctgcaccagctcatgaggagaccttgccatcagtaccagttttggagcctgagcccaccattcaggattcatcagcagctccagtactggatctgaatgaagatcagccacaggaggatcaggacatttaa

SEQ ID NO: 11575 - DNA, 521 bp, Glycine max
  Peptide Sequence Number=SeqID_103260
atggtgaagtatccggcgaaccaggggcgccagatgacaattccgctcgccagcagcaagactaagctgatgatagcagcccagaacacacacttctgcccgaagttgtatttcccgcgtaagaacatgataataaaggctgcaaacatcaccacgccaacgaacgggtgtaggatacgcgccagctgtggcgtgccgagcaccgcaccagacgatcgcgctttttcatcattcgcgctcctctttttcatgcaggttttcgtcgtcgtcctcttccacccggttcggaccgacaccaacgtagtggaacaccgcggcggcgaaggtggcggcaaagccgatagcagccagcggtttccagacgcctttccagaaggtgaccgccgggctgatgctcgggttggccggcaggccgtgatacagctgcggtttgtcggcgtggtgcagcacgtacatgacgtgcgtgccgccgacgccagccggatcgtacagcccggcgttagcatagccgcgcgtattca

SEQ ID NO: 11576 - DNA, 767 bp, Glycine max
  Peptide Sequence Number=SeqID_103261
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggagcttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11577 - DNA, 264 bp, Glycine max
  Peptide Sequence Number=SeqID_103262
tgcattgccaaaagtggcccaggttcccgagtatcaacagggacaccaggatttatttattcgagtgactccgtcacctcgaggtattttcgggcaaaggcgtcgggtgatgctgccaagcttatgttccctttagtgtatgatggtgtttttgaggtgctccagtggcttctgtttctatcagctgtccctcctgttcagctactgacggggtggtgcgtaacggcaaaagcaccagccggacatcagcgctggcaagtgtag

SEQ ID NO: 11578 - DNA, 704 bp, Glycine max
  Peptide Sequence Number=SeqID_103263
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11579 - DNA, 195 bp, Glycine max
  Peptide Sequence Number=SeqID_103264
atgtggttgcaatcacagaagtgcaggccagtttgcgacaaaggcgaacttagggcagaaggagaaagaagaagaacgatagggttcgagcacgcggcactagatgattctgttacacctgagtacccaacagatccaaattgtgaacatattgttgatgaaaggcctttcattcgtgcatataaaggagagtaa

SEQ ID NO: 11580 - DNA, 741 bp, Glycine max
  Peptide Sequence Number=SeqID_103265
gttgatcaggaacacccagtgccacgaggcgatctcgaccagccagccacccagcgtgggaccgatcaacgggccgaccagcgcggggatggcgatgaagctcatcgcgcgcaggaaatcctcgcgcggcaccgaacgcatcaccgccaggcgaccgaccggcagcagcatcgcaccgccgatgccctgcagcacgcgcgcaccgaccagctggtgcaggtgctgggccagcgcgcaggccagcgagccgagggtgaacaggatgatcgccaccaggaaggtgcggcgggtgccgtagcggtcagcgatccaaccggaggcgggaatgaaggtagccaccgccagcgcatagctgaacaccaccgactgcatctgcagcgggctttcgcccaggctggcggccatcgccggcaacgccgtgttgacgatggtcgagtccagcatctgcatgaagatcgccaacgaaaccaaccacagcagggggcgctggcggttgtaggtcgatggcgatgtggacatggggcgcggccggtgcagcgttggggagaccatgatcgcgcactgcgggtcacggcgcgatcaacatcgcgccgcaaccgcatgcgcaaggttcagcgctggctgtgcgcgtgcaccgcgtcgaccagcacctgcacgtgcgccgggtccatgtccggcgacatgccatggccaagattgaacacatggccctcgcgcgaaccaccgttgcccgcggcatag

SEQ ID NO: 11581 - DNA, 339 bp, Glycine max
  Peptide Sequence Number=SeqID_103266
atggaaaaacggctttgccgcggccctctcacttccctgttaagtatttcctggcatcttgccagtcgaacgaccgagcgtagcgagtccagttctgagcggccgcaacgcggaatggagctcattcgccctagccgccgatcgccctcgcgcaacagttggccgattcaccttgaatgcagcgaatggcacgacagcgttcccgactggaaagcggcgcagtgtaagcgcaacgcaagggtgaatggtgagttagctcactcattaggcaccccaggctttacacttgccagcgctatgcttccggctcgtatgttgtgtggaattgtgagcggataa

SEQ ID NO: 11582 - DNA, 264 bp, Glycine max
  Peptide Sequence Number=SeqID_103267
atgtcctcgcctttagaggaatacacgtcctcgcctttagaggactacatgtcctcatctttagagggctacacgtcttcactttctgagggctctacatctccgccttcagagaactcaagggatcgcgctcgcaagacacccagtggacccgaagaagtccaacagggccctgaggctctaggtctgattacgggcctctgtcggttctacggagtgaccaccactccgatctgttggatcaagtggcctcggaataattaa

SEQ ID NO: 11583 - DNA, 806 bp, Glycine max
  Peptide Sequence Number=SeqID_103268
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgataatagcttaaaaagccactgggatgtggcgcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggaaaaaaaaggctgcaccggtgcgtcaacagaatatgtgatacaggatatattccgcttcctcgctcactgactcgctacgctcggtcgttcaactgcggcgagaggaaatggcttacgaacggggcggagatttcctggaagatgccaggaagatacttaacagggaa

SEQ ID NO: 11584 - DNA, 261 bp, Glycine max
  Peptide Sequence Number=SeqID_103269
atgtgtcatccagagcaaaggtgtccacagtggtggcttcagccacatgtatacaatcatcaaattcctatacatcaggtctacccatacaaaaacaaaaaagtaaacctaacagtcagtcctagatacacccaccctcaaaaagccaccgatgatcgccatctcccccgggccactatcctccgtagaatctgcctcaaatgccgacatgacttccttgagagaatccacctcaggaagtgggtcctcatcgccctctag

SEQ ID NO: 11585 - DNA, 728 bp, Glycine max
  Peptide Sequence Number=SeqID_103270
atggtgaaagttggaacatcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggagtcctggattagggggtatccggactgccggattgtgtgcaacgtccgaactattgaagcatgaagatacaagactcaagacttcggcccgtgtccggatgggactctcctttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 11586 - DNA, 177 bp, Glycine max
  Peptide Sequence Number=SeqID_103271
atggtaagagctggtgacattggtggtgtatatcatcaactggatggatctcagcgcttatttctagacgcgatgactacacaaatgcaacgtttattgaaccgtaacaaagaagagctctacagacgaatagccaaatcttccttatttactcttaaacctctatcccctaaagaa

SEQ ID NO: 11587 - DNA, 243 bp, Glycine max
  Peptide Sequence Number=SeqID_103272
atgccaagtagtctcttgtataagccaacaaacattggccatggtgagcaagcaatttcaaacttcttaaggcactcatcaaacttgatgcaagctccattggagcttgtaggcctaggatcttcttcatcaatggattcctttgcttcttggaagataaatggcagcggaatggagaaggaagagagagaggagacgccacttcaaggagaagataagtctagaagaagctcaccaccatag

SEQ ID NO: 11588 - DNA, 161 bp, Glycine max
  Peptide Sequence Number=SeqID_103273
tgagaacctgtgatgtacctaagcaggcgagctcctggcagtcaacagataaaaggaaaacaagaccacaaagcaaggaggcttgtggtggctggccagctgaggctaagatggtctctggtaatcgattaccaaggggtgtaatcgattaccaggcttga

SEQ ID NO: 11589 - DNA, 270 bp, Glycine max
  Peptide Sequence Number=SeqID_103274
atgatgagaaaagaaaagtacaagatgaatatcgcaaccaacccttcggcgggagggcgagcaagactcgaggatgcgtcttccaacaaagaaaaatgcgcgggagtcgccaccaacgtttattcaaggaaaacattagaaaagccaaaagggggtctacgaattttaagaataaaaggttcgggagttgtttacgtgcagggaagagcatggcccttgctcctacgtatcccaagtgtgatgaggaactcagacctacgtagttcttaa

SEQ ID NO: 11590 - DNA, 324 bp, Glycine max
  Peptide Sequence Number=SeqID_103275
atggtgggttacacaccttcaagctttgcggatttggacttcgccagcggaaggatcaaagcgggtctgaaaagaggcaaatttaatcatcccacttggacgaatgagaaaactggggcaaatggagagggtgagaataagggagaagcccatgttatgactgccattcctgtacggccaagtttcccatcaacccaacaatgtcattactcaaccaataacaaaccttctccttacctactgccattttatccacaaaggccatccctaaaatcaaccacaaagcctacctaccgcacttccaatgacaaacaccacctttag

SEQ ID NO: 11591 - DNA, 833 bp, Glycine max
  Peptide Sequence Number=SeqID_103276
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgtctcccaaggtatttccaaatccagtggctatggcattcaaaaaccttggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11592 - DNA, 101 bp, Glycine max
  Peptide Sequence Number=SeqID_103277
gtacataggaacggatgcaagtggggatggggtcatgaccgaccaatcgttgccctttcccggcgttaaacgagcagagaacgtcgctgcaaggcagccca

SEQ ID NO: 11593 - DNA, 382 bp, Glycine max
  Peptide Sequence Number=SeqID_103278
atgactagaggcaatccatctgacttgcaaccctttgatcctgagatagataggacatttcacagattagttaggcatcattttataccttttgatcattctgagcattccattactggtgaatctgtgcattttgttattggtgattttgaacatcttgatcttgagcattataattttgagcattttgattatgagcattctgattttgcacattctaagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 11594 - DNA, 246 bp, Glycine max
  Peptide Sequence Number=SeqID_103279
atgaacaatttggtgaaccccgacaaaattgtcatgtctggaagtgtgggatacaccttcaatttatcaagagggatttccgggattgatgatgttgcttggtggtttgattcggtgagcaacaagccatgtcggtgcaaagatcgtcgtatggttcaagagaatttagaccaatcgatgaggttctattgtgaagatgggcaagcaactaagaccactaggattaggtttcgtgtgacattctga

SEQ ID NO: 11595 - DNA, 654 bp, Glycine max
  Peptide Sequence Number=SeqID_103280
atggagctttatgccatgcctgccgccacccagggcctgctggacgacgcggcggtcgatatcgaggcgtggatcgcatccgaggtggacatcgcattcgccgaacaggaggcggcggctttcgttggcggcgacggcatcaacaagcccagggggttcctcgcctatacgaccgttgccaataacgactggagctggggcaatatcggttatgtcgcgaccggcgtatcggcgggcttttcctccgccggtcccatggacgtgctgctcgatgccatctatgcgttgaaggccggccatcgccagaacggcaccttcctgatgaaccgcaagacgcagggtgcgcttcgacgcttcaaggacacgaccggcgcctatctttggcatccgccggctgccgtcggtcagccggcctcgctgatgggctttccggtgacggaagccgaggacatgcccaatgtggcggccaacagcttcgccatcgccttcggggatttccgcgccggttacctcgttgttgatcgaaccggcgtccgcatcctgcgcgatccctattcggccaaaccctatgtgcttttctacaccaccaaacgcgtgggcggcggcgtgcagaatttcgaggcgatcaagctggtgaagttcggggtgaattga

SEQ ID NO: 11596 - DNA, 153 bp, Glycine max
  Peptide Sequence Number=SeqID_103281
atggttaaggaggagtgtaaagaggtaagtgtctcctccaagaggttagctaagaaggaaaagcttaaatccttgtgcattgttggtgcccaaaataggtattatgagacaccaaatccctatgataggtggtatgatgaatgtgttgagtga

SEQ ID NO: 11597 - DNA, 269 bp, Glycine max
  Peptide Sequence Number=SeqID_103282
cgctgttcatgtgtcctccattttcgagtctggagctgtgttccatgattgcctaagagaggaccctcaaggcaatcctccagctcatcctgttccggagccacatgaatcttctggtgactgggaagcacgttgttctgttgttttccagatcggttccttcgccaaaagaaaaaagaaggagtggagacgagagtcatcatcacagaaagggcaggacggacgaaatcagtgtcctatctttgctttcctcttatctctgatgagac

SEQ ID NO: 11598 - DNA, 357 bp, Glycine max
  Peptide Sequence Number=SeqID_103283
atgggggatttcatcagcagactctccttccccgcatgcttgcattttagtggagaaaacaccgagactttttcaagtctcacaagttatccagaactacgtaggtctgagttcctcattggaggatacgtaggagcaagagcctcgcttttgtcgaccgcaccgctttttgttaccatgatccaagagctggtagcccgcggagataccttacagttatccgcacctcgtcattcagtgaccccaagtgtgattgatgagcagaggccaatgtggtcatctgcgccctttccggagatgtcagcatcttccagtggagactttctcaagtctcacaagttatttagaactacgtag

SEQ ID NO: 11599 - DNA, 785 bp, Glycine max
  Peptide Sequence Number=SeqID_103284
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgctggagtgcagtggcgcaatcttggctcactgaaacctctgcctcccgggttcaagtgatctcctgcctcagcctcctaggtagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11600 - DNA, 492 bp, Glycine max
  Peptide Sequence Number=SeqID_103285
atgaagcacttcactgacaccctcatcagtgccaacatagaggctgaggcaggagatcacttgaacccgggaggcagaggtttcagtgagccaagattgcgccactgcactccagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11601 - DNA, 258 bp, Glycine max
  Peptide Sequence Number=SeqID_103286
atggagggttgttgtcctttgagacaaacgtgcgaggtgctaataccttcctcaaacgtaaatacaactcccgaacgtagaattttcattttgactggtttccttcggtttttccgacgttttccacaaataaatgttggtggagactccgcgcatctttcctcctttggaaagcgcacccgtgagcttcgcctcgctcgcccgcaaaagggcatgttgcgacaagactacattttgggttgggcattaacaacttga

SEQ ID NO: 11602 - DNA, 306 bp, Glycine max
  Peptide Sequence Number=SeqID_103287
atggctccaaagaagcttcttactaaaagggctaggaaggacaccgcaagggagggatccagtgtatccccacaagtggagattgatgatcaagggatggtctttcctcaaagaaagacgggtccaactaggagaaagggaatacacagaattccaacgaagatttccaggaggcagtggacccaactgatagatcccatggctaagtatgaccttgagatagtcatggagttctatgcaaatgcctggcccactaaggaaggattcatggagttttatgcaaatgtctggcgcactaaggaatga

SEQ ID NO: 11603 - DNA, 1125 bp, Glycine max
  Peptide Sequence Number=SeqID_103288
atggcttctccacctgcctcccctccttctcctcctcctgctccttccgacgcatcggctttgccgtctgccgtgaagcgaacacgcaaagcctcacgcctacaatcgttgtctactagaccacctggtactaagagaccagtggtgcatgttgatcatactaccggcaaggccgacggtccccacaagaagaaattaagaacatatttggggattgtggtgcgtgataaggtggacgtcacctatgatcactggaaagaggtccctactgctcagaaggacttgatttgggaggatattcaagcggaatttgaaatcctagagacttctgacagtaggacgaaaaggaagttacttcataccgacggtgtggaggacactgactgtgagaaatacgacatcagtaaggaaaatgggcctagttttgccagactcgcagagacccttcttgggaggatgtgcgcaagaaggcacaggccatctagaagcagaacactgcccctcacgttttgtatcgtggggacgccacatgaagtggaagatggccccacgaagaaaacaggggagatgacgactgaggccataaaggaaatcgctgagaagatcgattcctttgaggagcaggcaacacagggatccttcgtcccccatggacgtcaggatgttctcaccgctactattgaacgtctagagcaccctggacgtgtccgtgctgctggagccggtgtcaccatcaagcaatactttggatcggctccacggacaaaaagtgacgcggcagttcatggcatccttcagccagatgcagtcccatatgcaatctcagggacttgcactgcctcccgagcctctggaaacgatcctgagacgggtgactcagataggtgcggcttgtacatcgaagcagatcctgcctacctggttgccctggggagagtttatgagggatccactattgttcataacactcctttgttgcctggccaagtaaaggtgggtgtggaagaggttacagatgcagatgctccagttcctgtacccactgatgaggtttcctttgtggggcaggcacttcacaccttccttgcttggccaacacatctggtcaagtctttatcacagcag

SEQ ID NO: 11604 - DNA, 444 bp, Glycine max
  Peptide Sequence Number=SeqID_103289
atggtcattatgcaccttttgtcatccagaggcggtgttcccgatgacatgcggagacaaattatggtcattgcgcacaccttttcgccattcggagacaatcgtatccaatggcacacagagacaaattatggtcattctgcgcccttttgtcatccagaggcggcgagcccgatgacatgcggagacaaattatggtcattccgcacaccttttcgccattcggagacaatcgtgtccaatggcatgcagagacaaattatggtcattctgcccttttgtcattcagaggcagcgagcccgatgacatgcggagtcaaattatggtcattccgcacgccttttcgccattcgggggcaatcatgtccgatggcacgcagagacaaattatggtcattctacgccttttgtcatcccgaggcggcgagcccgaggacatgtga

SEQ ID NO: 11605 - DNA, 321 bp, Glycine max
  Peptide Sequence Number=SeqID_103290
atggctccattgccgtcactccaaaacggtcaattaccctcaccgttgagaggactacacgtcctcaccatcagaggactacatgtcctcgccatcagaggactacatgtcctcgccatcagaggacttcatgtccttgccatcagagggctgcacgccctcacctccagaggactacctgtcctcgccttcagagggctacacgccctcacctcagaggactacctaagtcctcgccttcagagggctgcacgccctcacctccagaggactacatgtcctcgccgtgagagggatacacgccctcaccttgggtactag

SEQ ID NO: 11606 - DNA, 312 bp, Glycine max
  Peptide Sequence Number=SeqID_103291
atggataaccactcgggtatttccgcccgtcagcgtgactcaaaagtcagtatgacagatcttgtaagtgcggaagatgatgtaaatctccgcgtgtcaacgggcttgtcggccgcgattgacgaagggcgcagaatgaccataatttgtctctgcgtgccatcggacacgactgtgtctgaatggcaaaaggggtgcggaatgaccataatttgtctccgcatgtcatcgggcccgccacctctggatgacaaaagggtgcagaatgaccataatttgtctctgcgtgccattggacacgactatgtctga

SEQ ID NO: 11607 - DNA, 150 bp, Glycine max
  Peptide Sequence Number=SeqID_103292
atgaaagataaatgcaatgtgcctgaattgcacaatatgttagttcaggaagaaacaaggtttaagaaacaaggaagttacttaatccattatatgcagcggaaggcaaaggagaagatgagaggggaggcaccatccactagggaataa

SEQ ID NO: 11608 - DNA, 927 bp, Glycine max
  Peptide Sequence Number=SeqID_103293
atggagggcagtatatttctgatcgttctcaacgacctgcgtagggagggattgaccctaatggccaataacctggaagcggccatgcgcaagcgtgcagaacattggaaaacgctcaattatcctttcggaagcgaaatgccctgggactccaccggacaggaagaagtgtacctctggtcccgcttttttggtttcgacgagaaagcccaggtgacgctcaatgccattatcgcttatatgccgacggtaccacattggggttataatggcagcgcacgtcgttactgggactttgtctatggtggcaagctttcacgcattgagcgtcagctacaccactatggctctgcactcaatgccattcccgtcctgactgcctatcgcgatcatcccgacgatttctacctgctccgtatcggtcatgctggtatgatgggagcactggctaatgtcaccgaagatggttttggccccggagcattccactcctacccttccacactggccaatgatgggatatccggagactatggaactggattttatggctatgctgtcaactcgggaacctatattgttgagcatcctgaatttggctggctcgcttttagtggcaacctgaaaaaggaaaaacaacaggtcaaagttgccctgacgacagcctccaaaggccgtgtattcctggctaaagaaaacctctggctgacgacagatgccggtgagattgccgaactgcactacgatcagaaagaccgcagcgttacactggttttcaacaatgatccagcccagaatatcgcgcatattttgctcaatgtaaatcccgaaagccactatgaggtggatggaatcaacaaagatcaaccaaaccgatatgcaatccccctttcgaagaaaacagtaaaactgaaaaagctgcactag

SEQ ID NO: 11609 - DNA, 432 bp, Glycine max
  Peptide Sequence Number=SeqID_103294
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatttccgcctcgaccactacctgggcaaggccgcggtgcagaacctgatcgcactgcgcttcggcaacacgctgctggaagcggtgtggaaccgcaactacatcgaatcggtgcacatcctggtggccgaatcaagcttatcgataccgtcgacctcgagggggggcccggtaccagcttttgttccctttagtgagggttaa

SEQ ID NO: 11610 - DNA, 60 bp, Glycine max
  Peptide Sequence Number=SeqID_103295
atggttcaaggaaaatttgttccaaatttgggggaggtattatcaaggtacggaagctaa

SEQ ID NO: 11611 - DNA, 194 bp, Glycine max
  Peptide Sequence Number=SeqID_103296
agtggatccaaccttgacccatgggctcaaaaatctacccaaggttcatgagaaccctagggccttctttagtagctctagcccgagcctcttcgagtcttctatccaatacccttggggggaaacatcccttagcactaccatacctcttgagcttgaggttattcctcaagtaaagaagttgttggatgagg

SEQ ID NO: 11612 - DNA, 261 bp, Glycine max
  Peptide Sequence Number=SeqID_103297
atgattgatgatgaaaaggcagctgtgtctccagcaaaacctccaaaaagcctggatcatgaggtcgatgatcccctgtatctgatgacattgaccattccacatctatttttgaaacctgtccaggttatgtgggatgtttccctattcggactgtttaattcaaacttccccttgtacataaagcatgaagatctatctgaaatagcacacggtggtcaatgtctcagcatctctgttatacagttgtggattctataa

SEQ ID NO: 11613 - DNA, 432 bp, Glycine max
  Peptide Sequence Number=SeqID_103298
atgaccatgattacgaattcgagctcggtacccatggtcaacttgacgcaacccttcacgatgacactgccctggttgtcgcaatacggcggcatcaccaatgccgcgaaacagatggccgctgcaaccaaggatgcattgaggggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 11614 - DNA, 201 bp, Glycine max
  Peptide Sequence Number=SeqID_103299
atgtctcctccacctctaaaaacctcacaatctctcaaaaactccttcaaagctcttcaagatgcctcctttggtctgctcagtcgcctttgggttcgcacgctccaaaaatctcgtccaattctgtgttttcaggttttatatggaaatcctgccggtggcctcctgttgagcgccaatgtcgcgcttagcgcgcattag

SEQ ID NO: 11615 - DNA, 321 bp, Glycine max
  Peptide Sequence Number=SeqID_103300
atggaggatggatctttgagcttcaatggtgattttccaccatggagatgtagcagaagatataggagaatagatgagaggatgtgtcatcgacgagggaataagccatggaagaaggagcttcaccaccaagaatgcgccttggataagaagcttaaagagaaagattcaatggaggaaaagaaagatgatataagatccattagagcttgtaggcctaggatcttcttcatcaatggattcctctgcttcttggaagatgaatggcagtggaatggagaaggaagagagagaggaaatgccactttaaggagaagatga

SEQ ID NO: 11616 - DNA, 348 bp, Glycine max
  Peptide Sequence Number=SeqID_103301
gaacatgaaatggaacttcatcgacttaatcaaaatgaagaaaccaacaaaaagaaaagaagcatagcacttaaagcctcctcatcaatgcaagaagaaaatgaagaagaagaatcagaagatgaagaagacttctcactctttgtgaagaagtttaaaaaatttgtcaagaagagaaaaatcgagaggcgtcaaaacttcaacaatggaagaagatctcaagaagactctcaaattcttagatgctacaaatgcaaccaacttggtcacatcaaaccaaaaaggcttacattgcacaggatgacaatgactcatcggatgattcagagaaggagatcaaccttctaa

SEQ ID NO: 11617 - DNA, 193 bp, Glycine max
  Peptide Sequence Number=SeqID_103302
tcacataaaggcacactaccccacaaatgagtcatggcctgagaagaatgagaagaaaagtcatgaagaaagaagatcgaagaaggcgtatattgcatgggatgacaatgactcatctgatggttcagagaaagagatcaaccttctatccaaggactatgagagcgatgagaacatctctcaagaagattaa

SEQ ID NO: 11618 - DNA, 89 bp, Glycine max
  Peptide Sequence Number=SeqID_103303
atggccactggatggactgactacaattgtgagtaccaagccgcctctcataatgttttatttcctacttcgttgtatgttttactagg

SEQ ID NO: 11619 - DNA, 498 bp, Glycine max
  Peptide Sequence Number=SeqID_103304
attgccaaggaaatcactgccaaacaagtccagctttggccaaagaaagggaagctttcagcagggaagctaagtgtgaagtatgcaattctacacaggattggtgctgcaaactgggtacccaccaatcatacttccactgttgccacagagagatctcctctatccctgcattacaaactgtttgaggggacacatgtcccagacattgtctcgacatcagggaaagctgctgcttcaggtgctgtgtccaaggatgctctgattgctgaactcaaggactcatgcaaggtgctggaagcaaccatcaaagccaccacagagaagaaaatggagctggaactacttatcaaaaggctctcagagagtggcattgatgatgaagaagcagctgaggaagaaggagaagcagctgaagaagaagaagaagctgctgaggaagaggaagatgcagcagaagagacagaatcagatgatgattctgaagcaaccccatga

SEQ ID NO: 11620 - DNA, 192 bp, Glycine max
  Peptide Sequence Number=SeqID_103305
tacgaatcaacggaagcgtggctatcgatcctttatcttcggattgaagctaaggtagaaaagttacacagggataactggctgtggcagccaagcgttcatagcgacgtgctttttgatccttcgatgtcggctcttcctatcattgtgaagcagaattcaccaagtgttggattgttcacccaccaatag

SEQ ID NO: 11621 - DNA, 73 bp, Glycine max
  Peptide Sequence Number=SeqID_103306
atgttgtcctcgcaggaaatgggtccgaagaaactctccacgaagaggtctagaagagacgccacagcggaag

SEQ ID NO: 11622 - DNA, 371 bp, Glycine max
  Peptide Sequence Number=SeqID_103307
gaaacagctatgaccatgattacgaattcgagctcggtacaacatacattcctaagagtgaagagtttagaattcggcttccaaaccaagtggttttcaagagtacattgaagaatcttgagcctttgttctcaattatcaaattggtaatatcagagaggtggtctttatactttcttcaagaattgacactcgatttttcgacctgcaggcatgcaagcttggcactggccgtcgttttacaacgtcgtgactgggaaaaccctggcgttaccaacttaatcgccttgcagcacatccccctttcgccagctggcgtaatagcgaagaggcccgcaccgatcggccttcccaacagttgcgcaagctga

SEQ ID NO: 11623 - DNA, 336 bp, Glycine max
  Peptide Sequence Number=SeqID_103308
atgaatcagaaatctacacctgttgcaagagtctgtggtctatgctcttctgcagatcaccatatagatatttgtccttctttgcaacaatctggagtcaacgagcaacctgaagcttctgctgcaaacatttataatagacctcctcaacaacaaaaccaacaacaacagaataattatgacctttcaagcaaaagatacaatctaggttggaggaatcatccaaatctgagatggacaagtcctccacaacaacaacagcctgtccctcctttccagaatgttgttggttcaagcaagccatatgttcctcctccaatgcagcaacagcaataa

SEQ ID NO: 11624 - DNA, 531 bp, Glycine max
  Peptide Sequence Number=SeqID_103309
ggctacacgccctcaccttgggtactagttaccctcaccatagagaggactacacgtcctcgccttgagaggactacacgttctcaccatcagaaggctgcacgccctcacctccagaggactacatgtcctcgccttgagagggctacacgccctcaccttggaggactacacgtcctcacgatcacagggctacacgccctcaccttgggtactagttaccctcaccgttgcagaggactacacgtcctcgccttgagaggactacacgtcctcaccatcagagggctgcacgcccttacctcaagaggactacatgtcctcgccttgagagggctacacgccctcaccttgggtactagttacctcaccgttgagaggactacacgtcctcgccttgagaggactacacgtcctcaccatcagagggctgcacgccctcacctccagaggactacgataggactacacgtcctcacgatcacagggctacacgccctcaccttgggtactagttaccctcaccgttga

SEQ ID NO: 11625 - DNA, 423 bp, Glycine max
  Peptide Sequence Number=SeqID_103310
atggcattgcctttaatatccattatatggaggaggtggtgcctgaatgtcaatgtaagtagcattgttcttgtgaagggagatgatggggttggtgatgacgaagaagaggaagtttttcggacagtgatagatgggacaccagcgatgagtgaccagtcaataggggtcattggaaaacaacaaaataaccagggaggatatggggaacaaaaggttaacaaagaaggaattgatcaaatagatgaagcagaaatggtattggtgcagggtatgcatataggtctgttggggagtagtgaagagggagtgacagcctctgagagtgccaatgtcgggaattcgtgtccagtcgaggaggtgcgactaccatgtgccaaggtgaaaggcgttgaagagagcgaaattgggaatacacattag

SEQ ID NO: 11626 - DNA, 267 bp, Glycine max
  Peptide Sequence Number=SeqID_103311
atggatatttcattttcgaaccctaataaaagatcttcaagctacgatgaagatttgtgtggaaaggctacagttgtcgtcggtggtgatgaagcaatcaacgacggtgaagttgaggttgttggcaaagaactaggcaaacaaccacgctctgatcaacgagttcgatgctctggtgtagcgatcgtggaagtaggaacatgctgtgataacgttgccgagtttgtctctgctggaagagaacaaagcactaataacgaatgttag

SEQ ID NO: 11627 - DNA, 384 bp, Glycine max
  Peptide Sequence Number=SeqID_103312
atgtctatggttgttaacctgattggtcactatgtttgtgaccaagctgatcctgctgctattgtaatcaggaatgactgggcatcagtgtcaattaatgttgccctgcaggtgctgcaagagcaagaagtggatgggtttcaagcaccctgcaaggaatgtaaaggaagcaagttagctggtcttagaatttggacattggacttaactcaccaattaactaactctaactgcttgaagttggacattggacttaactcaccaccacaaaaccgggttgtaagtcaatgtgggatctcaacacaccctgcgtcatgcacaatcggcacaagacttgaatctggagcatggcccaataacaacaacatctcatgtcacggctaa

SEQ ID NO: 11628 - DNA, 1107 bp, Glycine max
  Peptide Sequence Number=SeqID_103313
atggatgagacaatttgcgtatctgaagaagatcataagagtggaagtagcaaaccctcttctccaagtcttagaagaaaacgttcatttttcgatttgaatgaagaagctgtggatggtggtggggatgatagcaccagtgatgatgaccccatcaatagcaatgacatttcatcacaagaaggtaatttgagtagcaataataactctagtgaagaagggaaggagcgtgcatctacggttaggcaatatgttcggtccaaaatgccaaggctccgttggactcctgatctccatttagcttttgtgcatgctgttgagaggcttggtggacaagaaagagcaacgcccaagttggttctccagttaatgaatgtgagaggactcagcattgcacatgtaaagagccatttgcagatgtatcgaagtaaaaagcttgatgagtctggccaagttttatctcacaataggtcaatgcaaggaaggcatagtattttttatatgtacggaagacttaatgccccacgacactttgggaatgataatagaaattatttgccatcatctgtgtttatggaacaaacaccctatgaaatcagtgctcatggctcttcaagattacacccgacagcactcttcaatagtaaaatgatgataagatcaagttcagggtgggacaaagatttatataattctcagtcgtatcaacgtagtttctgcagtcctaacctcactgggcacgcgaagtttgatgctgaggttcatgatgtgaaaaatcgaatgccagaattcataaatcaggttcaagtatggaaacaaggtgacatcaaagatcaattagagaggttgaatgagatgaaagcatccccgagtttcttggaactaaaactaagtcaagattcaagaaatgctagagattaccagatgaacaaagacacagaaagtgaacaaaaaattaatacgaaactctctttgtcattgttcacttcgtcctcatcatcctcaaattcatcacaacaagcacaatgttgtgaaaagaataaagacaatacccatgttgagagtttttgttttcaaaattatgcaccaagaaatcgtttgggctga

SEQ ID NO: 11629 - DNA, 78 bp, Glycine max
  Peptide Sequence Number=SeqID_103314
atgcagtacatcttatgcagtaagggtcaagacatggtacaaccaaagcctgaaaacagggacactgtctgtaaataa

SEQ ID NO: 11630 - DNA, 1278 bp, Glycine max
  Peptide Sequence Number=SeqID_103315
atggatgcaaaaggcataacttgggttggaaacatattccagaagtttgaggacatttatgtggacgtggaagacacaatgttggagttgtttgaacttaatcccatactttctgtttcccttttttggggatatgaaaccgttaagtacatagggaatcagatgcagactgttggggaaagtgttaaaaagatctattcagatgtcatgcaagatttacttcctccgcctttatatgatttggatgaaacatcagcctctgagttgccaatagatcaatatattgacgctggattctctaataagtcatttcaaggttccaagaaaataactgtaaaggatgataccaaccaaacaactgaggattcaaggatcaaacatgatgttgataatgatgtaatccatgctaaatccggtgattctgatgctttgttcacatcagcttcttgcaactctgtcaaagggaatagttttatttcacatgcaagacaatacgttggtagcacagatattagatcaaacctcggtggtgatgaaaatcgacaaaataaaagcatacctgcttccaagacagtcagtgaaatcactttgtcaaaagcagatacatgcagtacatcacaatcatgtgaactctcccgggtaaatcaaaatcatgcagccactgtttcaaaggcagcttttgctgaagtaactaccattacctctgtagatgactgttgcaatgaaattgaaaatgcaagtactgaagaaatccccaatgtgctggtattggcagctgaatcagccgaagagaaagagatgcatgttagttcatattcctccagtgacctatttggagatccatatggggtcactatggtcggaacatttgagcctgacaattattcttaccccacaaccattgcatctcatccagaaacatgggatttggatgtaccaaagattggtactattattgtagagcaaggccataaaaccatacagcaagatgatgaactgaagcttgaggaaacttgtgttatggtgactagagatgaacttgaatcagttgccattgcactgggtaatctaataactagcaagaacaagaagaggcaacccttttctttgtccaagaaggctgcaaggaggcaagagtatgagaagcttgcaatattgcatgggaacaatgaaatagaaaagggtgattttgcagagaatttatgtccaactttacaggatgatcataagaaactactgcttcctgatatttctgaacctgagtgggagcttctctaa

SEQ ID NO: 11631 - DNA, 1248 bp, Glycine max
  Peptide Sequence Number=SeqID_103316
atgggtggtggtttcttgttaccattgccaaccctcttgttgtgtctctttgttgtgttaatttattattccctccaaacaaaagctgaggaatttgatgagtccttgttgttcaatggaaaaaacgtttccagtttcagcagtggcagaaagcttggtgcaggaagatgcaacttgttccgtgggaaatgggtttatgacccttcataccctctctatgacccttctacatgtcccttcatagatccacaattcaactgccaaaagtacggtagacctgacaaacagtatcagaaatatagatggcaacccttctcttgtcctttacctaggttcaacgcatttgatttcctggccaagtataggggcaagaagattatgtttgtcggtgactccttgagcttgaaccagttcaactctctggcttgtatgattcactcttgggtgcccaacactagaaccagtttcataaagcaagatgctctctccaaaatcacatttgaggactatggccttcagttatttctataccgcacagcatacttggtagaccttgaccgtgagaacgttggaagggttctgaagattgattcaataaagagtggtgatgcttggagaggcatggacgtcctagtttttaacacgtggcactggtggacccacaccgggagttcacagccgtgggactacattcaagagcgtaacaagttgtacaaagacatgaaccgtttcattttattctacaaaggtttgacaacttgggctagatgggttaacatcaacgtgaatccagcccagaccaaagtcttctttctaggaatttcccctgtgcattatgacgtgttaatgaagcacggacacttcactcttttgtcgtgttcggtgtccgacatgcgtccgtgtcagtgtccgacaccgacacgatacccttattacgttttatattttggacattacagggggaaagattggaatcaaccagcaaaatcttgcatgagtgagacagaaccattctttggattgaagtaccctgcagggacaccaatggcatgggtgatagtgaacaaggttttgagtaggataaagaagccagtgcaattcctagatgtgactacactctcacagtacagaaaagatgcacatcctgaaggctacagtggggttatgccaactgattgcagccattggtgtcttccaggactgcctgatacatggaatgtgcttctccatgctgctttatttgactga

SEQ ID NO: 11632 - DNA, 405 bp, Glycine max
  Peptide Sequence Number=SeqID_103317
atgtattttatacatgttagcacttccttgcatggacttagactaaagacacgtattaaaagtaaaaatttaaaaatgtggtgtttggtggagtttgggattttggatgtgcaggaagcaattgtcacatatgagcggtctaatctaaccttaacctttgtaaagctagctaccatttcactaggacttaaagaataccaacagctaatccagatttatctcgaatcaagaaataacaccatcaacttccatgaggtaaatgttgactatgcacttagctataagcacttagagacacggcttaagattaaggaccttgttgatcaatctgaaaacatgacatcagtattgtctcttcctcaccaaggatcaacaatagtcactgtcaatattaatatatattaa

SEQ ID NO: 11633 - DNA, 324 bp, Glycine max
  Peptide Sequence Number=SeqID_103318
atgggaagattacatgttagataccagctagttgaacacaggaaaggaataattgcagctgtaaggggacttcatggattaagttatccacagagagttcaagaaactaaaatcaaatcttgtgttcactttaagggatgtgaaaagggatccgtctcagaacatacacttgctgctgctgccaccacttcggcaacgccacgccgtaaccgcacaaggcacctcctcgcctcttcaaagggaaatttttggttcaaatcttggctaatcgcaagccaccttcatcttcttgggttacgcattagcgttgaaggctgcacttga

SEQ ID NO: 11634 - DNA, 702 bp, Glycine max
  Peptide Sequence Number=SeqID_103319
gtgaggaaatcagaagaggagtttgaaaatgagtacagcaagattcatcaagtgtgttactgtcggagatggagccgtgggaaagacctgtatgctcatctcttacaccagcaacacattccccacgtttttgacaacttcagtgcaaatgtggtggttgatggaagcacagttaatctcggattatgggacactgctggacaggaggattacaacaggcttaggcccttgagctacagaggagcagatgtgtttttgcttgcattttccctcctcagcagagccagctatgaaaatatctctaagaagtggattcctgaactgagacattatgcccccactgtgccaattgtacttgtgggaaccaaacttgatttgagggaagataggcagtatttgattgatcatcctggagccacacctataactactgctcaggcagaagagctgaagaaggcaattggtgctgctgtgtacatagaatgcagctcaaagactcagcagaatgtgaaggctgtgtttgatgctgcaatcaagaaacacaaaagaaggcatgtgaaagagctgaaggtctggagaccttactcaatgtgtcacactcgctcagcggacaactctcgctcacgcacaaagaagccgcctagggaagtcaactgtcacgtgaaggcgtgcttagtgtataaccacttactcctcacttag

SEQ ID NO: 11635 - DNA, 1155 bp, Glycine max
  Peptide Sequence Number=SeqID_103320
atggaggatggaagtgagaaatggaattttcaggggaacaagaagctgaatgcttcatccatctctgtgagaggggtctataacatgttgatggagagagtcaacaatagccgagacaagaaacctttggttcctctctgtcgtgtagatcccaccgagaacccattgtttcggactaccccagaagctactgattctgtttcaactgctgttaactcctataacttcaactgttaccctcccaccgttggcttacctgatgcaaagagggctattgcaaattatctctcttctgatcttccataccaattatcaccagagaatgtttttctcaccatcggtggcacacaagctatagatataatcttgcctgcccttgcacgttctgatgccaacattctccttccaagaccagggtacccgcaatatgattctcgtgctagttgttgtctcctcgaagtacgacattttgatcttttgcccgagagaggttgggaggttgaccttgattcccttgaatctcaagcagatgaaaacacagtggccatggtcctcatcaatcctagcaatccatgtggaaatgtcttcacataccaacatttaaaaagggttgctgaaattgctaggaaacttggaatctttgtcatttctgatgaagtttatgcccatgtaacttatggaagcaatccatttgttcccatgggggtgttttcttcaatagttccggtcattacaattggatctttatcaaagagatggttagttcctggttggagaactggttggatagccacatgtgaccctcatggaatttttcagaaaactggggttgtgaaaagtatcatcagttatttggagatcacaactgaccctccaaccttcttgcaggagatcccttgcttaacatgccctcacaaaccagaaggagcaatgtgtgtcatggtggagattaacttctcacaaattaaggacattgttgatgatatggatttctgtgccaagctagctgaagaggaatctgtccttcttcttccaggtgtcacggttggactgaagaattggcttcgaattagttttgctgtcgacacttctaatcttgtagaaggccttagcaggataaaagcattttgccttcgatatgcaaagatgccatga

SEQ ID NO: 11636 - DNA, 300 bp, Glycine max
  Peptide Sequence Number=SeqID_103321
atgatgaaagagaaagagaataacaagaaagaaagagagtgtgtctcaacacaatgggtggttgaggagagagaaagtgagatgagagagaaagggtgtcaaggatggggtgtggggacattgaaggagatggcgtggctgcgtagcatttgggatcagcatgcaaaagagggtatgtggcagtttgataattcattgggagcaggaattttggctatgtgtaattctcttacaagctctctgtttacaaatatctctgaagggtttggattacattttggggcatcacagctaacatga

SEQ ID NO: 11637 - DNA, 165 bp, Glycine max
  Peptide Sequence Number=SeqID_103322
atgcccagaagaatgtcggcaagattgaacctctttgagccgatttgtgcaaaatttgttaattttcgtattaaacgttgttacagctccgttagtgaggacttccctataggacacgtgtcttccttttactgggcgggaccacggctaacgtggtggtcttag

SEQ ID NO: 11638 - DNA, 219 bp, Glycine max
  Peptide Sequence Number=SeqID_103323
atgaccttgtatttcacgaccttccctactagaacccaacccctatcccatgccaaaagagatgaaaggaacttagttaccttcaatgacgacaaagaggttgtaggtggatgggaagtgttgccattgtgggacgattcaatttgttgcgaaaatccttggaggaaaacacatcgtcacgggtgggaggtgctgacgtcacagggaaggaggtgttag

SEQ ID NO: 11639 - DNA, 672 bp, Glycine max
  Peptide Sequence Number=SeqID_103324
atggtttctgtgggcccaggcaagttctacggcaccagcctcccccgccctcggatctacaccgacgtcaagttcaacgaccaccgcattgacccacccactcccgtcaacggcccacttatgtcctgggcccaagaagcccactggtccatgggcggcctcagcttcaagcgcctccgcctccagggcaaaatagaaggcaacgtcgaaaggctccgctaccagcgcgagaaggcccaagcccaaagcccgagcccaccacccccgccgcgctccgttctccgcggatccaaaagaacttcctccccttcgccgccactggctccgttcgcgacgaaacgccgaaggtgcatggatctgatcctagaagaagaggttgaagctccgagtgctggcgttaggaagagtcgcttagtgaagaagcttggcgatgattttgatagggtggcttctttggagaacgagggtgctgaaacgacgtcgttgaagactcggagtaagagattggttaaaggtggcaaacctgtgaagaagatggcggttgaagagtcggagaaatcaaagcccaaagcaaagaagagtacagctgaagctgctgggaagagctttgtttctgttaacgctgttagaacttcgcccagattgcccaagcgtgtgtccaaacacctatag

SEQ ID NO: 11640 - DNA, 483 bp, Glycine max
  Peptide Sequence Number=SeqID_103325
atggttcacatggagctacgagaaaccatcattatcttggttgggatgcttgacacatacttaaatgtcttggctttgtggcttctgtttcttctttttgctagctgggtggcgtatgtgttttttgaggatacaatacaggggaaaacagtattcacttcctatggtactacattgtatcagctgtttcttttatttaccacatccaataatccagatgtttgggttcctgcatacaagtcttcacgttggtattgcctgtttttcatactatttgtgctggtgggggtttactttgttacaaacttaatccttgctgttgtttatgacagtttcaagagtgagctcgtaaaacaagtttttgagaaggattgtttgagaaggaatgtgttggacaaagcttttgatctcttggatacgcatccaataaaagagaaggcttcagaaagcttctttttctgtgaaggcatgtacagcttctaa

SEQ ID NO: 11641 - DNA, 888 bp, Glycine max
  Peptide Sequence Number=SeqID_103326
atggccgaaggggttgttgtctcgttgcaggaatggcagggttggggcaccacctccccgctccccaccatggttgcccaaatcgtcgaggatttgaaagttctggaagaagatttagatgcccacatgagttttggcggcaatggtggaaagttacaggggaatttcagagtgcaagaagataagaaacaccgtgcaacgtatcaggctttgggtgattcggaaaagaagctccaattttattcagctagacagatagcttgtcgcatactaggtagcaggggttacctatgccaaaagtgctggcttcccatggaggattgtatgtgttcaaaagtcacatcctgttcactctaccctggaatcaggttttggctgtatatgcatccaaaggatttcttgagacagaacaacactggaaagattttgtggcaggtgtttggggttaatgcggcaactttgtgcctttttggcattcctgaacatgaggaaatcatgtggaattcttttaaaatggcagctttaaagtcagttgaaaatgcgtttggtcaggaaccagttgcaagtgatgaagtcgcaccatcagaggataaagcaaagtcagtttggggagatgaggaccttgcatgtatatccctaaatcctggtgcctctgctatgcataaacttaggccacagccatcttgggatcgtacatgtacagcagcagcagctgctggcctgctctcagagctccaacttcttccacagtttagcaccgttggattggatgaacaggaagaagcagtagaacatgctttaacagtcctattagatgccctcacaaatagacgtcttcgcgtgggaaggtctataacacgaaaaatgaggcataccaacatccaatag

SEQ ID NO: 11642 - DNA, 1950 bp, Glycine max
  Peptide Sequence Number=SeqID_103327
atgatgatgctaatccgatcaaaatgcaaacttgtgaaaatgtgtggtgtttgcgtttgtgggtctctcgaaatgtgcatgtactcgacggaaagcgtggtggcgagtctcgaaaatcgcgtgtttaaggttggggatccagtgattccagtgagtcctattctgaagcagtgggtggaagaaggcagagaagtcaccaaacttcagctcgaaaatctcgtttaccgcctcactcaatctcgtcgcttcacacatgcccttcaggtgttggagtggatgagcaatgaaaggaactatgagttgtctccgggaaacattgctaaacagatcaacctgatatcaaaagtccgtggccttgaacaggcagagaaatattttagaggcatccctgatgctaaaattgagttcaagatctatgctgctcttttgagatgctatgcggaacataaatctgtggaggaagcggaggctgtcttgaaaaaaattaaagagttgcatcctgtgaatataactgcatgttgtaatatgatgttggaactctatgctaagaagggtaagtacgagaaactggataggttgatgcaagaaatgaaagagaaagatatatgcaatgctggtacatatacgattcggttaaatgcatatgtgatcgccacagacataaaggggatggagaagttacttatgcaaatggaagttgatcccatggcaactgtggactggtatacatacatgactgcggcaaatggttatcggaaagttcacaattttgagaaggttgcagcaatgttaaagaaatcggagcatgtagccagaggcaagactaagaggcttgcttatgaatctattcaaactatgtatgccattattgggaataaggatgaggttcatcgactttggaatatgtgcactagtcctaagaaacccaacaaaagttacatacgtatgttaagctcgttagtgaagctggatgacatcgatggggcagagaaaattttggaagaatgggaatctgtacatgaaaattttgatgtcagaattccaaatttgatgatcagtgcttattgtaaatggggacagtttgataaggctgaggcttatatcaggaggcttttggatggtggcaagcatttagatggaagaacatgggaccgattggcgtgtggctataatgcaggtaatgatatggagaatgcagttcaggcaatgaagaaagcagtctcgacaaatctagcaggaaggaggccagacccctttactctggttgcatgtgttaaatacctgaaagaaaaaggagacttggatttagcccttgagattcttaagttatgcatagagaacagccatatctcagtcacttcctatgatggactgcctgaagcaagagcttcatcgcttatatgcttacccagacacttcgttttaagcagtatggagagtagtccctctcagctgagaaattggatttgggtttgttattccatcatgcaccttctcgctaaatcactttcaccatcgtgtaatctttcgtcattcacggcgtcgtcgcctgtgactacggttaatttagaatcacactgttcgggtcaccccaaaatcatcaaacctagtttcaatcacaacaggatcaacaccttgcacactggttccactgtagaacatgttgaagtggatgaggttgaactcgattcactacaaactgcgttggccattcaccttgccatcaaacatggcaacacaagacttccaaggattaagaatcccaacgcctacatctcaaaaacttttgttcccttacgcgtggttacaaaatctgaactcaacaacctctctcgcacaacacaagaattggaagggaagagggggtgcttgggtggcacagggaagaggacaacggtgcaaggaaatagtcattttgaaatgggggtgttttctgttggagtcttttag

SEQ ID NO: 11643 - DNA, 774 bp, Glycine max
  Peptide Sequence Number=SeqID_103328
atggtatggaggcaccagatgattgctgcagcaagtgctggctaccaggctattgcctttgatttcagaggctatggactttctgagcatccggcagagccagaaaaagcaaaattacttgaccttgttgatgatgtcgtgggtcttttagattcattaagcattaccaaggttgtgcttgttggtaaggactttggtgccgttccagcatatattcttgctgctctccatccagataaagagccagggagagcagaagcagattgttgccactttgatgttaagtcggttataagaaacatctacacactcttttctggaagtgagatactagcaggcgataatcaggaaatcatggacttgtataacccatctactcccctgccaccatggttctctgaggaagacctggcaacctatgtatcactgtatgaaaaacctggcttcagatttgcattgcagttttctagtctagggtacatcagtaatattatcacagctaataatccacacgggactcttggagtggatagtggtataagtgatcctaaaatcacagttccagcactgctgatgatgggtgagaaagactatgtcgtcttcaagtcttttggcatggaggactacatccgaagtggcacagtgaaaaattttgtgccagacttggaaatcatatatatttcaggaagccatttggtgcatgaacaatttcccgagaaggtgaaccagctcatcattgaattccttaacaaacaaaagcatctgattgtctga

SEQ ID NO: 11644 - DNA, 534 bp, Glycine max
  Peptide Sequence Number=SeqID_103329
atggcacttgacacatgtaaggaactcatggatctttcaattggggagttaacaagactccttaaagcaaatgcaagttcattcaaacacaagcctaatgttactatagccgaagatggaagggaatatttcacaaccatcaatgaggcattgaagcaagtacctgagaaaaaccgaaagtcattcttgatctatatcaagaagggcgttcaccaagagtatgttgaagctacaaaggaaatgacccacatggtgtttattggcgatggtggaaaaaagacacgaaaaactgaaaacaaaaacttcattggtggaattaacacttatagaaaccgtcattattgtgagattgagaataaggcttaccttgctcgtccatggaagaattactctaggaccataatcatagaaacttacattgatgatttaattcacgcttatgggtatttgccttggcagggactagaggacccttctagtataaacacttgcttctatgttgagtaccacaacacttgtctcgattcaaactaa

SEQ ID NO: 11645 - DNA, 342 bp, Glycine max
  Peptide Sequence Number=SeqID_103330
atgatgattgcttccttctatgccaagactttccacagcttcccttcatgctacaagcttgtgcttctctgtactctaagtggtggaggtgtggggtcatactcagaatcaaaatctgatgctaaacctcatgttcctagtattgatcctaatgagccaaagaaaaagaaattggtggttcttggaacaggatgggctggtaccagtttccttaaggatctccacgcttcgttatatgatgttcaggttgtttccccacgtaactactttgcattcactcctttattacccagtgtcacttgtgggacagttgaagctaggagcatagtagagccagtctga

SEQ ID NO: 11646 - DNA, 264 bp, Glycine max
  Peptide Sequence Number=SeqID_103331
atggaggaaggaatcaaagatggaactccaacaaaagacaacctcattagttcttctcacaaaggtagctcctcaagaatccctggtctctctaagccagagaaccgtgttgctgggaatggttatgaaaatgtgattcatcaagcatccaagtgcagtaatgttgatgctgctgataaatttaaaaaagctgaagaatctcttagaactgtcatgtatgatatttggaactttttggataaatttttcaacaagtacccgtag

SEQ ID NO: 11647 - DNA, 714 bp, Glycine max
  Peptide Sequence Number=SeqID_103332
atggcagtgtcattttcgcaggcagatgaggcattgggtgcagccagcgtaggaagcgttgcggcaattcttttccaagttgcgaacgatggcggtggggatggcgttgtgggtaccgccggaggacgcgttgcgaagcgcggtggtgacgttgaaagcgttggggcaggtcagggaggttatgtggtggagcctgatgccacagaagcagagaatggcgtcacaggtggcgttgggctgtgggattcggatgctgcggttgcggagcgagtcttggagagagttgacgcatttttgggagtcgtcggcgggcatcatggggaggtcgccggaggggggaggcgacgatgcagcggagacttcgagggcggtgcgggcgtgggcggcgaagagccaggcggcgaggacggggcagcagcggctgcggtcaagggtggggccgccaccgcaggcggcgttgacaccgccgaagagctcgttggagaggtcgaggcggcagatttgggactggtgtgtgatatggacgcgaggaaaacgaggtacgctataaaggaagtgaatgattgcattttcgcttttaagttgaactgtgggcactggttggtgattggaagtcgagtgtggtggtttgttttggtgtcggagaaagtggcaacgttgttctgggaagtggaaagaaagggtttgcgcgaggaaaaagaaggcactggataa

SEQ ID NO: 11648 - DNA, 294 bp, Glycine max
  Peptide Sequence Number=SeqID_103333
atgacgcgtggtggtaaaccggggtcattgaatcacaacatcggttttatgaccgtctttgaagggcggcttttctacatcggttgtatagctacaaccgatgtagaatgggtaggtctctatagcggttctaaggctgaaaatgatgttgaatggaatggacacaaatggaaaggtttctacatcggtcttcaatcaaccgatgtagaatttgaagagtttttacatcgtttatcacctaaccgatgtagaatgatgatattttttacatcgtttataattgaaccgatgtag

SEQ ID NO: 11649 - DNA, 432 bp, Glycine max
  Peptide Sequence Number=SeqID_103334
atgacgatgatggtgataattgcaatgatgttgatggtgtcagtgataatagtgatggtggtagtggtattggtagtggcaaacaatggtaacaatagtaataacggtgatagatgtgatattgatggtagcagcggtgatgatgatatggcgatggtggtagttgtggttgccaatggtagtgatgacaaaagtgatattgatagtggtgacaataacaatgattgcgacaatattggtactaggggtgatactagaaatgtcatggtaatgatactaatagtggtagcagtgttggtgttagcaaccaatgatgatagtggtaaagatattgatggtgatgatggtaaatgtgatattagtggtgataattacaatggtgttagtgatagtgacattggcgatatcaatgatgatgacaatggtacgtaa

SEQ ID NO: 11650 - DNA, 1200 bp, Glycine max
  Peptide Sequence Number=SeqID_103335
atgccatggccacccacgccactcaatgcaaccaagttgcatccccaactctgtgttcgattaactccagctgcagctgcccttgcttctgaggaatttaatcttcaatcttccgtttccaacatgttggcaaccaaactccaaaagcttcttatgctatcttcgcaccaccggttgcttctgtcgaaattggttcactttgcccctgatcttggtctccctccgaattttcgatcccggttgtgcaacgaccatccggacaggttcaagattgttgacacgtcctatggccgcacacttgagcttgcatcttgggatgtcaacttggcaaagcctttggtgcctcctgcatcatcatccaattctcttggtttcatagttgaccgtcctttgaagttcaagcaattgagccttcgaaaggggcttaatttgaagagacgtcaccaggatttcttgctgaaatttgaagaaatgccacaagtgtgcccctataggaatcctgctgagtctttgaccaaggagtcattggaggcagagaagagatcttgtgcactagtaagggaggttcttgcaatgacggttgagaagcggactttaatagaccacttgacccatttcagaaaggagtttggcctccctaacaagctgagagggatgattataaggcacccagaattattttatgtgagtttgaaaggggaacgggactcagttttcttggtggaggggtttggtgagaagggtgacttattggagaaggatggggctttattcatacaagatagatggatggatttggcaagggaatccaagagaatgagacgagagagaaggaagaataggattgacaaagatgttggcagcttgaatggtactgatcaaaatagttatgacagtgatgatgataatattgagatggacaattttaaagatggttatgatgatggttttgaggatatttttgaagagttggattttgaggctgaggatgatgatcatagaaacggacgcaaccttggtagttttcaatttgaagaacaaacatttccctacacaagtaaagcgatgcaactttctagtggcacttcgtcactacctcatacaaatctaacaatattcttagcatatgacacatgtccctttgctacaactttagtgaaaaagccttctacccgtgagcatacaaatcctaatccttga

SEQ ID NO: 11651 - DNA, 963 bp, Glycine max
  Peptide Sequence Number=SeqID_103336
atgagaaacgtttcaaagaacaagtggttcttaacctgtttccgtcctgtggttgatatagatgacatgctggagcctagagctgttgttgatcattctgccaatcgtcgtttcacctgtatccccgtcgcagacaaacatgacacaaaagattcagttaccaaaaccacgttttcggagcaagagtttgcacagaattgggtagttgtgccccatcctcagaagcgaaagttttctaagaatacaagagctcgaaacaaaaatcttgatggccaaagttgttttggatcaaagggtggttattcggcatccacagaaagttcatcaaccggtgatgagaagaaacaagcttttgcgggcaccaacattccaaaaatcaagccccctgaatggtcttcgcgaatttcatcttcaaattcgcccgaatcaaagagtgagtctcctaaagaccaagtagagaagcaaaagaagtttcagtgcgtaggaatatactgggttcttttaagcttagtagttacggtcttttggggtaagtgttgctattatagttgttggggcaaattttggcaaacatttaaactgaggtatcttggggatgaccttgtcctcataattggtattgaagagaagaaggcaaaggatatgattgagaagggtgaggattctttcctatcccttttccactcaattagaaggtggaatacaaagatagcaacgagtagcaggctgctttggggtatctgcaagagggtccagattaacgaggttgttcatcagataaataaaccttggggttgggcctttggagggttggtcgaagaaccaattagggaaaggggagcatgttatggaagcaaatctcatccaatgtcagaagttggtacaagaatttggaatctcaactcccaaggcgcagaaagcactttagaggaaatgaaggttgaaaatagcccgaggaggtga

SEQ ID NO: 11652 - DNA, 300 bp, Glycine max
  Peptide Sequence Number=SeqID_103337
atgtcttgtgggggtggtgagttatgggatgaggtgatcaaagcgaagtatggcggttggcaacgacgtttgggtgacaacggcccttcatacaagcagtcgttttggtggagagatctagccaagatttgttggaacaatagctcggtggggtggtttaattcaaacgttgagtggaaggaaaatgttgaagatgggtggagatggaaaatggaggatttgggccagtattcagtagcatgggcatatggagcaattcaaaaaccgacacaaaccaaggacaactccttctataaataa

SEQ ID NO: 11653 - DNA, 666 bp, Glycine max
  Peptide Sequence Number=SeqID_103338
atgaagaactgcgagctatgcaagcttccagctaggaccttctgcgagtcggaccaggctagcttatgctgggactgcgacgccaaggtccacggagcgaacttcctcgtcgcgagacacacgcgcacgctcctctgccacgcgtgccagtcactcacgccgtggaaggcctccggctctgccctcggcaacaccgtctcgctgtgccagagttgcgccggcggaaccaccgaacagggcccagagagccaaggagggaatgacgacgacgacatagacaccgacgatgaggatgactacgatgacgatggtgagagcgaggagaacgaggttgcagccgacgaggaggacggagacaaccaggttgtcccttggtcctccgagccgccgccaccgtccccaagctcttccagcagcgaagagtcgattagccggtgcaacaacgtggacgaggtttcgaccacattgaaacgacgtcgcgagaacgacgattttcagggttcgaattcgaataattggaaatgtgaacggagcgaagtggacagaggatgttggttggctcggttgcggcggagaaccgccgatgatgtggcggttgagcgacggagggctagagcggcgtttccgtacggttgttgtgatgatagagcatctgaagacgtttga

SEQ ID NO: 11654 - DNA, 831 bp, Glycine max
  Peptide Sequence Number=SeqID_103339
atggtagacgaaaattttagactcaccgcaatatcagaggatgatgtgtccagtcatcagtccgacaatggcgtctacatagatgatgttggaggtatgaacaaccaaagacagatatttggtctaagttcagaggctatccttaaggagcaactgaagacactacaagaggagtcacgtctagttcgagagcgatggcgtcagtttatggagagcttttctttgagtcctccatttggaccagttcgacattcggatcaagatgatgagcaagatgacaatgaatcagatgatgactttaatggagatcttgttctcccttctccgcgaactgcttcttcttctccggcaaggcaagcgcgaaccttgtcttcttcttctccgcgaacgagacttccggaagacctgttaggggttcttccggatgttccggaagaacattttccggaaagtttccggaagaagggttcttccggaagtaaccaaacgtcttccggaagacttccggaaaaacctcttccgggaactttccggaagaagtggttcatccggaagaattccggaagacgcccacttccggaagaagtttcaaacttccggaagacctttccggaagaacccttcttccggagtgtttccggaagaaccacttcttccggaagtggtcgtgccataggtagagttgtaggcagagatagagctgttgacgaggatgctggcgatgttcccgagaggcgtaggcctactgcctcagcccgtaggctacgcgttcatcagatgactacggagggacgtgatatggctgaggacgtcgctgacatgactgatgat

SEQ ID NO: 11655 - DNA, 1182 bp, Glycine max
  Peptide Sequence Number=SeqID_103340
atggattactcaagggctcatttgtgtcagtcactctcagacctaagccctaaagtaggaagtatagtcgtcgaagccttgaagcttccaaggcacctaagaatgggtcggttggaagccaaaaacttcatggtagaatatagccaagcaagcaaccaaatacccgctcttctagaattggcaaggctagactatgacatgattcaatcgatgcaccaaaaagaattagcagagatctcgaggtggtggaaagagttgggacttattgaaagacttggttttggaagagatggaccaagagaatgcttcctatgggtgttggggatttttccagaaccacgttattcaaattgccgcattgaacttgcaaaagccatatgcattttacaagttttggatgatatgtttgacacttatggaacattagatgaacttattctttttactaaggcaatcaaaaggtgggatcttgatgtgatggagcaactacctgaatatatgaaaatatgttatatggcattgtacaacaccacccatgaaattgcatacaaaattcagaaagaccacggccaaactgtagttgcttgtttgaaaagaacatggatagacttaattgaagcttatcttaaagaagccaaatggttcaacaacaaatatgtgccaacttttcaacaatatttggataatggggtgatttcttcaggatcatacctggccttggtgcatgcatcttttctcattggggatgacttctcaaaagaaaccatttccatgatgaatccaccatatccaaggcttttttcttgctctggggaaattcttaggctttgggacgacttaggaacctcaagggatgagcaagagagaggtgataatgcttgtagcatacaatgtctcatgacagaaaataatatttcagatgaaaatgttgccaggaggcatataaggaaactcataaagaatttatggcctgagctaaatggtctttccatgaccacaaccacaaccactcttcctttgtccgttatgagggcttctctcaacatggctagaacttctcaagttatttatcaacatggagattatcaaagcatgcttacggttgatgatcatgtgcaagcattgctatttacaccctctatcaactatcaagatgaaagtgatatcaatcatgttatttga

SEQ ID NO: 11656 - DNA, 477 bp, Glycine max
  Peptide Sequence Number=SeqID_103341
atgagtaccataagcaaagattcttcttcttccaagaatatgaccagtgagtgtgactcctccgaggagagtggttggactaagtactttgaggatttctttgacaaccataatattgatgatgatgatgatcagaaatgttctatgtcgtctttctctggtgttgatagctactactccacctcctttgtctctgattctgctacgaaaaaattaactgacaacacacaagctgaggaatatgatcaccaatcgagtttgaagaagagaaagaagatcaaaacagctttggttgatgatgctttggaagatactgcaagttctcctatcaaaggctccaaggaaaaaagaaataccttaggagaaagagatgaaaggaaagaaatgggttttaatgagggggataacgaccacacaaaactgaagaacaaaggcctttgcttagttcctttgtcgatgatagtgaaatatatctag

SEQ ID NO: 11657 - DNA, 1386 bp, Glycine max
  Peptide Sequence Number=SeqID_103342
atggattccacaagtgcagctcctttgcacgtagcaatatttccatggtttgccatgggccacctaaccccaattcttcacctctccaacaagcttgcacagagaggccacagaatctccttcatagtccccaaaagaacacaaaccaaactacaacacctcaatcttcaccctcacctcatcacctttgtccccatcactgttcctcgagttgatggtcttcctcaagatgctgaaaccacttcagacatacccttctctttgttcccacttctcgccacggctttggaccgcaccgagaaagacatcgaacttctcctaagggaactgaaaccacaatttgttttcttcgatttccaacattggctgcccaacctgactcgaagcctaggcatcaagagtgtcgcgtatttcatagttaatccgttatcaatagcgtatctcggaaacggaccaagacaaagccaaggaagagaattaactgaagttgattttatggaaccccctcaggggttccctgatgatgcatgcataaagtttcagccacatgaacttcggttcctcgtttccacaaggaaactcgagtttggaagcggcgtttttctgtacgatcggctgcacaccagtacatgcttggcagatgcaattggattcaaaggttgcagagaaattgaagggccatatgcggagtatcttgaaactgtgtatgggaagcccgttttactttcagggcctcttttacctgagccaccaaacactactttggaggaaaaatgggttgcatggcttgggagattcaaacctggttctgttattttctgtgcatatggaagcgaaagcccgttaccgcaaaatcagtttcaagagttgttgcttggtcttgaactaacaggttttccgtttcttgcagcacttaagcctcctaatgggtttgtttctatcgaagaagctttgccagaagggttcagtgaaagggttaaaggaagaggggttgcatgtggaggttgggtgcagcaacaattgatcttagaacacccttctgttgggtgtttcataacacactgtggagctgcttctgtgacagaggcacttgtgaataagtgtcagttgctgttcttacctaggttgggtgctgatcatgtcataaatgcaagaatgtttagtaaaaagttgaaggttggggtggaagtagagaaaggtgatgaagatgggttgttcacaaaagaaagtgtatgcaaagctgtgaaaactgtgatggaagatgggaatgaggttggaagaaaagtgagagaaaatcatgccaaactgaggaacttcttactaagcgacagtttagagtcgacgtgtgttgatggtttctgtcaacaacttcaagatttgttataa

SEQ ID NO: 11658 - DNA, 1455 bp, Glycine max
  Peptide Sequence Number=SeqID_103343
atggatgcacacgcaccatctatgcacatagcaatgtttccatggtttgccatgggccacttcatcccatttcttcacctctccaacaagttagcaaagagaggccacaaaatctccttcttcacccccagaagaacacaaaccaaactacaacatctcaaccttcacccacaccacatcacctttgtccccatcaatgttcctcacgttgatggtcttcctcacgatgctgaaaccacttcagacgtgccctcctctttgttcccacttattgccaccgctatggatagcacagagaagcacatcgaacttctcctaagggaactgaagccacaaattgtcttcttcgatttccaacattggttaccaaacataacacgaagcttgggcataaagtgcatacaatactggatacttaatccatcaactatagcatacctctggaacggaccaaggcagatccaaggaggagagttaaccgaagttgatcttatgaagccacctaaggggttccctgattcatccatcaagcttcatgcacatgaacttcgattccttgctgccacaagaaaactcgagtttggaagtggtgttttcttgtacgatcgcctgggcctagggcctattttacccgagccaccaaactctactttggaggaaaaatgggtttcatggcttgaaggattcaaccctggttctgttgttttctgtgcatatggaagcgaaggctcgttaccggaaaatcagtttcaagagttgttgcttggtctggagcaagcaggttttccatttcttgcagcacttaagccacctaatgggtttgaatctattgaagaagctatgccaaaagggttcggagaaagggttcaaggaagagggattgtagatgaaggttgggtgccacaacaattgatcttaggacaccgttctgttgggtgtttcataacacactgtggagctgcttctgtgacagaggcacttgtgaataagtgtcagttagtgttcttacctaggttgggtgctgatcatattataaatgcaagaatgtttagtagaaagttgaaggttggcgtggaagtagagaaaggggaagaagatgggttgttcacaaaagaaagtgtatgcaaagctgtgaagactgtgatggaagatgagactgaggttggaagagaagttcctaggccaagatctgagatcttcaaagaacttccattagagcacaaggtcagatctccacggtggaggttacgatcttgcggaagaactcccaagatctcaactttttcaataaaaagtcatattttactagttaagaaggaaagattaacagaacagggattcagaagacgaagggtggcagcagtcgtcgacgatgtagtggcaaaaacaaaaggatctgaaaaggactgcggagaagagaaagaagaagacgatgagaagaaagagataaagtga

SEQ ID NO: 11659 - DNA, 744 bp, Glycine max
  Peptide Sequence Number=SeqID_103344
atggcagggtacaagggcgatgacgagtacgattacctcttcaagctggttctgatcggcgattctggtgtggggaagtccaacctgctttcgcgcttcaccaggaacgagttcaatttggagtccaagtccaccataggggttgagttcgccaccaagagcttgaacatcgatgctaaggtcatcaaggctcagatttgggacaccgctggccaggaaagggagcatttaatcttaccagcggagaagtttctctattgctgtgccagctattacatcaactcacttgaattgtgtttctgtattaggtaccgtgccattactagtgcttactaccgaggagctgttggtgccttacttgtctatgatgtcacacgccgtgctacatttgagaatgctgcaagatggttgaaagagttgagagatcacacagaccccaacattgtggtcatgcttattggaaataagtcggatcttcgacaccttgttgctgtcccaacagaagatggaaaatcttttgcggagaaggaatctctctacttcatggaaacttctgcattagaagcaaccaatgttgaaaatgcatttacagaggttctttctcagatataccgaatagtgagcaagagaactgttgaggccggcaagaatgccagttcttctgctgtcccatctaaaggacagacaataaatgtgaaagacgattcctccgttttgaagaaaattgggtgctgctcaaactag

SEQ ID NO: 11660 - DNA, 936 bp, Glycine max
  Peptide Sequence Number=SeqID_103345
atgaagttgcagcactataagagcttggaggatatggtgcatcaagccaagaaaatggagagtggtaaggagaagtgcaagaaggagggatcttcctcacctaagcaacaaggttcaaagtttccaagtggtaaacatgttcctaaccctagcaacaaggtcatactgcattacattgcccaaacaaagaaaaccaaagttttgagagacaatgagattgtcactatgcccaagatccaagagagtaaaacatttccatttaatattgatggtattttccttgtccttgtatttgattcgggaggatggatagataaagaggatttcaattcgaggacgaattctctcaaagtaggaggggatgatgtggatcaaacaaggaacatggacaatgaagcactacaatgctggaccgatttgcaatacaagaagcttgttcatgctcttgatgcttatgatgccaagaccttttggaaccagattgtgtggacggatactttgaaatcctccatctcattcaagtgttgcatctatgaagctcaaatgatacctcatgatactcagctccatgatgctcaaacaaagaagaaggttgaagaagaagaagcactcattgctgctactacaaaggaaatggttgcctcaaatcaagctgaagcatatgctacaactatggataataccactatatgtgggatcattattgatctcaccaatagtggtatcatggaagaaacacctaaggcatccaatctagccatagctaatgagggctattgctgcacccacacccaccatatgtctgtacccaaaacacttgaaccgttcccactaaccattgaccctaccccacagtccattcttccaacacctccgcttccttcttcttccccaccacctacccaacctccactaccaccgccagctcaagactaa

SEQ ID NO: 11661 - DNA, 547 bp, Glycine max
  Peptide Sequence Number=SeqID_103346
catcctctccaagcttcttatctaaggcacattcttggtggcgtagctccttcttcgatggcttattccctagtggatggtgccttccctctcctcttctccttcgtcttccgctgcatctccatggtgacaaaatcgccattgaaggacctcattgaagctcaaaatccagcctccatagaagttccacaagcaagcttccatcatgaagggttcacaaacatcccattgatgggaacaaggggttgtatcaattataatcccgtccttgccataagacaacttggctatcccatgagaggagcaccatcagaagaaagcacgtcaacgtggccacagccaaagcattggaacgggaaacgaagaggggccgaaaggaagaatgggagagtgatagattcattacacagagaagctatgatttggatggataggttcgctttcactttgaatggaagtcaagagcttcctagactactatccaaagccaaggcgatggcgaacgtgtactcgattcccgaggaagatcatgggctcctcaattatt

SEQ ID NO: 11662 - DNA, 108 bp, Glycine max
  Peptide Sequence Number=SeqID_103347
atgatcatggttaggactagaggcttaggtcgtgccttaggtagggttattggcagagctctgggaagagaggatcgtcatgattcagatgatgctctccagcggtga

SEQ ID NO: 11663 - DNA, 372 bp, Glycine max
  Peptide Sequence Number=SeqID_103348
atgtatcggttggaatcgtgcccacaagatgcccagtggactcaaagaagtccaacacggccttggggtttccagctctggttacgggcctctgtagtcctacagggtgcccgttcccccccggcaaggtcacgtcatcatgacataggaatcgtgcccacaagacacccagtggacctgaagaagtccaacagggccctggggtttccagctctagttacgggcctctgtagtcctacagggtgcccattccccccggcaaggtcacgtcatcatgacataggtaagatcgcgcctgcaagacacccagtggacccgaagaagtccaacagggtcttggagttgtcaagctctaattacgggtctctgtga

SEQ ID NO: 11664 - DNA, 336 bp, Glycine max
  Peptide Sequence Number=SeqID_103349
atggcgcctactaggcaccctctggacccagagaagtccaacagggccctggggtttccggctcttatcacgggcctctgccagtcctacggagttcttgtcaccccaacaaggcaggcgcagggtgacgcacatcaggatgcgggcacaccgccgccacctcggccggccgatttggctgggccactaggcgtggagcattatctacagcatttggttcgccagcaggtggccaaccactgtggacaggtgcagatacatgagtgtctctaccggttcagcctcagtcagcaggggcagagttccacccgttttgtatgccctaccccggagtag

SEQ ID NO: 11665 - DNA, 135 bp, Glycine max
  Peptide Sequence Number=SeqID_103350
atgatgctctcctacaacctaaggaaaggaaaaataaatcaaaatcctgtcacggctcctcctgtgctggtgcaggctcatcctgaagtgaggagggagcatcctaggctggctgagatgtctcctgagctgtag

SEQ ID NO: 11666 - DNA, 321 bp, Glycine max
  Peptide Sequence Number=SeqID_103351
atggttgatcgagaaggaggtggaaataaaccaccaagaaggactcttgatgaatatgcttaccaacaagaaccaaagtattacaataacatagtcattcatcctttcagtaataaggttgtggagttaaaaccaacattgcttagtctgattagtacacatccttttgctggaatggatgatgaagatccatacacacaattgtttaccttcatggaactatgtggcaaagacatggctctaatcacatccaaacaaaagtctcaacacttgggaagaagtggaggaaaaattcattgcaaggttctttcctacatctag

SEQ ID NO: 11667 - DNA, 354 bp, Glycine max
  Peptide Sequence Number=SeqID_103352
atgaacaccaccgatgtcgcatcacctgaaaaagccacgcttcacctgttatgtggaaaaattgcgtcgggtaaatctacgttatccgcaaaattaggcgctgcaccgcgcacgatcattatcagtgaggatcgctggcttgcagcgctctatgccgatgaaatgcacacggtcgcggattacgtgcagtattcctctaagctcagaaatggcatgaaaccgcatctggtgtcattacttaacgcggggatgtcagtagtgctggattttccggctaatacacccgccagtcgtgaatggatgatgagtatcattaaagcatcaggggctgataaccacctgcacttccttaac

SEQ ID NO: 11668 - DNA, 1011 bp, Glycine max
  Peptide Sequence Number=SeqID_103353
atgacagccggtatgactatgccgatgagtacctgcaggtggtctataaactgctggaaggcagctgggaggcaggatgcggtgctgcgcgatcgtcagcgtcgcattttcagcgatcccggcaaaatccatccgattaaccatcagggtacgttctttaacgtaccgggcatccatctgtgtgaaccctcgccgcagcgcacgccggtgctatatcaggccggtgcatcgagccgcggcaaacagtttgccgctgagcacgcagaatgtgtgtttgtcgccgcgccgtccaaagtgctgttaaagaaaaccgtggccgacatccggcgtcgtgcagccgaagccggtcgcgatccgcgcagtattttgatcttcaacctgcagacggtgattgtcggtgaaaccgatcgggcggcacaggcgaagtggcaggagtataaaaactgggtcagctacgaaggcgcgctggcgctggtctccggctggaccggcatcgactttggacaatatcagccggaccaggtgctgaaatacctgcacaccaacgccattcagtcagcggttgaaactttctctactgccgatcccgatcgtcaatggacggtgaaagcgctggccgactgggtgggcatcggcggttttggcccgctgctggtgggcagtgcggcaacggtggcggatgagttgcagagctgggtagaggagaccgacgtggatggtttcaacctggcgtatgcgctgacccatgaaacctttgaggatgtggtcgagctgctgattccggagctgcaaaaacgcggcgtttacaaacaggattacgccgcgggcacgctacgcgaaaagctgtttgccgccggaccgcagctcagcgcgccgcatccgggtgctggctatcgtgtgccggaagccagcatcaccgccgtggtcggaccgagcggtgccggaaaatctaacgctggcgaaatgcatcagcctgctggagcagccgagcggtggcagcatccgggttaa

SEQ ID NO: 11669 - DNA, 462 bp, Glycine max
  Peptide Sequence Number=SeqID_103354
atggcacctactaggcaccctttggacccagataagtccaacagggccctgggatttccagcactgatcataggactctgccagtcgttcggagtccccgttgcacctaccaaggccgcgggcgcgccaccaccacctcatcaggctggctcggctgggtcatttgacatggagcagtatttacggcatttggttcgccagcaggcggccaaccaccgggcacatgtacagacccatgattgtttgtaccagatgagcctcagcatgcagagccagggcttcgcttctttttcatgccctactccagaccagttcagggcagaggtcgcatggcccggggattggcccgaggcccaagcaagagaggcgcccccagaggctcccggcgatggagagcaggcccatgaggatgaggagatggtcgatttgcttgacttcttgggagggagtggagctacatga

SEQ ID NO: 11670 - DNA, 180 bp, Glycine max
  Peptide Sequence Number=SeqID_103355
atgggacaggtgggttctatggctgatttaggggtggcctttgtcaatgattgggtgtttgttcattttcccatatggttcctttttctccaattttcaacaattatattcaagggaaatgaaacaccggaaagcgcatcgggtcatcaacctaaaatactaaacatgaatccctcataa

SEQ ID NO: 11671 - DNA, 177 bp, Glycine max
  Peptide Sequence Number=SeqID_103356
atggagcatgaaacattccttgcaacttggttggcagagattgatttctctcccaatggcttgccttggttgatcaaccatgaaaaacctatgctacgtaggtggcacaagcttaatcccttgaaaattgagggtaggagatttgccctagattcagctagggactactttccttag

SEQ ID NO: 11672 - DNA, 381 bp, Glycine max
  Peptide Sequence Number=SeqID_103357
atgtattacatgccacaaacatttgctcagtatccgacacagatgtatcagtattcttttcagggtcatcacactgatacttctgcaagcgagcattcgttcggtggtgttgcggacacacatccttatttttcatggccgactatgaccccttcacagcaatatcatggtcaaattccaacacctaatgccccattaggtacacaatggaatgtgttgatttgcgtcacgaattttctgttgaggctgacgaagaagaagcggggagacatcggggcagaagaaatccttatcgccaagcacgaagatgggatagaccatgtggcacatcctcacggcatcacggacaccaaaatgaatgatttgcatgtctctctttaa

SEQ ID NO: 11673 - DNA, 322 bp, Glycine max
  Peptide Sequence Number=SeqID_103358
ggggatgacttagaatctttaattatccacggtcagtgcattgatggtgcccatgtttcatacgctgtcgcaacgtgcccttttgcaggcgagcgaaggcgaggctcaagggtgcgctttccaaaggaggaaagatgcgcggagtcgccaccaacgtttatttgtggaaaacgtcaggaaaaccgaaggaaactggtcaaaatgaaaattctaagttcgggagttgtatttacgtttgaggaaggtattagcacctctcacgtcgacaaaagcggggcttttgctcctacgtaccctctatcgaagaggaaatcagacctac

SEQ ID NO: 11674 - DNA, 586 bp, Glycine max
  Peptide Sequence Number=SeqID_103359
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgttgctacgagttctgatgccaagccgccatgatgtcctaatgaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11675 - DNA, 417 bp, Glycine max
  Peptide Sequence Number=SeqID_103360
atggctaaaccaagcagccccgcaaacttggcatcagccatcatttgtttctttgcctcaaagaagttcccccatagactaaaagcatcaccgggaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggtttacgcgcagcgtgaccgctacacttgccagcgctga

SEQ ID NO: 11676 - DNA, 198 bp, Glycine max
  Peptide Sequence Number=SeqID_103361
atgcaatttgggatgtgtcgcaaccgacccatcggcgggagggcgacgcgagggctcatgggtgcatcttccatgggaggaaaatgcgcggagtcgccaccaacgtttattcgaggaaaacgtcggaaaaaccggaaagggtgtttcccttgctcctacgtattcctcaattgtgataaggaaatcagacctacgtag

SEQ ID NO: 11677 - DNA, 606 bp, Glycine max
  Peptide Sequence Number=SeqID_103362
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccggtaaggtttacaaaggggaaattgatggtggaacaaccaaggtagcaattaaacgtgggaatccactatctgagcagggggtgcatgagttccaaactgagattgaaatgctctcaaaacttcgtcaccgccaccttgtttcactgattggctactgtgaagaaaacactgaaatgatccttgtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 11678 - DNA, 438 bp, Glycine max
  Peptide Sequence Number=SeqID_103363
atgcctcctgaagacctacaacagctgacccaaaaaattagggaccaactgcaggagtcgatcacagaaaaagtgactcagcagctgatggcatccttcagccagatacagtcccaactccaaccacagatgcaatcacagggacttgcactgcctccggagcctgaggttggtcccttaggtgctcgggggggcacaaaggagagttgtgttgatccctcagggaatgatccagagacgagtaacttagacaaatgcgggttgtacattgaagaaaatctttcccgcttggttgccttaggaagactttatgagggatccatagcggttcacaacatttctttgttgcatggacaagtcaaggttggtgtggagatgattaaagatgcagaggctcccatttcggtacccactgacgaggttaccttagtggggtag

SEQ ID NO: 11679 - DNA, 537 bp, Glycine max
  Peptide Sequence Number=SeqID_103364
atgtattacattctctattgtgtgttgcttccgcgttctactaaccttgctcaatcctttgaggaatatttaattttgatgtgggcactacaaactggacaccaaattgactgggcacatcttgtttgttaccgtatgcataaggcattatggacaaatgcccctctaccatatctccatttggttactctgtttatgaagcacttaaaagtccttcttactaatgaaccatttgtcaaggttaagcattcatttgcaataggagccactacagttgcttcttttggttataagaaagatcttgatggacaatgggttcgcaaacaagattaccaggcaaatgctcctgacgaacgcactccatctccaccacctagggatccctcctctgctttattgaatgacattctcaacaagatttgggatctttgcgcttttgttggcgaaaggtttgattccatgaattctcatatcactcgtcttgacgatgacatgggatttatccgtcattgctttgatcctccaaccgatccttag

SEQ ID NO: 11680 - DNA, 309 bp, Glycine max
  Peptide Sequence Number=SeqID_103365
atggatgagatcaactttgttggagaaagcaataattcatataatcgataccctaaaaattacaatcaaggacaaggctttaggcataatcaaaatcaagggatgtataggcctccacccatgcataataagaggcatagacaagaagagagacattccaccttacaagaaatcgtgcttcaacaatcgagcacccttccttcacaccctgagccaaatcctaaaaaggaagaagtgagtgttatgagtaccaggagtggacgacctatgacagagttgaagaagaaagagaaagtcactccaccataa

SEQ ID NO: 11681 - DNA, 510 bp, Glycine max
  Peptide Sequence Number=SeqID_103366
atggctggaatgcttcctggagttgaatgtgctagaaggagaaggtttcgtcgatgttcggattcaaattcaacttctttgggatcacatgcatccacaaggcgttcttctttctgtttgtatgctagtaaccatgatcaatgtcgccttttctcatcctcttccctgcaaagaagcatgttataccaggcacaccctgatgagaatatgggaggagtggccagagaagccaaacagagattggatgacaagttcagagctcaaaggatgtcagaaaacaaaaggttcaagttgtatctgtctaaggcaaaacaacacaaaatgtgtggagggcaaaagaacaagcataatagtgttgcacacagaggaatatgggtcaaagaaaagtggttcaaggaggttcagttggaccaaatggagctggaaagcatcagaacaagaggaatgtgctgtgtgcttggaatcattcagagttggagagacactgatccatcttccttgtgcccatag

SEQ ID NO: 11682 - DNA, 330 bp, Glycine max
  Peptide Sequence Number=SeqID_103367
atggatggcattaatatgaaggatggagtaacaagaaacagcctgtttcatcagttgagctttgctaacaagaaaccattctcatcaaacacgcatccaaacctaacaagtcaaggaactggtcccactatatctgatggttgtgattcttcatctagtaagtcagcaggtttgctagaatcatcatacacgcagcctgttaagccaacttctaaggcaaaagttgaaaatactgttgaagaagttaacttaaaacctagaattgggtcaagatctcatagtaatccaaaggagagaacatcacaggcagataagcaggccaaaaaatga

SEQ ID NO: 11683 - DNA, 103 bp, Glycine max
  Peptide Sequence Number=SeqID_103368
atgtgggaatggcataggcttaaaggagcactcaaaccgggtgtatttatctccaaggcctacactccgaagagtccatcagggtctctccctcctgattcag

SEQ ID NO: 11684 - DNA, 261 bp, Glycine max
  Peptide Sequence Number=SeqID_103369
atggaagtgagctcagaattgatttatttggggtgcaaaggaggtactgtggaaatttgggataagaagaaacacaaaagagtcgacacgttgcaaatgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11685 - DNA, 237 bp, Glycine max
  Peptide Sequence Number=SeqID_103370
atgtggtgtctccaatcatctttcatccatctctattccgctgccattgatcttcaagaagcaaaggactccattgatgaagcagatccaaggcctacaagctccacatggagctacgtcactactacttcacctttctctagtgaaagtgaagaagcaaaatgggaagaatatagagaagaaatgtacccccaagaagaaggacaacctttaatggttaaggagaagtctaaggag

SEQ ID NO: 11686 - DNA, 423 bp, Glycine max
  Peptide Sequence Number=SeqID_103371
ggatcgcgcccacaagacgcccagtgggcccgaagaagtccaacagggccctggggtttccagctctggttaccggcttttgtcagtcctacagggtgcccgttcccccagcaaggaatcgcacccacaaagacacccagtggacccggagaagtccaacagggccctggggtttccagctctgggatcatgcctgcaagacacccagtggacccgaagaagtccaataggctctacggagtacctgtcacctccagcaagggcatcaggccccctactaatcgagctttcatcaagaagtactgtgcccccaggcaggcacagggcgaaacaccacagcagcctggggatggccagcagcgggcaacagacgcaccaccatcacttctagagttcacctcagctcatccacaaaaaggttag

SEQ ID NO: 11687 - DNA, 237 bp, Glycine max
  Peptide Sequence Number=SeqID_103372
atggcttctccacctcgctcgcctcctcctctttctcctcctcctccttcagatgcatcagcttctccgtctgccgtgaaactacctggtgctgagagactagtggtccatattgatcctactaccggcaaggccgacagtccctacaggaagaaattaagaacatatctaggggttatggcgcatgataaggtggacgtcacgtacaagaactggaaggaggtccacactgcttag

SEQ ID NO: 11688 - DNA, 258 bp, Glycine max
  Peptide Sequence Number=SeqID_103373
atgcaggggcatgaaaatgccaccgctgagaatgggccatggataattacattagatgctcctagttttattgctgttatgcaacatgctcgcaaccgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11689 - DNA, 618 bp, Glycine max
  Peptide Sequence Number=SeqID_103374
atgacatctgactctgcacaggaaattgcagataaaatagactccttagaagagcaggtaacgcagggttcgtttgtaccccatggtcggcaagacatactgaacactgccattggacgacctgaccatgggggtcgcgttcgggcagcaggctcaggtgtcactattactcagtactacggaagggcatcaaggacatgcagcagctcgtccacgtccatcagccaacaacaactagatgaagttgttgcaaggcttagggaagacatgactggccagattagggaagaattgaggagtcaaattaaggaagaattgaggactcagctagaagaggaaaataaaaggaccttggaaataatgaccaatgcattgaaagaggctattaaaaaagagttgtcaaataaaggatcccaagaggcactccaaattcagccggacatacaacaactaggtgcgcgtgtcagcacacagggaagtaatgctgttaccaatgcgcaggcttcacaagaacaggatgctgatgccataccattgatgggactgtttgtgcagcgtaacgatggtacacaaagctgtaattgttgggtttggtttgtgttttgttcatggttttag

SEQ ID NO: 11690 - DNA, 624 bp, Glycine max
  Peptide Sequence Number=SeqID_103375
atgccgggagcagacaagcccgtcagggcgcgtcagcgggtgttggcgggtgtcggggctggcttaaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccacatttgagcagcaactcttcagtaacaagtagttatcaggctataggggttccaggtggagcagctagtaactcacattcttatgcttctggtccaaatactggtggtccttcaattgggcctcccccagtaattgcaaacaaagctcctgctcctcagcctgccaccaacgaagtctacttggtttgggatgatgaggcaatgtccatggtgagttgtgttcttgagaaaatatgtagtggggtaccgagctcgaattcgtaa

SEQ ID NO: 11691 - DNA, 375 bp, Glycine max
  Peptide Sequence Number=SeqID_103376
atggttaacgttaatcctaccactaggagaggatcaggcccccagaaagaaaagttccatagttatttgggggttgtagcgcgtgaaaaaattcttattatccactccaattggaatgatgtacaagaatctttaaagaacctagtttgggatgacattttgggaaaatttgacatccctgaaggtaacaagggtaaaaagaaggtgatgtcaacaatcgctactagatggatgcaatttaagtcatccctaacgacaaaatatgtttatgctaacaatgacgatcatcaaaaagatgatccttctgttaagtatggtattgatgcaacaacatgggcagaatttgcaaaaacctgcgaaacccttacctggcag

SEQ ID NO: 11692 - DNA, 438 bp, Glycine max
  Peptide Sequence Number=SeqID_103377
atgtgggccatcatccatgagtgcaaagagaagctaaatctagcggcgactcacgagcaaaggatagaagatgagtacgccaagatatcaacagaaagggaagcaagggaaagggtaattgattcattgcaccaagaggcaaccatgtggatggaccgatttgctcttactttgaacaggagtcaagaacttccccgattgctagccaaggccaaagcaatggcggacacctactccgcccccgaggagatccacagacttctcagctattgtcagcatatgatagacttaatggactatatgattagtgatccacgatgtcggatacaatgtcctgacatcctgcccgagaatactggagttgctgtacaatgcaagttaaaagtcaagtgcagaagtgaagctgcaggatccacgatgtcggatacaatgtcctga

SEQ ID NO: 11693 - DNA, 108 bp, Glycine max
  Peptide Sequence Number=SeqID_103378
atgcgaaatttattacttggattttctgatgtgaacctgagtaggagtggatcgtttgatacaggctacggaggtttggatgacgccacttccggtgaaggaagataa

SEQ ID NO: 11694 - DNA, 276 bp, Glycine max
  Peptide Sequence Number=SeqID_103379
atggccttgaaacacaaggtccagagtttgatagaagttggatggttgacgtttcaagaggacaggcccagtataaaaacaaacccgctcgctaatcatggaggggcagccgttaatgccatcgaggatttttgcttaatgcgttcgggcatgccgcaagacatagaaacatgtttagcggtaggagaactattacaacaaatgatagaccaaggctggcttgaggaacactgctccccaaaggccccgacacccctcggcggtatcgggcgttag

SEQ ID NO: 11695 - DNA, 647 bp, Glycine max
  Peptide Sequence Number=SeqID_103380
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcaatagagaagaaaaatgtgacggagaagagtgagatatatggattcggagtggtgctgattgaattattgacgggaaggagcgcaatggacatagaagctggcaatggcatgcataaaaccattgtggagtgggcccgctattgctactccgattgtcatcttgatgtgtggatagatcctgtgctgaagggtgtagatgcattgagctatcagaacgacatcgttgagatgatgaatggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 11696 - DNA, 963 bp, Glycine max
  Peptide Sequence Number=SeqID_103381
atgaaagccctcgtcctcaccgcctttggcggcccgcaatccttcgaactgcgcgacgtccccaaacccgtgccgcaagcgggccaggtcctggtccgcgtccacgccacttccatcaacccgctggactaccaggtccgccggggcgactaccccgatctggtcgccctgcccgtcatcaccggccacgacgtctccggcgtggtcgaagccgtcgggcccggcgtgagcgccttcgtgccgggcgatgaagtctggtacaccccgcagatcttcgacggccccggcagctacgccgaataccacgtggccgccgaaagcatcgtgggcaggaagcccgcctcgctgagccatctggaagcggccagcctgacgctggtcggcggcaccgcgtgggaagcgctggtcgtgcgcgccggcttgcgtgtgggagagagcatcctggtgcacggcggcgccggcggcgtcggccacgtcgccatccagctcgcgaaagccgtcggcgccagggtgttcacgaccgtgcgcgacagcaatgtcgacttcgcgcgcagcctgggcgcggacgtcgccatcgactacgagaaggaagattatgtcgaggccatcctgcgcgagaccggcgggcgcggcgtcgacgtggtgttcgacaccatcggcggcaacacgctggcgcgcagccccgacgcgctggcgcaattgggccgcgtggtgagcatcgtggatatcgcgcagccgcagaacctgatccaggcgtggggcaagaacgccagctaccacttcgttttcacgcggcagaaccgcgggaagctggacgagttgagcgcgttggtggcgcgtgggcaactacggccgcacgtgggcgcggtgtatccgcttgccgatattccggcggcgcatgcgcggttggagagtgcgaacaacgggctgcggggaaagatcgcgatcgcggtggccgattga

SEQ ID NO: 11697 - DNA, 663 bp, Glycine max
  Peptide Sequence Number=SeqID_103382
atgcggccgaagttgcctggctggccagcgcggcgcggattgcgccgcttgttcgcccaccagcacgcgaaagcacagctcccgcacgattgccggcccgagcaccctggcttcgagcggcgaggccagcgcccgcagcagtcgcaaagtggtatcggccagcgtgggatcgagcggggtggacgtgatgccggtgggggcgggcgcggccggcccgtcgtggccgtcaagcgacagcaccaggtcggccagggtggtcggatcgagccgcaactggatcgccagcaggggttcctcgggcgtggcgtcggtctcggtggagaagggcagcggcacggacagcaccaggtaatgctgcgcgtcgtaacgatagaccttgtcggccaggtagccgcgcttgctgccctggcacacgatgacgatgctgggttcgtacagcaccggcgtacggccgagcggctggttggcgcgcatgaagcgcacgccgtccaggcgcgacagggtgtagccctcgtgcggcgcgagccggtcgagcagggcggtcatctggtcatggagggcttgcggtgccgtcattgcgctatcgcttggataagagtcttaggcatcattttgctcctgattcgtcaaagaatatggcgtccgagtaggaataggcaatga

SEQ ID NO: 11698 - DNA, 477 bp, Glycine max
  Peptide Sequence Number=SeqID_103383
atgtcctcagctaatgaccctacaattaatagagaaggattttctgatcttggtgatcagctcatgcagtgtagtcactgtaatgcaaatatgtggtatgttgaaagagtctcaaaagataaaagaactacaaatccaagattcagtttatgttgtggaaatggcaaggttgaacttccattgttacagaatccacctaaatatctctaccaacttttgtatgatcatggtacacctgatagtaaaaattaccagcagaacataaggacaaataacatgatgtttgcctttacttctgctggtattaagtttgacaaatcagttaatcattcaagaggacctcttataataagaattcaaggtcaaccatgtcatagaataggtagtatgttaccgatgcctgggaaagaaccaaatttgcacaattgtatatctttgacacagaaaatgaagtgcagaataggattaatgcaataa

SEQ ID NO: 11699 - DNA, 270 bp, Glycine max
  Peptide Sequence Number=SeqID_103384
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggggtatggtttgtgcattgccatgtggaagatcatgtgccatggggactagacatggcttttgaggttgagaatggaccaacttcttcaacttcactccctccaccacctgttgatctgcctaaatgttaa

SEQ ID NO: 11700 - DNA, 498 bp, Glycine max
  Peptide Sequence Number=SeqID_103385
ggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtacccacagtgatgcactccctagagttattgttagcgacaaagatctaacattgatgaatgcgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11701 - DNA, 435 bp, Glycine max
  Peptide Sequence Number=SeqID_103386
atgaagcatttcactgacaccctcatcagtgccaaacataataaattgttccaaagaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11702 - DNA, 764 bp, Glycine max
  Peptide Sequence Number=SeqID_103387
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctgcttgtccttgcgacattatgagaaatctgaaaagggatggttttctcgcgaaggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11703 - DNA, 420 bp, Glycine max
  Peptide Sequence Number=SeqID_103388
atggggtttgagctgtactacaaagaagagatgcctacaaggaagatgaaggtggaaattatcatgtggatggactctcaaaaagcctccacctctggctattatggaagtgataatgttgttcaccgcgacattgttctgatgttacgtcctgctaggaaatatctctttgatgatgcatacattagctttaccaaagatgatgacagggacttacaacttgaagaagatgatagaagcctagatgctactgccactatccaagatgaagaatatgctaaagctgtgggtgacaccattgtgcatggggtcatcattgatcttacaaccactagcatcatggacgagactggtgaagcgtccaatgcaactatggctgatgaagttgatttacatattcaagatcctgcgtccaagtag

SEQ ID NO: 11704 - DNA, 363 bp, Glycine max
  Peptide Sequence Number=SeqID_103389
atgaaggacatgcacaaagtgcgactatatgatgtggcaatggggtgtgcccatgggcccgaaatctaccctaaggctcatgagaaccctagggccttctcttgcatctttggccaaatcttcttggagtcttctatccaatgcccttggggggtaggattgcatctgtggaggttgaggctaatggtaactaagaaggttttgagggagaacgggatgttgtcgatgaagtggttgtgggatatgttgagggtgccaacgagggtggggaggagactgagcacacataaagtgagtattcatctctttattctataccaacaaccaaggtcaggattcgtacctactcaaccaacattatag

SEQ ID NO: 11705 - DNA, 567 bp, Glycine max
  Peptide Sequence Number=SeqID_103390
atgggctcaaaaatctaccctgaggttcatgagaaccctagggctttagcagctctggcccaatcttctgggaatcttctatccaatgcccttgggggaaaacacaccaagctcatcaagttcaacgatttaggagatgtgatttttgtggtggtgactatcagaatggtcattattcagtacctggtgattgccaacaagaagaagagccccattacttgtagaatcaaggtagacctcagcaaaactttcaaggaaattatcaaggctacacaggtggcccaggttcagatcagccttatggctggaggaagcaaaataacaattcatattctggtcccactaacccttcttttgcaggtccttctaacaactcttatggaggtccttcaaataggggtccacaacaacaacaacaatgatagaggtgcaaccagcccgtctaatgatcctttacatggaattggaggtcctatgacaaggtccaagactaagaggatgaagcaagcattgcaaggtccttcaatctggtttctattggcctacattgtggaaggacgcttatga

SEQ ID NO: 11706 - DNA, 623 bp, Glycine max
  Peptide Sequence Number=SeqID_103391
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11707 - DNA, 102 bp, Glycine max
  Peptide Sequence Number=SeqID_103392
gttccttgctacaaggtcatgacgaaagacaacgattgtacctcaaagccttacactggggcaatgaaaggcaccatgcaaaaaaacctcaagcgcacctag

SEQ ID NO: 11708 - DNA, 120 bp, Glycine max
  Peptide Sequence Number=SeqID_103393
atgagggaggagcttgccacccagctcgcccagatgaatggcagcggaatggagaaggaagagagagaggagacgccacttcaaggagaagatgagtctagaagaagctcaccaccatag

SEQ ID NO: 11709 - DNA, 327 bp, Glycine max
  Peptide Sequence Number=SeqID_103394
atggaagcatgtttagcagtagaggacctgttgcaacagatgatggaccaaggccggctggaagtcggcaatgagggaggtgaagagcaacacatatgtatgcagtcaacaaatgaagaaggtcttaggaagcccaagcctttggtggtatatttcaccagagatgcggctccccaaacgccccaatacccctcggtagttaaacctcttccgtttctataccaaaacagccacgcagttccgtggaggtatgcgcctccaagcaaaaggaaggaagaagccaccgacatcagctcgttgtcggccaaggtaactgttagtgcttag

SEQ ID NO: 11710 - DNA, 354 bp, Glycine max
  Peptide Sequence Number=SeqID_103395
atggatctcattgaaaatatggctacaagcgacattgctattttgagagatggagctcacattcctaccaacaagagatgtaccatctgtgggggagctcatgaatctggatgttgtattcctattgaagaacaccccacttgtgaagttacatgggaaatcagcccagaaacaattttaatgcaggaggattttctggattccaacattgccagcaatataatcaacaacagggacaatggaggaaccaccctggaaatcagttcaatagagattaaggtggacaatccacaaggccacaacaacaagggcctagtctctatgatcgcacaacaaagttggaagagactctag

SEQ ID NO: 11711 - DNA, 387 bp, Glycine max
  Peptide Sequence Number=SeqID_103396
atgactgcccttgagcttcctgtgagtgattgggaggacaaatggattgatgtgtacttcgacataagttcaaagttgctagacattttcaatgcatttagctatgagctttcacgtctgaaccagggaaaccttcctcttaagaagatgaagacaatctctggacattgtgttccggtaaaagacatatcagtttcgaaagcagttaaaattctcacaaagtttgtctctgctgacaatggtacttctcatgtcatcaatgcatatctccaccgagcttttgcatctttcaacgagcttaagcagctccacaaggagcttggatcatctcactctcataagaagcacaaaaggcacaaaacagagaatggtaacgacggtgggaag

SEQ ID NO: 11712 - DNA, 483 bp, Glycine max
  Peptide Sequence Number=SeqID_103397
atgaccatgattacgccaagctcgaaattaaccctcactaaagggaacaaaagctggtaccgggccccccctcgaggtcgacgaagacagccaaatgccctgctgggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11713 - DNA, 558 bp, Glycine max
  Peptide Sequence Number=SeqID_103398
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcaaggaggaggaagtggttatggaagtgggccatatcctcctcaagggcggggtgcaccttatgggtcaagtggtatgcccggtgggcccagtggtggtcctcgtggtgggggtggaagcggctatggagttggagctccaaattatcctatcaagcttatcgataccgtcgacctcgagggggggcccggtaccagcttttgttccctttag

SEQ ID NO: 11714 - DNA, 525 bp, Glycine max
  Peptide Sequence Number=SeqID_103399
atggctcgcgtacgccatgcgctggtgttgtttggcggcattgtgccgcgaaaagccaccgtacagttgcgtgaatcgctcaccgaggccgaagcggcgctggacggtgcggagaaagccgaagcggcgttgttcaaccgcgccacggttggcgccaaactgctgctgaccgaatggctggttacccgcggttggcgttcgttcctcaacgaggcggggcaaaagaaaatcgccggttcgttcaagcgctttgccgatatccagctgtcgcgagcggcggcggagctgaaaagcaacttccagcagacgcaggacgactacagcgatcggctcacgcgtctggcgcgtgagatcgacagcattcaattgctttccagcgcctatgccggggtagccgaggcctggctggaaaactggcaagaggtgcgccgcgctatcgagaacaatgaccgcagcgtcatcgaatatttccgtcgtcaggcgctggccgcggaaccattctggctgcatagtggaaaacgataa

SEQ ID NO: 11715 - DNA, 845 bp, Glycine max
  Peptide Sequence Number=SeqID_103400
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatatcatcgtcggcaagaagcccacgggcacgctgctgatcgactacctgctgcccggcaagaacctgtacctgatcggcactggcaccggcctggcgccctggctggccgtggcgcgcgaccccgagacctacgagaagttcgacaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11716 - DNA, 874 bp, Glycine max
  Peptide Sequence Number=SeqID_103401
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggatttaacactcagttcacagaatttggaaagagaaaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 11717 - DNA, 234 bp, Glycine max
  Peptide Sequence Number=SeqID_103402
atggacaaactgaacgcagcagtaacacagaccttgacattgtatattgagattcaacaatgcaaggttaggagtatgacaaacatatgctcaagaggccaaaaagctgctcgaacgaaaaactacagtggtgcagaacttgaaggtgttgtgaaaagtgctgtctcatatgctttaaatagacaaatgattttttggggggctcaccaaccccccggaggaagagaacattaa

SEQ ID NO: 11718 - DNA, 342 bp, Glycine max
  Peptide Sequence Number=SeqID_103403
tctccatggaaccaattgcctccctcgtccagtattatgatcagccgttgaggtgcttcatctttggggacttccagctatcaccaatggtggaagaatttgaagagatcctaggatgtcctctagggggaaaccatacctcttctcagggaattagaccgccaaaggcaagtcgaaaatggggtggtcggaataccgagaaaatatttggagtcctctttccaaatgtggatgggttggtggacctggcagcgatcgacgtttttctcgcctatcataaccacaaggaaagtccggttgtcgctatgctagccgacctatatgacaccttcgaccgaagat

SEQ ID NO: 11719 - DNA, 872 bp, Glycine max
  Peptide Sequence Number=SeqID_103404
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatcatttttgaggccaaaagccatcaccggcacatccaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11720 - DNA, 258 bp, Glycine max
  Peptide Sequence Number=SeqID_103405
atggccaaaatacaatgcccaaaagaaggaaaaacctattctaatatttacaaagataagcgggctcatactttgcccatgggctcaaaatctaccctaaggctcgtgagaaacctagggccttcccttggatctctggcccaatctacttggagtcttctatccaatgcccttgcggggcttactttcaactttcctatgtatgttaaactcactaggcttgtttaccacagttttaggagttcaacatacacttag

SEQ ID NO: 11721 - DNA, 383 bp, Glycine max
  Peptide Sequence Number=SeqID_103406
atgttagcgggtattggaatcggcgtagcagcagcgttgggcgtggccgccgtcgccagcatggatgtgtttgatcgtggcccgcagtatgctcaggtgctttcggcaaccccaattaaagagagcatcaagcaaccgcgtcaggagtgccgcaacgttaccctcacgcaccgtcgtccggtgcaggatgagaaccgcatcgccggttccgtactgggtgccgtggccggtggggtgattggtcaccagttcggcggtggccgcggccgggatatcgcgaccgtagccggtgcgctggcaggcggctacggcggtaaccaggtgcagggtgcgctgcaggatcgtgacacttacaccaccagcgagcagcgctgcaaaaccgt

SEQ ID NO: 11722 - DNA, 147 bp, Glycine max
  Peptide Sequence Number=SeqID_103407
atgcttgggttgtgggtgtgggtgtttgacgcagtgcttgtggttgtgtgggtgtgggtgtttgacgcggtgcttgtggttgtgtgggtgtgggtgtttgacgcggtgcttgtggttggtggtgtttggtgtgggcttgggcgctag

SEQ ID NO: 11723 - DNA, 480 bp, Glycine max
  Peptide Sequence Number=SeqID_103408
atggataaagccaggttggtttatggcttggtaacccacatggatatgaacattagcgccctgatctcaggtcaaatctattatattgctcagagtaactcctttaggctcggatttccagtcttgatcactgccctctgtagagctagaggagttacctctgacagactgacttatgagagcctaagcctggccattaacatggcctacattaagaaaaactgttggaatgtggatgatatgacagttaacttcagaggggcaatgaaggcaagggctcagctagctgatgttccttctttttctactccaccagctccttccacttctgttactcctacaccagctcctccaggcccatcttcccaggactttcagcactttgagttcatgcttcagagtctttatcaaagacagatattattaatgttgagcatgcaggttgtggctccaccaggaactatcttgacaattgagtag

SEQ ID NO: 11724 - DNA, 48 bp, Glycine max
  Peptide Sequence Number=SeqID_103409
ggtgaatgctgtgagattttcccagacgcccgaaatggactcggatga

SEQ ID NO: 11725 - DNA, 459 bp, Glycine max
  Peptide Sequence Number=SeqID_103410
atgttgggattcacaagcgattctcctcaaatttcagccaacccgcatcaattagactttgcacctcacgcttcgaggtcatacagtgctcaatggaatgccccagggcttctcgatgacaagcacacgttgcgttcgagtcgtatcctcggaaaaatggaggttaaggaaccttggttggagttatggctaccattgatttatcgagtagatatgggagcaagccatcataggacactagaattagggaaacttggtcgtataggaatggcagtcgcagcatgggtgtcacaacatgctcttttgcgggcgagcgaggcgaggctcacgggtgcgctttccaaaggaggaaaggtgtgcggagtcgccaccaacgtttatttgtggaaaacgtcagaaaaactgaaggaaaccggtcaaaacaaaaattctaagttcgggagttgtatttacgtttga

SEQ ID NO: 11726 - DNA, 156 bp, Glycine max
  Peptide Sequence Number=SeqID_103411
atggagatggcagtggaaggcaaaggagaagaggagagggggaggccagcaattcaatcaccaaaactcaaattcacaatagacacaatcataaggaaacctaaaagttcaagaaaagccacaaaaaataacaagacaaaactcaaaggaacctaa

SEQ ID NO: 11727 - DNA, 790 bp, Glycine max
  Peptide Sequence Number=SeqID_103412
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaagacagaattggtgggaatcgagtaactgaggctgaatacaaggacctgcaagatatgattattagagttgggctatttgaagtggaatccaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11728 - DNA, 821 bp, Glycine max
  Peptide Sequence Number=SeqID_103413
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagcgaatgctgctgctgctcttgttgctgttgttgttgttgttgttgtcgtcgttgctgttgtcgttgtcgtatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11729 - DNA, 600 bp, Glycine max
  Peptide Sequence Number=SeqID_103414
atggaaaaacggctttgccgcggccctctcacttccctgttaagtatcttcctggcatcttccaggaaatctccgcccgttcgtaagccatttccgctcgccgcagtcgaacgaccgagcgtagcgagtcacgcccaatacgcaaaccgcctctccccgcgcgttggccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11730 - DNA, 213 bp, Glycine max
  Peptide Sequence Number=SeqID_103415
atgcactcccaccatctccaaagccccctagttcatctacaaatgctggagcgttgcctacgacccgtggtcgaccagcaggcgaccaagtccaaagccaaagatatcaagggcacaccggagaccggcttacaaatcccaggttttcataaacaaagaaaccaaagcggtggcagagccgcatggatcggtaaagagagagaagagggataa

SEQ ID NO: 11731 - DNA, 275 bp, Glycine max
  Peptide Sequence Number=SeqID_103416
tcaacatgttgaaattgctggatgagtacaatgtccatgcaaaaagttttagaatggtcagggacagattgacagatagtcaagtcgataatgtaaaattgagattgatagctgcacgtgagaaaaatggtcgtacatacaatctcccaaatgtttctgaagttgatgctttgattgttggcgattttgatccagactcaagaagggatattattgtagaaactcaaaatggagaattacaaagaatccatgaattacactctagttatctatga

SEQ ID NO: 11732 - DNA, 180 bp, Glycine max
  Peptide Sequence Number=SeqID_103417
gagtatggagttagcaacacctttaacattactgatttggttcctgttgcaggtgtagttgatttagatgatgaggggtttgtagatttgaggacaaatcctcttcaagagggagggatgatgcaatcctcccaaggaggggacccatcaccagagccatggctaggagactccaataag

SEQ ID NO: 11733 - DNA, 138 bp, Glycine max
  Peptide Sequence Number=SeqID_103418
atgattaattggtacgacctcgatcacccttctacaccagtcctgggattgactactactcctccggccactcctgtgctacatcttatagatgaagaagacactcaggatgaggatactcagtcactggaattttaa

SEQ ID NO: 11734 - DNA, 910 bp, Glycine max
  Peptide Sequence Number=SeqID_103419
ttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatactcctcacgggaacacacacttatgggagacggagtttggctcttgctgcccaggctacagtgcaatggcctaggggactcaaggagtcaacctatggcagagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11735 - DNA, 168 bp, Glycine max
  Peptide Sequence Number=SeqID_103420
atggctggtacattcttccttttgaaacagcaaaataatttagagaattatgagcgggacgccataggaggggcgcccccagaagctcccggcgatggagaggaggcccacgaggacgaggagatggccgatttgcttgacttcttgggagggaatggagctacatga

SEQ ID NO: 11736 - DNA, 447 bp, Glycine max
  Peptide Sequence Number=SeqID_103421
atgcataaggcattacaggccaatgcacctctgccttatcctcaccttgttaatctttttcttcatcattttaatattcctttgggtgatgaaccatttgtcaaggtaaagagctctttctctattggtgctagtgcggttacctcctttcgttaccgaaaagatgttgatggtcagtgggttcgcaaacaggacttgccattgcctattcccgatgaacgtaccccatctcctccaccacaaagggttgattctacttctcttctgactgaagtactcacagagctccacgaccttcgagcttttgtgggtgaatgctttactgcgatggatacttgccttgatgcgatggatactcgttttgatgggctggatacaaggatcactcaactcgaagatgatatgagcttcattaggcgttgcttcgatcccccgaccgactcttag

SEQ ID NO: 11737 - DNA, 651 bp, Glycine max
  Peptide Sequence Number=SeqID_103422
gtttcttcttttttcgaggacgagggtgagagccctgtcgagtctgatgaaacaaaagtccaaacttggagcaaccaacactacaggaacgaacctgtggttgttgttgttgcttcacagttgcaaaagtattctagttttgatgaccagagtggggagaagcctctgcttttgcccattcgaagcttgaaatctcgcttatctgaagaagatattgatgttcaatctctgaacatgtcaatgagttctaaaagattttcaagctattcgaatagaaaagcagaagttgaagctgttgatgttgatgttgatgctgatgttcaatatctaaataggtcaacaaccttcaaaagtttttcaatcaattcaaatagaaatgcagaagttgaagctgatggtgttgatacagatgttcaatctctaaataggtcaacaatttctcaaggattttcaagcaattccaatagaagagctgaagttataatgttgtcttcaaacacttatgttataatgttgtcttcaaacgcagaggattcggtgaggaagaagggcttctacaagtcttgtcctccaccacctccgccaccaccaccaacaatgtttcagaaatcaatgttcatgaagccaaggtttgatggttcatccaactaa

SEQ ID NO: 11738 - DNA, 510 bp, Glycine max
  Peptide Sequence Number=SeqID_103423
atgacggcgacagcgacgaagtctatttccttgaagcctttgggaagagacgacaccgtgaggcgccatttggcggaggagattctgattgtggtgcctaggtacaccgtcaagcctctggcgacgatgacattggaaagcacggaccaaaggtataaggtcttttcttgtagtgcctatggtggttcaaggaataggtttgagcaattaaagaatcctaggaaaaagagtgtgccacatactaatgaaaatgtgtttaagtctgtttggaagtgcaactcttcgaataaagtcttggctttttcatggaaacttttacatgaccgtttggcaactaaagaaaaccatgattatgaagggccaagtagccaagatgagattactacttcaccttcctctagtgaaagtgaagaagcaaaagaggaagaatcaagtgaagaaattgattcccaagaagaaagggaccttttaatggtcagaagacttctaggaggccaatcttgtaacttg

SEQ ID NO: 11739 - DNA, 87 bp, Glycine max
  Peptide Sequence Number=SeqID_103424
tggtatcagagccaggttgttcgacttggtgatcggctcagacgagcagcgtgtcccgcagatggagcggcggtgcaagtaccgcag

SEQ ID NO: 11740 - DNA, 462 bp, Glycine max
  Peptide Sequence Number=SeqID_103425
atgaccatgattacgccaagctcgaaattaaccctcactaaagggaacaaaagctggcagggtctcactctgtcacccaggctgagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11741 - DNA, 271 bp, Glycine max
  Peptide Sequence Number=SeqID_103426
atggatgattttagtgaggatgaggatcaacagttctttgatcacatcaatcaccaaagtgacgaccaaagcgatggcaagggtgttggcagaccaacgacacctccgtcacctccgttgcaatatcaccaacctaggtgtccagtagacttgaactttgaccaccaaccacactacattgatcgacaccattttgttcaacaacaacataatgtacaaccaccagccgatgcactcgaggttggcatggctttcgatgaaaaagcacaat

SEQ ID NO: 11742 - DNA, 111 bp, Glycine max
  Peptide Sequence Number=SeqID_103427
atgtggaaattcttcatcgttcttcgtcgttcttcaccgttcttcatccgttcttcgttcgttcttcgttcttcaacggttttcttttcttccgtttttaacgtgctttaa

SEQ ID NO: 11743 - DNA, 105 bp, Glycine max
  Peptide Sequence Number=SeqID_103428
atggacacccgtctccgtgtgattggtgatcccatgaatggagttcaacggggacactcacgaaacaagatacaagcgcaaggccgtgtaacgcgctaccactga

SEQ ID NO: 11744 - DNA, 279 bp, Glycine max
  Peptide Sequence Number=SeqID_103429
atggccacagttactctaaccacactagttacccacgtctgggccatccgacaagctagtgccaatgaccctggaaggtcagtgcacagtgccccccatgaacatacacaacatccaatgtatgaacatggccaaaagctagtgccaaagaccctggaaggtcagtgcacagtgtcccccacgaacatacacaacatgcacatgccaatgcatttccaacatcaatcaatattccatttccatgtcattctcaacataaatatcatttcgtctcaatga

SEQ ID NO: 11745 - DNA, 851 bp, Glycine max
  Peptide Sequence Number=SeqID_103430
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctacaaaaagggcatccgagtgaggaccctgctcaggactcagatgagaaaccctacacaaaggacatccaagtgaggaccctgctgaggactcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11746 - DNA, 435 bp, Glycine max
  Peptide Sequence Number=SeqID_103431
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgtagcgtagcgacgtcagtgagcgagaagactggtagttccctaatgtatcatattctgcgacgcaccgggggccacttttgttctggcctgccaccgcggtggagctcacttcacgacaccctcatcagtgccaacatagtaagccagtatacaactgccgtcttttag

SEQ ID NO: 11747 - DNA, 726 bp, Glycine max
  Peptide Sequence Number=SeqID_103432
atgcgcgcctgctatgccctgcgcccggaaggtatcaactggcctgaaaatgaagacggtctgccaagcttccgccttgagcatctgaccgtcgcgaatggcatagagcatagcaatgcccacgatgcgatggccgatgtgtacgccactattgcgatggcgaaactggtgaagacccatcagccgcgcctgtttgactatctgtacagtcatcgaaataaacgcaagctggcgacgttaatcgacgtgccgcagttgaaaccactggtccacgtttccggtatgttcggcgccgcccgcggcaacactagcctggtcgcgccgctggcctggcatccggataaccgcaatgcggtgattatggttgacctggcgggggatatgtcgccgttgttggagctcgacgccgatacattgcgcgagcgcctgtatactccgcgagacgaactcggcgatttaccggcagcgccaattaagctggtgcatttaaataaatgcccggtgctggcgcaggccaatacgttgcgtccgcaggatgccgaccgtttaggtatcaatattcagcgctgcctggagaacgcccaactgctgcgtgcaaatccgcaggtacgtgagaaagtggtagccctgtatgccgaagccgaaccgttcgtgccatcggataatgttgacgcccaactgtacaacggattctttagcgatgccgatcgcgcggcgatgaagata

SEQ ID NO: 11748 - DNA, 306 bp, Glycine max
  Peptide Sequence Number=SeqID_103433
atgcttcagagcattcatcagggacaaattattttacttcagagtttacaggtggtggcgcctctaggatccattccttccgttgagcagtttctggatagggtagcctggcctggggcccaaccttctcttcacatggaagatgaagaggatgcgtcatctgaggccaccattctagagccattcatggtagaggaggaggtaggtgagacacaggttggacaggaagctgctgctactcctgagaggtcacgagagatcacatcagatccaccaacaccagtggtggacctatccttaccttag

SEQ ID NO: 11749 - DNA, 345 bp, Glycine max
  Peptide Sequence Number=SeqID_103434
atgcccttttgcgggcgagcgaggcgaggctcacgggtgcgctttccaaaggaggaaagatgcggggagtcgccaccaacgtttatttgtgggaaacgtcggaaaaatggaaggaaagcggtcaaaatgaaaattctaagttgggaagttgtatttacgtttgaggaaggtattagcacctctcacgtcgacaaaagcggggctcttgctcctacgtaccctccatcgaagaggaaatcagaccttcgtagttcttccttaagggtgaatcacacgatttctttttacttgaaaggtgatcatttaaaggtgttggaccttaaaaatgatccattaacttggtaa

SEQ ID NO: 11750 - DNA, 670 bp, Glycine max
  Peptide Sequence Number=SeqID_103435
atggtggggatccatggactcggtggagtgggtaaaacaacacttgttgtcacggtctataatttcattgctggccattttgaagcttcttgctttcttggaaatgcgaaaagaacttccaacacgatagatgggttagaaaaactccaaaacaaccttctttctaaaatggttggagaaattaagtttacaaattggagagaaggaattaccataataaagcgtaagctcaagcaaaagaagattcttttgattctagatgatgttgataaacataaacagttacaagcgattactgacagtcctgattggtttggtcgtggtagtagagtcatcatcaccactcgagacgaaaatttgttagtgcttcacaatgttaaaataacatataaggtgagagagttcaataagatacatgctcttctattacttactcacaaggcttttgagttggaaaaagaagttgatccaagatactgttattttttgaatcgagcggtaacttatgcttccgaccttccattggctctagaaataataggttccaacttatttggaaagagtatagaagaatcggaatctgctctaaatggatttgaaagaattcctgataataatatctatgaaatacttaaagtgagctatgatgctttgaatgaagatgagaaaa

SEQ ID NO: 11751 - DNA, 297 bp, Glycine max
  Peptide Sequence Number=SeqID_103436
atgtctctattgtttgcaaggatcacgcccgcaagacacccagtggacccggagaagcccaacagggtcttgggatttccagctctgattacgggcctctgtcagttctacggagtgtctgtcaccctcagcaaggtcatcaggccccctaccaaccgagctttcatcaagaagtgctgcgcccccaagcaggcgcagggcgagacaccacagcagcctggggatagccagcagcgggcaacagacgcaccgccaccacctctagagttcacctcagctcatccacaaaaagggtag

SEQ ID NO: 11752 - DNA, 135 bp, Glycine max
  Peptide Sequence Number=SeqID_103437
atgcttttcaagaaccagccgttcactcctgaaaaggtcatggatgatgccttgttccacacctggtcctggctaaaatgtgtggagaaggacttcaatatgcattttactttctggtcaaccaatctaaaggat

SEQ ID NO: 11753 - DNA, 726 bp, Glycine max
  Peptide Sequence Number=SeqID_103438
acagttacggctcgcgcatatcttcttcatcttctgggttgcactctgtttgctaacaagagtgcaaccaatgtgcatgttgtgtacttggaggcccttcgtgacctcagtcagaccgggaggtacgcctggggagtggctgctctggtgcacatgtacgaccagctgaacgatgcctctatcagcagcagccgacagcttggcggttacatcacactgcttgttggattttcgagcactttccctcagtcgcagagtccattgctgatcaggaatatgacaaggattccctacgtgcgtggagctcctggattgacttcggattccggatgtctgttggatcccgtatggggagcaccgatcggtctgagacttccatgtgatatcatgttatttcggtttcctgcgctaggggcctgttgctgtttattaccgaccagagagggtcgtgcggcagtttggatacacgcagaccattcctgctccgcctgtcgattcataggtgtcgttagtgtgccagtgactaaatggactggttcttccgcatctcgcatctcgcatcctttcatgacaccagaccacgcattagatcctctgccagatggtcatgccccgcagccccgagtcgtccctcaggccccacagacggatatctctcacgtactggagccaggagcactgtcgacatctgcgaggcccgctgtggaggagcctagacatgcagtg

SEQ ID NO: 11754 - DNA, 842 bp, Glycine max
  Peptide Sequence Number=SeqID_103439
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacaaaaacacccaactatggttatagggagctgggtatttggcagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11755 - DNA, 144 bp, Glycine max
  Peptide Sequence Number=SeqID_103440
atgtggaccaccacgggggaggagcttgccacccagcttgcccaggcaagcatggttgcttcctccagaagcaacagccttctggaggaaggatctggaaggcccaagtgggccaaattgctatttgtaccgcctttttactaa

SEQ ID NO: 11756 - DNA, 210 bp, Glycine max
  Peptide Sequence Number=SeqID_103441
atggcattagaagaagggaaggtgaagatcgagaagttcgatgacagagatttcagcttttggaagatgcagatagaggattatctatatcagaagaagctattgacattagtcaagaacttcgcattcaacatcgtaaacgagaagactactgcaggcttaatgaaggcgttatcagatatgtacgagaagccattggcagccaacaaa

SEQ ID NO: 11757 - DNA, 150 bp, Glycine max
  Peptide Sequence Number=SeqID_103442
atgggggtgcaaatagcaaccaggcccacttgggccttccaggatgttcctccaaaaggcggttgcttctggaggaagcaacctagctcgccagggcgagctgggtggcaagctcatcccccattgttctataatagggggaggagggaa

SEQ ID NO: 11758 - DNA, 378 bp, Glycine max
  Peptide Sequence Number=SeqID_103443
atgggttttccagcaaaccggatttcccttgaacatatttgtaccaagaaaaagtggaccaaaaaaagatctactgcaggtgatttgattcccattgatttggagattaacaccacctgtagtgggcgtaattcagagagaatcagaaaattcttgcaggatttagaagcagcaacaactccagaagaagaacttcgatcttctgaggcatcttctagttttcctattgtagggcattctcatatagaacttgttgaagacacaatcatggctgaagagccaagaagagtaaccttggaagattattcaagttcttctgtgccacaatttttcactagtatagcacagccaaatacatatcctccttctttgatatag

SEQ ID NO: 11759 - DNA, 523 bp, Glycine max
  Peptide Sequence Number=SeqID_103444
atgtcactgaacagaacgcaaatcgtcgactggctgtaccgctgcggcgatattttcaccaaacagagcgattttctcaccggccttgataaagagatcggtgacgccgaccacggcctcaatatgcatcgcggcttcagcaaagtggtcgaaaagctgccgtcgatcgccgataaagacatcggttttattctcaagaataccgggatgacgctgctttccaacgtcggcggcgccagcggcccgctgttcggcaccttctttatccgcgccgcccaggtcacccaggcgcatcagagcctgaccctcgacgagctttatcagatgatccgcgaaggcgcggacggcgtcgtcaaccgtggtaaagcggagccgggcgataagacgatgtgcgacgtctggctgccggtggtggaatccctgcgtcattccagcgagcaacatctgtctatccctgccgcgctggatgccgcctgcgaagtggccgagcgcgccgcccacgccaccatcaccatgcaggccc

SEQ ID NO: 11760 - DNA, 144 bp, Glycine max
  Peptide Sequence Number=SeqID_103445
atggacattctcaccctgggtcaagcttgtaacctagacacggttgatgcccgagatcacatcttcttttcgaaaaaggcgtgtgaacaaaagtgcacaagacctacacattttttgtttgcgtttcagacaaatcatcgtaaa

SEQ ID NO: 11761 - DNA, 201 bp, Glycine max
  Peptide Sequence Number=SeqID_103446
atggcagcgcagttaatccatggtcgcgtggtgatggagtgcttagagggagtttgggagaccctcgaaggcaatgagaggtgccgattccgtggcgcgattcaactcactgctacttcattagtacatacggaggaacccgcacgcacgcttcagcagcctgtggagtggatactaccaacacctactccatatcgacta

SEQ ID NO: 11762 - DNA, 226 bp, Glycine max
  Peptide Sequence Number=SeqID_103447
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgggtaacggcaaaagcaccgccggaatcaagcttatcgataccgtcgacctcgagggggggcccg

SEQ ID NO: 11763 - DNA, 162 bp, Glycine max
  Peptide Sequence Number=SeqID_103448
atgacaccggggggcggagcctatggaaaaacggctttgccgcggccctctcacttccctgttaagtatcttcctggcatcttccaggaaatctccgccccgttcgtaagccaatttccgctcgccgcagtcggaacggaccgaagcgtagcgagtcagtga

SEQ ID NO: 11764 - DNA, 402 bp, Glycine max
  Peptide Sequence Number=SeqID_103449
tgctgctattttcataaggcgcgctaagcgagtcagtctcgctaagcgccccatggcctccaggaagaggaaagccataaccttccaacctcaagaaccttatgacaccactcggttcatttctgaggttgcttgggagcgatattcacagaacgttcactcctggaacatcctttcggagaggaacgttaacctctttgtgactaagacgcgcatagatcctcaagagcttgcttccaagctctgcatttcagggcgtgggttcattttaaatgctgaggaggcgccctggaagctcatgaggaaggatttgactacactagcccagaattggagtgtgttatcatactccaacctcgcccccacttttcatacgtccgatttgaatatggacagggcgag

SEQ ID NO: 11765 - DNA, 315 bp, Glycine max
  Peptide Sequence Number=SeqID_103450
atggtggcccgagtgatgttggggaatgattacgagcctggaatgggtttaggcaagaacaacggcggtaggaccagcctgataagcaccagaggaaaccgtgggaagtttgggttaggctataaacccacgcaagtggacataaggaaaagtgtcgcgggaaggaagagtggaagccaagatctttcttcatctgttcctacgtctctacccattatcattcatttgcatgtttatttctttacgcttaaaacgccagatccgacgacgagtccctcgaaggtactaatacctgggacccgaccatcgatttga

SEQ ID NO: 11766 - DNA, 186 bp, Glycine max
  Peptide Sequence Number=SeqID_103451
atggcctgcggtgcatcaccctacgcttgtctaggcgtgcaatacttctcaatgaaggctcaggtgatcggcggcccgatcaccttactgggtgtaacggaaaccctgaatgactggcagaggcccgtgatcaacgctggaaaccccagggccctgttagacttatctgggtctagagggtgcctg

SEQ ID NO: 11767 - DNA, 312 bp, Glycine max
  Peptide Sequence Number=SeqID_103452
atgggtgatatcgatctccgccctgttgtatcggagggtgcctgcactggcgaaccaatcgacgtgattgatggtgcggaaggaggtgacgtcgatgccgcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11768 - DNA, 767 bp, Glycine max
  Peptide Sequence Number=SeqID_103453
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcccagctacttgggaggctgaggcaggagaatcgcttgaacccaagaggtggagattacgggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11769 - DNA, 621 bp, Glycine max
  Peptide Sequence Number=SeqID_103454
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttactcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11770 - DNA, 426 bp, Glycine max
  Peptide Sequence Number=SeqID_103455
atttaccaaggtaatccttgtggcgtctaccctgacttatcttccctcactggaagtggcgtctacccggacttatcttccttcaccggaagtggcgtctaccctgacttatcttccttcactggaagtggcgtcatccaaaaccttttccgtagcttctgttcaattcgatctgctcctactcaggttcacatcaatgcgcctgaatcggacattcgtgtgaaaagtttcgacccatatgaatttcttgagagcttccgttgttccatttcgagcatctcgatgtattatgcgcctgaatcggacctccgtgtgaaaagttatgaccatttgaatatctcgagagctttcgttgttcaatttcgagcgtctcgatatgtgatacacatgaatccgacatccgagtgtaaagttatgaccatttga

SEQ ID NO: 11771 - DNA, 432 bp, Glycine max
  Peptide Sequence Number=SeqID_103456
atggcgcgatcttggctcactgtaacctctgcctcctgggttcaagcgattctcctgcctcagcctcctgacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11772 - DNA, 483 bp, Glycine max
  Peptide Sequence Number=SeqID_103457
gctttgaaaaagattgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgtatgggccgcgtttgtctcattccacgcctgacactcagttccgg

SEQ ID NO: 11773 - DNA, 840 bp, Glycine max
  Peptide Sequence Number=SeqID_103458
atgcgatcctgggtgaggggtcagtggatctcgttcgatgtggatgctctcagccagttcctgggataccctttagtgctggaagagggccaggaatgtgagtatggccagaggaggaaccggtacgatgggttcgatgaggaggccatcgcccagttgctatgtataccggggcaggattttgcctggactgctgctggaagacgggtgcggatcatgcgcaccaacatgaccaccctgactcagatctggatgactttgctgctcagcaacatccagcccagcgatcataattccgacctccccctgccgaagtgtcagctggtgtacgccatcctgacacggatgagcattcacgtggctcagttaatcgctgatgccatctatctatttgcaggtatggtgcctaccaggcaccctctggacccggataagtccaacagggccctgggatttcccgctttgatcacaggactctgccagtcgttcggagtccccgtcgcacctagcaaggtgatttggccgcccatcacccgagctttcattgagaggtattgcacacagagacaggcccagggggatgctctgcaggccgcagacgcgccgccacctcatcaggctggcccagctagatcgtttgatacggagcagtatttgcggcatttggttcgccagcaggcggccaaccaccgggcgcatcccatcgcaaatacaaacggccataccctttcctctggatctctgcataaggccggaaacctatggagacacccagaaatcaacaaggaagactcgggcgaattccgacaggcaaaagttttgactcagatgttcgattga

SEQ ID NO: 11774 - DNA, 231 bp, Glycine max
  Peptide Sequence Number=SeqID_103459
atggcacatcccttgtggatctttgctggtaaaggtttttacaaggttgaaaagaaatctcaaggaccgcaggttgcttggggactggatgtaggcacgggttgttgccgaaccagtgcagcccccaaaattccttgggttttgaaggtgcagcccccaaaattccttgggcttggtccttccttggataagagtgaaagccacaagatttggaagaaggctttcttttaa

SEQ ID NO: 11775 - DNA, 351 bp, Glycine max
  Peptide Sequence Number=SeqID_103460
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagagagttag

SEQ ID NO: 11776 - DNA, 255 bp, Glycine max
  Peptide Sequence Number=SeqID_103461
atgaatattgaagaatccattcatgttttctttgatgagtctaatgttatttatccaagaaaggatgtgttagatgatgtttcagatttcttagaagagatacacactcatgaaaggggttctaaaaggaaaagagatgaaagcaatgagtattttcaagactacgaaactccagcaaccaatgatcttccaaaagagtggaaagcttccagaaatcatcctcttgacaacattattggcaatatttctaaaggg

SEQ ID NO: 11777 - DNA, 204 bp, Glycine max
  Peptide Sequence Number=SeqID_103462
atggctccaaagaagcttccagctaagagggcaaggaaagatgccgctggagaaggttccagtatggccccacaagtggatgtgaagtttgacggacatcggttccgaagagaggcaggtccagttgagggaatgagagtatgccgaattctaggaggaaattgccaggaggcagtggactcaacatgcggcacccatggctaa

SEQ ID NO: 11778 - DNA, 947 bp, Glycine max
  Peptide Sequence Number=SeqID_103463
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgaatggcatggaatggaatggaatcgaatggagtggagtggaatgaaatggaatggaatggaatggaatcaagtcgagtggaatggaatggaatggaacggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 11779 - DNA, 288 bp, Glycine max
  Peptide Sequence Number=SeqID_103464
atggcctctttagattctttgcttttcaaaagtattttcaggaacaggttattccaagatcatgatgaagaccaagtcaatttatgtctcatgacaaaatctgatgagaataacaaagaagattttgtaaggaagaagtggtacatcgacagtggatgttccaagcatatgacaggagatgtatccaaatttacaatcatttctcccaacaaaagtggacatgttacatacggcgacaacaatatcagtaaaatctcaaaagaggtaacatctaagccatctctatga

SEQ ID NO: 11780 - DNA, 847 bp, Glycine max
  Peptide Sequence Number=SeqID_103465
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcctcatcccaggcccacaaatcactttgaaactaaatctccttactcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11781 - DNA, 453 bp, Glycine max
  Peptide Sequence Number=SeqID_103466
atgttccctcatgggaagatgtccatgaaaggggtgtcgagggaaagagcccagaatatgaagaacctcgggatttcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11782 - DNA, 494 bp, Glycine max
  Peptide Sequence Number=SeqID_103467
ggcgcgtcccattcgccattcaggctgcgcaactgttgggaagggcgatcggtgcgggcctcttcgctattacgccagctggcgaaagggggatgtgctgcaaggcgattaagttggttaaaaagctcgtagttggaccttgggttgggtcgatcggtccgcctccggtgtgcaccggtcggctcgtcccttctgccggcgatgcgctcctgtccttaactggccgggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 11783 - DNA, 330 bp, Glycine max
  Peptide Sequence Number=SeqID_103468
atggagattaagaacaacaataaaaatggatggaatgtggagttggaagaggaaatgagggaggttattgaagtgttgaagagaaaagacatggaagactatgataggttagggaatattgcactgaagataaacaagggttttgctgtttcagcacctttgctcacaggaattgctgcactaggaacctgtggtggagtttttcagctgttggaggagacaattgaagccgcaattgaagagaaagacttggacaaaagagaaaatggagagctaattgaaatgaagatggctttgcaattgggaagaagtgtgtcacagctgagataa

SEQ ID NO: 11784 - DNA, 306 bp, Glycine max
  Peptide Sequence Number=SeqID_103469
atgtttgcacattcgattaaaggctgccgtcccttgggacgggcgtgtggggtgctaataccttccccgtgcgtaaatacaactcccgaacctttcactaaaaagttcgtagatcgcgtcttttccggttttttccgacgttttcctcaaataaacgttggtggcgactccgcgcgtattcctttcgtggaacacgcatcccgcgagtctcgcgtcgccctcccgccgaagggacgtaaggttgaatcatgtgttggcagtagacaaagtgaaactggaagtgacatggacatcaacagtccttaa

SEQ ID NO: 11785 - DNA, 1040 bp, Glycine max
  Peptide Sequence Number=SeqID_103470
ggttacatgtccacgcctttagagggctacacgccctcactttcagaggactacacgtcctcaccttgagagggctacacgctctcgtattcagagggctgcacgccgtcaccttcagagtgctgcacgccgtcaccttcagaggactacacgtcttcgccttcagaggcctgcacgtccttgccttcaaagggctgcacgccctgcccatcagagggttgcatgccctcaccttccgaaaattacacgtcctcgccttcagaggactacacgtcctcgcctttagaggactacacgtcctcgccttcagaggactacatgtcgtcccttcaaaggagtacaggtcctctcgtttagagggctacacgtccttgcctttagagcgtacacgccctcaccttcagaggactacacgtcctcaccatgagaggactacacatcctcgctttcagagggcaacacgccctcgccttcagaggattacacgtcctcccttcaaaggactacacgtcctcgcgtttagagggctacacgtccttgcctttagaggagggcaacacgccctcgccttcagaggactacacgtccttgccattagaggggtgcacgccctcaccttcaaaggacttcacgtcctttccttcagagggctaaacgtcctcagcttcagagggcttcacgccctcaccttcagaggactacacatcctcgccttcagagggttgcatgccctcaccttcagaggattacatgtcctcgccttcagaggactacacgtcctcgcctttagatggcatcacgctctcacctttagaagactacacgttctcgccttcagagggttgcacgccctcacctttaacggactacatgtccttgccttcagaggactacacgtcctcgccttcagagggctacacggcctcactttcagaggactacatgtcctcaccttgagagggctacacgccctcgccttcacagggctgcacgccgtcaccttcagaggactacacgtcctcgccttcagagggctgcac

SEQ ID NO: 11786 - DNA, 524 bp, Glycine max
  Peptide Sequence Number=SeqID_103471
atgacaaagacaaagaccgcctttgacccttgttcagagattggggttggtttcaaaaggcttgaagccaaacttcacagggattgggaaaaggaagggaagatacgtatcactgatttgccttgtaatttttacgtggtccagtttacgtcactggtagattacaagcttgctctctatgatggtttatggctgatagcggaccattgtatcctgggtgggggagaagctaggaaaattccggaaagtggactgtcttacgtcaattcattcacgtgggttgctcgtgagatggaggatgaagcaccgaaagagaccatgtcggagtttcaagttcgcgcggtagcaggagtcatcccttgcctcctacagtcccttgttcgcccacaggctcaacatggaagcacaagtttgataacaccatgggtgtacttcacttcagtttcaaacaaagttggtggctgcagcactaataatattctctctcgttgcactagaagctcctgcaatacttcgttcctaag

SEQ ID NO: 11787 - DNA, 360 bp, Glycine max
  Peptide Sequence Number=SeqID_103472
atgtacaaagataattggacccaaccttggcccatgggctcagaaatctaccctaaggttcatgagaaccctagggccttcttcagcagctctagcccaatcttcttggagcctcttgctcatggttcttgtgattggtcccttcctagggaggattgcatcaccagcccacatcaattagactttgcaccttacgcttcaaggccctacaatgctcagtggaatgccccgtggctcctccatgataagcacacattgcgttcgagtcgtatccttagaaaaatggaggtgggttttgttgttgatttagggatggcctttatggataaatgggtggtgggtaaggagatggctgagtaa

SEQ ID NO: 11788 - DNA, 417 bp, Glycine max
  Peptide Sequence Number=SeqID_103473
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagttcttcgcatctcatgctgtggttacgcatcttcggatcgaattcctgcagcccgggggtaaccactttccgtgccgcagacgaccgagcgtaggagctcacgaattcgcggcctatatgagtcgtatctacaattcactgacgcaccgtcgtttttcacaacgtcactgggaaacaccctggcagttacccaactataatcgccattgcacactccccctttag

SEQ ID NO: 11789 - DNA, 177 bp, Glycine max
  Peptide Sequence Number=SeqID_103474
ctgaggtacatttcacctgaggtacaatctcgtcggcattgtcgctgttgtgttcgaggtagtgttgcttggaaagttgtgtatccattaggtcctgctcactattttcgtcagttgcttctccttgcatcaaaaggttctgctctccgtttccagcaatgtactaaatgtggatga

SEQ ID NO: 11790 - DNA, 2049 bp, Glycine max
  Peptide Sequence Number=SeqID_103475
atggctggcaccgttcatgccgtgggtcaatcccgaacgcatgggcccgatcagctggcagggctatgcgtggacgttcgcagtcatcgtcattcccaacctgttgttcaccaccgcgctgctgtcgctgctggcggcgctgacccgctcgatcctgtgggtctacatcggcctggtggcctacctggtgctccgctgggcatgcgcgcactgggccgcacgatccgctactggtccaccgccgaacgcaacaacgggatccccgagctggccggttacctgctggccaaccgtgccctgtggttgggtgtggctgccgtactgttcgccgccaccttcgcgttgttccgcaccgaacgcagcggcagtggccgtcggcgctggggccgcaggcaggcgcaaccggttgccgatgccaccggcatccgccccagccgcgcgacactgccgcgcgtgcgtgccgttcatcgtgctgctggtactgggcctggccaacttcctgcccagcgcgctgttccggcagaccctgtacggcacctcgatctggccggtcacctcgcagatgatcatggggctgcagggcgccttcagctggctgctggtgatcatcgtgctgttcttcgccgtgaccgatgccatgccggtgccgaactgggtgccgctgctggccaagttcaccgcactgctggccgtgatcgtctgtttccaggccgccggcgcgctggcggcgatgggcgtgcagctggccaagggctacacgcatctggagccgctgctgtacctgcgcagcctggcgctggattcggtggtctacatcctcatggggggcctggcgctggtgctgcaggtgctcaccaacaacaagttcgtcggttacgcattgctgatcgtggtgatgatcggtcagggtgtgctgggcatgctcgactacacgcagaacctgtacaacttcggcagctggcccaacgcaccctattcggacatgaacggctacggccacttcctgaccgggcaactggcattccagggctactgggcgctgttcctgctgaccttgatgtgcctggcgtcggccttctgggtacggggtgtcagccagggcctgcgccagcgcctggccctggccggccgccgcctgcgcgctggctgtactggagcaccaacatccgcaacgagttcctttctccggaccagcagctggatctgcaggcccgctacgagcgcgagctgtcgaaataccgcaacctgccgcaaccacgcattgtcgccgtggacaaccgcgtggacctgttcccggaatcgcagtcgatggtgatcgatgcgaattggacggtgcgaaacacccacgccacaccgatccaggacgtgcacgtctcgatgggtgatgacaaacagctggttgcgctcgatctgggcggacagaccctgtcgatgcatgacgccgatctcggctaccgcatctaccgcctgcagaaaccgctgcaaccgggtgaaaaccgcagcgtgcatttccgggtggtgcagaagcctaatggcatcaccgccggccaggcgccgagcaacatcgtggacaacggcacgttcttcaacagccgcgtgctgccttccttcggctacaacgaaggcgccgagatcagcgaccgcaacgaacgccgcaagcgcgacctgggtgagccgcggcgcatgcccaagctggaagacgaagccgcgcgtgccaacacgtacatagccaacgatgccgactggctcgacttccgcaccacggtctgcacggcaccggaccaggtggcgctggccccgggttacctccagcatgagaccacggtcaacggccggcgctgcttcagctatgccatggaccggccgatgctgaacttctacgcctatctgtcggcacgctgggaggtgcgcaaggcaaagtacaaggacatcccgatcgaggtctacttcgacccggcgcacggctacaacgtggaccggatgatcgaggcggtgcagaagtcgctggcctactacgaagcgaacttcaccccgtaccagcaccgccag

SEQ ID NO: 11791 - DNA, 373 bp, Glycine max
  Peptide Sequence Number=SeqID_103476
gcagcgtgttgtcctctggaagcagattgtgcactacctcaagcaatgagtatcagaagattcatgcttgccccaacgattgcatactgtgtaggcatgaattccaagaaatgtccaaatgccctatctgtgggacttcacggtacatcaagcttatcataccgtcgacctcgagggggggcccggtaccagcttttgttccctttagtgagggttaatttcgagcttggcgtaatcatggtcatagctgtttccttcgggaaacctgtcgtgccagctgcattattgaatcggccaacgcgcggggagaggcggtttgcgtattgggcgctagcggagtgtatactggcttactatgttggcactgatgagg

SEQ ID NO: 11792 - DNA, 803 bp, Glycine max
  Peptide Sequence Number=SeqID_103477
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcggccactcgccctcgatcatggtggtgtcgatctcggtggtgtcgcggttggcatccaggtagatgcgcgggaaatgcgcctcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11793 - DNA, 875 bp, Glycine max
  Peptide Sequence Number=SeqID_103478
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtgatcataatcgattacttctctcttaaaactgtttcagaagtgatcaagaacactttaatcgattacatcaagaatctaatcgattacattgttcttgaaagttttctagtttttggtaagaatactttaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11794 - DNA, 240 bp, Glycine max
  Peptide Sequence Number=SeqID_103479
atgacaccggtaaaccgaaaggcaggaacaggagagcgcacgagggagccgccagggggaaacgcctggggggcggagcctatggaaaaacggctttgccgcggccctctcacttccctgttaagtatcttcctggcatcttccaggaaatctccgccccgttcgttttaccaacatagtacgtatgacactccggcgtacccaattatcgcccgcctcccccgccgcgttggcgattaa

SEQ ID NO: 11795 - DNA, 357 bp, Glycine max
  Peptide Sequence Number=SeqID_103480
atgacaccggtaaaccgaaaggcaggaacaggagagcgcacgagggagccgccagggggaaacgcctgcgcccggaatacgcaaagccgcaccgatcgcccggttgccgattcattaagcagttgcgcaggtttccctgaatgggaaaggggcgccctgagcggcagcattaagcgcgggggtgtgggagttagcgcacgtcattggcaccccggctacacttgccgcgctgatgttccggctcggtatgttgtgtgccgaattggagcggataacaccaccctttcagtagctgaacaggaaggacagctgatagaaaccatgatacgccatgagctcgaaattaaccctcactaa

SEQ ID NO: 11796 - DNA, 853 bp, Glycine max
  Peptide Sequence Number=SeqID_103481
atggcagaggtctccacagaggccattgcctccctcgcccaatattatgaccagtcgttgaggtgctttacctttggggttttccagttatcactcatggtggaagagtttgaagagatcctaggatgccctctagggggaaggaaaccatacctcttctcaggattctatccctctttagctagaatttctaagatagtccaaatctcgatgcaggaattagaccacagaaagcaagtccaaaatggggtggatggagtaccgaggaaatatttggaagcaaaagcaagaatcttagcaggtaaaggcgaatgggcctcgttcatagacatcctcgcgcttttgatctttagaggggtcctctttccaaatgtggatgggttggtggacctagcggcaatcgacacttttctcgcctttcatgactgcaaggaaagcccggttgtcgctatcctagccgatctatatgacatcttcgatcaaagatgtgaaaagagcagtacaatgattgtttgttgtactccgaccctctacgtatggttggtttcacaccttttccgccaagagatgagacatgcttgcccgctagaaggccatcgctcatgcacagagaaaaaagaggcaagttgggaccgactcttagcaagcgaagaaggagtgtctatcaactggttccccggatggaaagaaggaagacccatggttcttatttcgtgcagaggatttccaaatgttcccttgatggggacaaggggttgcatcaattacaatctcgtcctcgctataagacaacttggctaccctatgagaggggcaccactaggggaagagcttgcacctattattgcacaag

SEQ ID NO: 11797 - DNA, 360 bp, Glycine max
  Peptide Sequence Number=SeqID_103482
atggcggcgattatcggcttccagtcgccatacaacgaccagcgcagcgtgatcgccctgatggccgatagcccacgcggcaacgagctgcttacaaacgccttaaatgacagcggcaaacgggcggcgatgttcggttcggtggcggtgattcgcgaatccggcgtcaatagcctgcgggttggcgatatctattatgtcggccatctgccgtggttcgagcgcatctggtttgcgctctccagccatccgatactgttggcgattctggcggccgtcagcattgtgctgctggcgtgggtgctgtggcgcatgctgcgtattctcagccgtcgccgtcttgatcctgatgatgagtaa

SEQ ID NO: 11798 - DNA, 678 bp, Glycine max
  Peptide Sequence Number=SeqID_103483
atgacatatggggaactcttgccatctctcatcgccaaccaattggtcgtggtggtcccgggaaagatcttccagtgcccattcccaaagtggtcacatgggcccaagcttttggaggacgtaaagacccccagaaggtttatctacaaggccttgcaaaaggtgggcatgattccctgcggcgggcgcagagaagactcttgcctaatgcatccgggtgtactccatgacatggaaacatgttcggcagtaagagatctattacaacggatgatagaccaaggccggcttgaggtcagcagtgagagggaggaggaacaacatgtatacatgcagtcgacaaatgaagaaggacctaaaaagcctaaacccttggtaatacacttcaccaggaacacggctcccctaatacctcaacacccctcggcagtgtcgggcggtagatctattccatttccttacgagaacagccacgcagttccgtggaggtatgcccctctgggcggtaggaaggaagaagctaccgatatcagctcactatcgaccaaagtgaccaatatcaccgagctgagcggcataacccgcagcggtcacgtgttcgcaccccctagcctgccgatacagttcgtaaacattaaagggaaagaaaggatgacggaaggacaaatgtcaaagtga

SEQ ID NO: 11799 - DNA, 567 bp, Glycine max
  Peptide Sequence Number=SeqID_103484
atgcatgatgcccaccggttggtttgcaccaaccaagcggatattaccggaaggcttcttgccgattcattggcttttgaaagccacatccttcattatctcattgtgtgtatctttcttccaagatcttcaaaccttgcacaagcattgcgattaaatgctccattaccatatccacacttagtcactctcttccttcaacactttaacatccctcttgattctgaaccttatgttccaatcaagagatccttcttaattggtgtcgctgtgattgcatcctttggttaccgaaaagagcatgatggctcttgggtgaaaaagggtgctcaacccaatgatggagaaggacatttacaaggtggagaagattcctctcttcttcaaaagattttggacaggttcgatggtcttcaaacctttgttggtgaaaggtttgatgctttggagttacaagtggacatgagatttgatgagatggattcaaggattaccaaggtcgaagaagatgtctcttacattcgcacaagctttgatctaccaccaccaccgccaccatcatcttag

SEQ ID NO: 11800 - DNA, 144 bp, Glycine max
  Peptide Sequence Number=SeqID_103485
atgtctcaaggaaacttcaatggggagttttcaccggaaagcgcaccgggtcgtcaacctaaattactaaaccctcgatccctcgtcatgctgcatacccaagcttcgtccatagatccctcatttaagactacacccgattga

SEQ ID NO: 11801 - DNA, 180 bp, Glycine max
  Peptide Sequence Number=SeqID_103486
atgggagtgtatttagcaaagttgggtaaattcgaatctaggccctcccggaacattttggaagttgggttgcttaaggagagtcacaacctacccttcggcgggagggcgacgtgtgactcgcgggatgcgtgttccatgaaaggaatacgcgcggagtcgccaccaacgtttatttga

SEQ ID NO: 11802 - DNA, 669 bp, Glycine max
  Peptide Sequence Number=SeqID_103487
atttcacttattgctcagtccaactcctcgcggcttggatttccagccctgattactaccttgtgcaaggcccgaggagtcacctcagattctcttaccttcgagtcacttagcccagccattaatttggcttatattaagaagaatcgcaggaacctggatgaaccttcagtcacatttccagggacccaaaaatccaaggctagaagatctaaggccccatctacatcagctgcccctgctccccttacatcagctccatctacttctgctcttccttcaccacctgtagctccagatgtggtccagcaacgaccagttatgagcgtcgagaagtttctacagaaggtggcctggccaggagtccatccttctcctttgggagggggtgaggcctccgcagcccaggagcctcagcaggaccaggaggatgacattctagaggccttagagcccactccacctaagcctttcatttttgagactggtccagtagcagctaccccacaggtgacactagagccttccactatagtgctagacatgtcttcttctcaacctgagccatctgcaccagtgttagacttgccccttcctcaggattcatcagcaggcactactgcactggacctgaatgagcaagccatggactctgcacaggatcattga

SEQ ID NO: 11803 - DNA, 447 bp, Glycine max
  Peptide Sequence Number=SeqID_103488
atggcgccagaggatatggaaaagactaccttcgtcaccctgtggggaatgttctgttataaggtgagtccaaaggacatcaccttcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11804 - DNA, 440 bp, Glycine max
  Peptide Sequence Number=SeqID_103489
aggcgggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactg

SEQ ID NO: 11805 - DNA, 435 bp, Glycine max
  Peptide Sequence Number=SeqID_103490
atggctccgagaaagctatctgcaaagagatctaggaaggactccgcgactgaagggaccagtgtcgcccctgagtttgacagccatcgtttcaggagtgctgagcaccagcagcgtttcgaggccatcaaaggatggtcgttccaccgagagagacgcgtccagctcagggacaatgagtatgcagattttcaggaagagatagctcaccggcgttggacgtcgttggtcactcccatggctaagttcgacccagatgtagtcctagagttttacgccaatgcttggcccaaggaggagggcgtgcgggacatgcgatcatgggtaaggggccagtggattccttttgatgcagatgccctcagccagttcctgggagacccgctagtgttagaggagggccaagagtgcgagtatagtcagagaaggaattga

SEQ ID NO: 11806 - DNA, 288 bp, Glycine max
  Peptide Sequence Number=SeqID_103491
atgtatgaatatcctaggagaacccacacattaacgtgtaagcattcctttcaaaattcatatggatattcatgctttgttggaaaaagggaaatggctccgaagaaactcttcacgaagaggtctagaagagatgccacaagagaagggtccagtgccgccctagatttcgatagtcatcgtttctggagtgctgagcaccagcagcgcttcgaggccatcaggggatggttgttccacagggagaggcgagtccagctcagggaggatgagtatacggacttttag

SEQ ID NO: 11807 - DNA, 747 bp, Glycine max
  Peptide Sequence Number=SeqID_103492
gagcgtggcatagtcgctgctgtctcccaccagcacgccgcccagcagtcgtgcattgtcggcgctaaccacgatcttcttgtaaatgccttttggcccgttggcccagtggtagctcaggctgcccggcgttttgccgtgcgcatcgccaaaggaggcgacttctacgcccagcagcttcagtttagtgctcatgtcggcaccggtgaactgcgccggttcggccgccagatgcccggccagcacacgcgccatctggtagccaggcgctaccaggccaaaaatctgcccgttccacaacgcgcattcgccgatagcataaatgtcgctgtcactcgtctggcattgatcattgatggtaatgccgccgcgcggccccacgctgatgtcggcgctccgggccagctcatcacgcgggcggataccggcagagaacagcaccagatcggtggtcagctcgccgccatcggcaaagtgcagcaccagactgccgtcaggctgggtggcaatctgttcggtctgcttcgaggtatgcaccgtcacgcccagcgagtcgatcttttgtcgcagcatcagcgccccgccgtcgtccagctgcacggccatcaggcgcggcgcaaactcaaccacgtacgtctccagccccagctgcttcagcgcattggcggcttccagccccagcagcccgccgccgatcaccacgccgcgctgactctggcgggcacaagctgcgatggcatccagatc

SEQ ID NO: 11808 - DNA, 228 bp, Glycine max
  Peptide Sequence Number=SeqID_103493
atgccgttgctgatatgggcacacaccggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11809 - DNA, 234 bp, Glycine max
  Peptide Sequence Number=SeqID_103494
atgtcagtgaaaaccctcgtcgggcgcctaggagtacatgacaagacaaaccacgcactagtaaggagaccagtcgaggtcacactattttgcgagaatgctccaaccatgtgggatcggcacaagcttaaaggagcacttaaaccgggtgtatttacccctaaggcctacactccgaagagtccgtcagggcctttccctcctgattcaagtccaacccagaaaacattttaa

SEQ ID NO: 11810 - DNA, 138 bp, Glycine max
  Peptide Sequence Number=SeqID_103495
atggtgcaatggttcaaggagcaacattgtccttatgaaggaggcagtcaccaggttcacaactcatttccgacaattctcaccgttggaaattgcgagaagatatcggagccaagagaaatttccttcgcattgtag

SEQ ID NO: 11811 - DNA, 636 bp, Glycine max
  Peptide Sequence Number=SeqID_103496
atgagatctctggctattggacttgcaaaacataatttaggcttagtttcagaagcaactggtacatatctgtctagaagcttgagaactagctcaggatcaagtaaagcccatacaccaaggaacatttcatatcctgtgtctcctactgggaacccacttttgcctcctaggttactagatgtgagtgaaaggctgtctccatctagtcctcacactgcatctggctcatctacaccggtaactggtggcattggtgcagtcctttttcatcaaacaaatctgatgaaggtgcaagagtttcaggtgtttcaagaatcattggagttgatttactttttgcctaatttgaagaagataaaagagtttaagggaagagaaagtgcaaactcagttttatactggttcggccacacccttgtgcctacatccagtccccaagaaaccggcttgagagttccactaacttgcaaaaaccctttacaagttctgaaccacacaaggacaacccttcctttgtgttcagattgctttacaagaagagaccctcggtctcttaatcccttttcagaagtaataagagaagaagaaatctctcttgaaagagatagattgaacaatgaagcactcaaataa

SEQ ID NO: 11812 - DNA, 273 bp, Glycine max
  Peptide Sequence Number=SeqID_103497
atgccgcatgttgatttaaacgtgggcaacagttacatggatgcttcaacttgtgcagaatttgtggctcagcatgaacaatttatgttaatgcaagacatggtgtgtgatgctctcatgcaacctcacacatttgaagctccaaactcaaataatatggaagaacctccaaatgaagatactcaaagattttataatttattggtagaggccaatgaaccattgtacgaaggggcaacaaactcaacattatcaatatctgggaggctttag

SEQ ID NO: 11813 - DNA, 306 bp, Glycine max
  Peptide Sequence Number=SeqID_103498
atgagatccaatgaggctacttatcctgaaccaataccagtaccagctgatccaccatctccagtggtggatccatcttctcccgctccagaagcagctctcccatctacacctattattatatctgatgaccctacagtgcaagcacctggattggctcctactcctccagccacacctgagcttcagttttcagatgaggaggggggacgaattactactcctccagctacccttattttacatctgacagatgaggaggatatgcaggaccaggacccacagggcacacaggaccagtcatag

SEQ ID NO: 11814 - DNA, 278 bp, Glycine max
  Peptide Sequence Number=SeqID_103499
gtaatccttgtggcgtctacccagacttatcttccttaaccggaagtggcgtctaccctgacttatcttccttcattggaagtggcgtctacccagacttatcttccttaaccggaagtggcgtctacccagacttatcttccttcaccggaagtggcgtctaccctgacttatcttccttcaccggaagtggcgtcatccaaaccttcttaacctgtatcaaacgatccgctcctactcaggttcacatcatctggtatcagagcttcggctcttga

SEQ ID NO: 11815 - DNA, 336 bp, Glycine max
  Peptide Sequence Number=SeqID_103500
atgacaccggtaaaccgaaaggcaggaacaggagagcgcacgagggagccgccagggggaaacgctggtatctttatagtcctgtcgggtttcgccaccactgatttgagcctgagcaccgtgcagcctttttttctgccacaacgcacttcgactggacaccctgcacagttacccaacatagtaagccagtatgcacacatccgccttagcgcctggcgtaatagcgcaaaggcccgcccgatcgccttcgccaacagttgcgcactcatgaatgcgcgaatggcgacaggtttcccgactgtgaaagcgggcagtgaagcgcaacgcaattaa

SEQ ID NO: 11816 - DNA, 300 bp, Glycine max
  Peptide Sequence Number=SeqID_103501
atggtagcccatgtgatgttaaggcatgggtacgagcccggaagagttttgggtcgaaacaacgatggtgtggcgagcttggtagagttcaaagaaaaccgtggaagatttgggctaggatatgagcctacacgcctcgatgtgaggaaaagtgccctagaaaggaggggtagaagcatgggccagctgcaaggaccgcaagtgaaagggattcccttatgtcacatcagcgaaagcttcatcagcatgggatggatgtgtgaagggcaggttgccatgatccacgatgaagtcccttaa

SEQ ID NO: 11817 - DNA, 237 bp, Glycine max
  Peptide Sequence Number=SeqID_103502
atgaaggttgaggaggagcctcagttgcttgttgtctttgttgtgactgctgctatattggaggaggaacatatggcttgcttggaccagcagcattctggaagggagggacaggctgttgttgttgtggaggacttgcccatctcagatttggatgattcctccaacccggattgtatctgttgcttgaaaggtcataattattctgttgttcataagcttcaggttgctcattga

SEQ ID NO: 11818 - DNA, 528 bp, Glycine max
  Peptide Sequence Number=SeqID_103503
atgacatgcggggaacgatttggtcccgcactttttcaccttttgtcatccagaggcggcgggcccgatgacatgcgggaaccatttggtcccccactttttctccttttgtcatccagaggtgccgggcccgatgacatgtgggaaccatttggtcccgcacttttctaccttttgtcatctagaggcagcgggcccgatgacatgtgggaaccatttcgtcctgcacttttttacctttgtcatccagaggcggcaggcccgatgacatgcggggaacgatttggtcccgcactttttcacgttttgtcatccagaggcggcgggccaaatgacatgcagggaaccatttggtcctgcactttttacctttgtcatccagaggcggcgggcccgatgacatgcaaagacaaattatggtcatccgcacgcttttactatctgagcagcgagtcgagtgataaacgcgcagagacaagttatggtcattatgcgccatttgtcattcaggagcagcgagtcgagtga

SEQ ID NO: 11819 - DNA, 351 bp, Glycine max
  Peptide Sequence Number=SeqID_103504
atggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctag

SEQ ID NO: 11820 - DNA, 324 bp, Glycine max
  Peptide Sequence Number=SeqID_103505
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggggagaagtgaggttccccttgtttggttagctaggggaggagagggaagggtaccgagctcgaattcgtaa

SEQ ID NO: 11821 - DNA, 514 bp, Glycine max
  Peptide Sequence Number=SeqID_103506
gccgatcgttattctcttgactcctgctaggattaaggaagcacagggatcatatccaacatcggtcagtaattctttcaaggcatctaaactcatgatcaatgacctggtgctggaaattcaagaatttagagagagtcttttagatttagggatcgaggttagatcaattttgacgcctattggacaagggagttcacaggtttcaggctcatctcaattatcatcaaaagatgtgtttctgtcaaagactaaagagtttgtttgtgttactgtcgccaagattacaaccatagtgatggacaactattcatggtgctatccggcttgtggtcaatgttataaaaaagatgacatgctaactgtgccgttgacatgtccgtgtgtcaaagagaatgatcaagctgtactgaggtatcgggttgaggtgatggttaatcacaagggtgaacaaagcaaatttttgatctgcgatcgtgaatgtgcacagttaattggtcagtcagcggatgaa

SEQ ID NO: 11822 - DNA, 540 bp, Glycine max
  Peptide Sequence Number=SeqID_103507
atggaggaacttgaaagaagtcattgggatgaggagttgactaattttaatgacagtagcatagacattgccattgtgaaggaattttacaccaacctctatgacccagaggataaatcacctaagcaggtgagggtgagaggtcatctagtgaaatttgatgaggatactttgaatacattcctgaagacccttgtagttctagaagagggggaaaatttgtgtgcttattccaagttttcactcctgaggccagatcctcaagagttggctgctaagctttgtatcccagggaggggattcgagctaaatgctgatgggcagccgttgaagatattaaggaagaacatgaccaccttagctcagacatggagtgttctttccttctctaacctaattcctacgtcctacacatctgatgtcaccttagacagagtcaaattaatttatggcatcattatgaagatggatatgaatttggggtacctcatctcccaccaaatctctcttactgcacaacatgatacatccagactttga

SEQ ID NO: 11823 - DNA, 417 bp, Glycine max
  Peptide Sequence Number=SeqID_103508
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 11824 - DNA, 258 bp, Glycine max
  Peptide Sequence Number=SeqID_103509
atgacggtgaaaacctctgacacatgcagctcccggagacggtcacagcttgtctgtaagcggatgccgggagcagacaagcccatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcatgacgttgtaa

SEQ ID NO: 11825 - DNA, 683 bp, Glycine max
  Peptide Sequence Number=SeqID_103510
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccgatttttccctcagcaaacacaaaccaacccgccaaacgattgctcaatggacagttgcctcacatccagtgacagatcacaaaaggagcaagagattcaaaatggcttaagacacttcaacagccatgtgttcatggaacataaggaagccacagaagctcccaacaaccttaggaaccctgaactcaagtggtgtgaagatgggaaaaagaacaccttccttgccccattgagcaagaatgaagaaagaagaaactatgctgctgaaagcagtcccaacaacttatccatgtccattgggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 11826 - DNA, 1037 bp, Glycine max
  Peptide Sequence Number=SeqID_103511
aaacctcggaggaagaaacagaaacttcatcctccgtgctttccgatgaaaacctaaacttaatccaacaggatgaccaactatcatcaacagatgatgatgatgggcaaatcaatactctaacgagagaacaagatctctggtttgaagcaatcaattccatacccgacccccaggaaaagaaggtttttctggaaaaactcaagaaaacattagaggtaaaacctagacaaaaggattttatcacaaacaacaaatttgatgtaagtaacatactcaagagattagaaaattcttcaaccaaaccaacgacaatccaagatctccaaacagagataaacaatctaaaaagagaagtaaaagaacttcgtcaacaacaagaaattcatcagatcattctttctcaacttgaggaagacagtgattctgaaagtaccaacaacagtgaggaaaaccaaccagaaaatttagaagatgatatgtttatgggattaatcaacaagattaaaatccaaaaattttacataaacataaaaataattattaatgatttcgttttagaaacaatggccctatttgatacaggggctgattcaaactgcattttagaaggattaattcctacaaaattctttgagaaaacctcagaaaaattaagtacggcaaatggctcaaaattaaaaattaattttaagctatcaaatgcaatcattgaaaaccaaggtcttaagattaacacaaactttcttctgatacaactgggaaaaccccaagtaaaagaaagaattcaatctttattaaatcatattgaatcgaccgtttgttctgaattgccacatgcattttgggacagaaagaaacatattgtcgatctcccttatgagaaagactttagggaaaaacaaattcccacaaaagccagaccaatccaaatgaatgaagaacttcttcaatactgtcaaaaggaaatcaaggatttgcttgataaaggcctaatccggaaaagcaaaagcccatggtcttgtgcggctttctat

SEQ ID NO: 11827 - DNA, 682 bp, Glycine max
  Peptide Sequence Number=SeqID_103512
atgctttctttggggaatgtttttaatcaggaagacttgtttgcatttgcacgccgtgtcgaagaacgtttgcccaatcaaaaagtacaatatgaagtagaactaaaactcgatggtcttgcgatttcgctttggtatgaaaacggtgtgttaatacgtggggttacacgtggcgacggagaaaccggagaagacattacccagaacgttaaaacgattcgcaacttgcctaaagtgttgcattcggatcattttgaaattccacgactgcttgaagtacgcggtgaagtgctcatgccaaagtctggctttgaaaaactcaatgctgatcaagaagcaaaaggcgataaaacgtttgcgaacccacgtaatgccgcagctggtagtttaagacagctcgatccaaatattgctgctggcagacctttagcattttatgcgtatggtattgcacagtgcgaaccaaatcatggcttaaccaccatgcatgatagcctgcaatggctaacacaacttggatttgaaattgctgaacgtcagtatctatgtaattcaattcaggaagtacaacaacgctacgagcaaattcagcaagaacgtcccgatttacaagttgaaattgatggaatggtcgtaaaggttgatgacttaaaacaacaacaacaacttggttttttaagtc

SEQ ID NO: 11828 - DNA, 364 bp, Glycine max
  Peptide Sequence Number=SeqID_103513
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaatggataatgctttgattgatgatcgaaggatacacgtggattttagtcaaagtgtggcaaaactgtggtcacaatacaggcggaaagatcaaaagggtaaag

SEQ ID NO: 11829 - DNA, 147 bp, Glycine max
  Peptide Sequence Number=SeqID_103514
atggtgctaagcctgaatcactcactgcaaagcgtatattgcagaaagatttttggtgttgcaaaaagcgctaagtgccgctgccgcactaagccccaaatgcttattggattttacaacttcatattgggcttagcacgaggctag

SEQ ID NO: 11830 - DNA, 657 bp, Glycine max
  Peptide Sequence Number=SeqID_103515
atgaatgacaaagaacggtcgaaaatcttcgcgaaatcacccacggaaacgttacggaagcacctcggcttggattttcttcacgaaaacaattttcctcagcaatttcaacaaaataggggaggagcttgccacccagctcgcccaggcgagtcaggttgcttcctccagaagcaatcgccttctggaggaagaatctggaaggcccaagtgggcctgaatttcacggactgcgtaacaacgcttccttttgatttctggcatgtctcgggacttcacatattgtgcaacaacgggtgccaattctgtttctcttgtatgcaaagaagatatactgcaggtgatttgatccccatcgatttggagattaacgctacttgcaggaggcgcaacgcaaagagaattagaaaagttttgcaggacttagaagcagcagcaactccagaagaagaacctcgatcttccaaggcgtcttctagctttcctattctagggaaatctcaaacaaatttaattgaagaagttatcatggctgaagagccaaggagagtgaccctagaagattactcaagttccactgtgccgcaattctttaccagcattacacaaccagaggttcaggcacaaacaatcacatatcctccttctttgatatag

SEQ ID NO: 11831 - DNA, 514 bp, Glycine max
  Peptide Sequence Number=SeqID_103516
atggcttctccaccttcctcgcctcctcctcctccttccgatgcatcagcttcaccgtctgccgtgaagtggacacgcaaagcctcatgtctacgatccttgtctactagaccacctagtgctgagagaccagtggtccatgttgatcttgctatctgcaaggccgacgatccccacaggaagaaattaagaacatatttgagaattctggagcgtgataaggtggacgtcacgtacgagaattggaaggaggtccctactgctcataaggactttatttgggaggatattcaggcggaatttgaaatcctagaggcttctgacagtaggacaaaaaagaagctacttcagactgtcaacgagagatggaagcaatttaaatcagacctcacgaggaaatgggccctttcagccgatcaggacggtgtggacgacactgtctatgagaaatatgacataagtaaggaaaaaatacacccagttttgccagactcgcagagacccttcttgggag

SEQ ID NO: 11832 - DNA, 282 bp, Glycine max
  Peptide Sequence Number=SeqID_103517
atgactaatgcaaactgtctgcaagaatcattacattcagtctcaaatgggaatctaagaggtatgatagaggtagatggaatatgtgacaaccaagaaggattaggttgtgagtacaccaaccaacccactgcttccaaaaccagtaaacctgacctcttgagtggaggaggatgtgccagcaaaggattaggttgtgagtacaccaaccaacccactgcttccgaaaccaataaacctgacctcttgagtggaggaggatgtgccagcaaaggtgactaa

SEQ ID NO: 11833 - DNA, 111 bp, Glycine max
  Peptide Sequence Number=SeqID_103518
atgcagcttgtttgctcaagtgacctacgttctagagttgatctccaagtctgcccaattagaaatggtgtgttctacacatttggtggcggtgccataaacgacgagtaa

SEQ ID NO: 11834 - DNA, 465 bp, Glycine max
  Peptide Sequence Number=SeqID_103519
atgacaccttcgaccgaagatgtgaagaaagcgatgcaaggattgtttgctgtactccagctctctatatggggctggtttcacacctttttctccaagaaggtaggcccgtctatccgctacaaggaaggaagaatcaagattctatcttcatgcgaaggatgtccaaatgttcccttgatgggaacaaggggggttttagtgaccacaacgcgagggtactccaaggagtttgcaaggcatgggatgcggcgtgaagaaaggacagagagcttaggggaagcaactgtgagggacgatgaggttaaagcttcggaagaaagtgatgaggtacaagccctaaaggcagagcttgaaagagcccgagtagtcgaagagaagttcaagtccatagccatcaaaggcagcaatagtaagctcaagctccgaagaggtgaaaggaatcatcacgggtcaaaggcatga

SEQ ID NO: 11835 - DNA, 282 bp, Glycine max
  Peptide Sequence Number=SeqID_103520
atggttagctccatcttgtgcggtagctatcaacagtgtgccagtatactttccgtaaagccattggcatcatatttagctactttacaacaattcgatgcaccgcattcgtttggagaacaaggtcaaagttcttcagctgcaacaaccaacattgaaaatactaacatagaacaacaacatgatcatgacgtggaagaaccagacatactgcaaagaagaaatccgcgacgtaatcggcgtccaccaccttgtgggactagtcatcgtcttggtcattga

SEQ ID NO: 11836 - DNA, 327 bp, Glycine max
  Peptide Sequence Number=SeqID_103521
atgaggatcaaaaggtcttttaaggttgtaatggggccaaggacaaggtatggagaaatatggaataagtggctaaatcccaaaggaatagaggagcaaaggggagcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattataatgatggatggctcaaattctcacaaaggtaaaatcatcactttcaaattgagctttcaaaactatcatgacatgtag

SEQ ID NO: 11837 - DNA, 471 bp, Glycine max
  Peptide Sequence Number=SeqID_103522
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgatcatgctcagcggccaggctttgtgcgctcagcgtgttga

SEQ ID NO: 11838 - DNA, 117 bp, Glycine max
  Peptide Sequence Number=SeqID_103523
atgttggctttcatctgttcctgtacttcctcttggtcacccatcatcctagatttggatctggaaggtattaccacctcttacgtttgtctcgaaagacaacagccttatttctag

SEQ ID NO: 11839 - DNA, 309 bp, Glycine max
  Peptide Sequence Number=SeqID_103524
atgacgctgccaaacataatcaccgcaatacagtcatcaattacagataatgatgttacacctataattactgcactttggtatcgttgtcctgtatatgaattcagtggtcaagttcaatataagacaattcaaattattgaagaagaatgtgttttgtgcatgtttcatacatttgtgaatatggaaagtgtaatatgtttggaacttaaagttgatgtttataattcattatcacctactcaagttaatgacctaagttggcccaagatggagcagaagaaggacaattccctaaaattagaatga

SEQ ID NO: 11840 - DNA, 315 bp, Glycine max
  Peptide Sequence Number=SeqID_103525
gtagttgtgtctccggcaaaaccaccttcaaagccagatccggaggtcgatgtcgtcttttatacgatttgcattgaaatacctcccaacgtacaacaccaatttttaattcggttactcgcatggaacagtgctttaaaaggtcttgatgatgctccacagcctaaatcagaagtgctccgaatgctaccggtggcaattgtcagtcaagcattcagatacaaagatagtactgagtgcgggaattctgactatgtctatgcactggatgtcccgaccatagtccattcagaggtttggaactcgtttgagtga

SEQ ID NO: 11841 - DNA, 593 bp, Glycine max
  Peptide Sequence Number=SeqID_103526
ggggaaacgctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtacctttttggaggatgttgtattcagtgatgagaattctgtgctaattgcattttccatcaacttggcatctatcaaaatctctgcttgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11842 - DNA, 550 bp, Glycine max
  Peptide Sequence Number=SeqID_103527
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacagcggataacaatttcacacaggaaacagctatgaccatgattacgaattcgagctcggtacctttattttgcctcgccctcccgttgaagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11843 - DNA, 105 bp, Glycine max
  Peptide Sequence Number=SeqID_103528
atggaggagttacaaggagaaaaagatgaagaacaaggaattaaactctatgtagagcttgtaggccttggatcttcttcatcaatggagtcatttgcttcttga

SEQ ID NO: 11844 - DNA, 642 bp, Glycine max
  Peptide Sequence Number=SeqID_103529
atgcgcaccagtatgaccaccttgacccagatgtggatgacattgctgctcagcaatgtcctgcctagtgatcataactccgaccttcctctaccgaagtgtcaactggtgtatgccatcctgacacggatgagcgtccatgtgggtatgccacccaccaggtaccctttagacccagataagtctaacagggctctggggtttccagcattgatcatgggcctctgccagtcattcggggttcccgtcaaacctagtaaggtgatccgaccgccaatcacccaggccttcattgagaagtattgcacgcctaggcaggcacagggtgatgcaccacaggccgcagacgcaccgccaccacctcatcaggttgatcttgctgggtcattagtcatggagcggtatctacaacacttggttcgccaacaggcggccgaccattgggggcaagtgcagatacatgagtgtctctaccagctcagcctcaatcagtttagggctgaggtcgcatggcccagatattggcccgaggcccaggcatgggaggcgcctgcaggagttcccggcgatgcagaggaggcccgcatggatgaggagatgacgaacttgctcggtttcttgggagggagtggagccacgtga

SEQ ID NO: 11845 - DNA, 312 bp, Glycine max
  Peptide Sequence Number=SeqID_103530
atgaatgctctcttagaatctaagcttttgaatcctagaaaaaccatgatttgttggcagcccaacctcattacaagcctagaaagagatgaaatgcaaaggagcagtcgcgctaagcggaccctgtggactcagcgcgcatccaccgctaagcgtagcttcagcgcgcttagcgtgacaagggaatctggaagagcacaaggatcaaggctgcgcgctaagcgcgagatcagctcgctaagagagacatttgtctcttgccaggctcagcgcccgactggcgctatgctcaaattcacttactcgtgctaa

SEQ ID NO: 11846 - DNA, 306 bp, Glycine max
  Peptide Sequence Number=SeqID_103531
atgaagccatgtaaggtttctgaccagaatatagcacacaaaatgaagtttgggaatcaagaattatccgtactcacaaacgagtctcactaccctgttaagaagggtataatttgcaccctatacaatttctgcatagcagataaccaaggagtccccctccttataaaagcttctctttctgggaaaggttacacagcttttgtcctattatcaagacctcacaaaggtgtttataccaactttaaagaccttttccttgcaaaggagggtattcaaagcccaatctacaaaggattctattag

SEQ ID NO: 11847 - DNA, 507 bp, Glycine max
  Peptide Sequence Number=SeqID_103532
atgaaaagagaaaaacatgcctcctatagtagtcataactcttgcaagagcctaagtgaagaacttcatgactattacgaagaaagccataggtcacatcttagacctcactcccatagaagagaaaaggaaagaaagcctcaagaggctaacattaacctcccatacttccatgggaaggacaatgtagaggctaacttagattgggaaataagggtagagcaacaacttaaaaagaagtctacatcaaaatattatggctctcactcttatccaaagaaagaccaaggccaaggcatcctacgggtgacaccttctaagagccaacatgataaggggaagacaatagaaaaagaaccccttaaggctagtatgcatgagaagactagctccatgaagtgctttaaatgtcttggaagaggacaaattacttctaaatgccccactgtcgcaacctacccttcggcgggagggcgacgcgagactcgcgggatgcgtgttccatga

SEQ ID NO: 11848 - DNA, 237 bp, Glycine max
  Peptide Sequence Number=SeqID_103533
gtcgactctagaggatccccttgtggtactagtagagggtacatctacttgggttgttatactgagaataagagagggtacatctcttgtggatcagctcaagtggagggtacatccacttggttgtttaaagagaacaagggagggtacatcccttgtggatctttggcttgtaaaggattttacaaggttggaagaaatctcaagaaccgttggttgtttggggacttgatgtag

SEQ ID NO: 11849 - DNA, 274 bp, Glycine max
  Peptide Sequence Number=SeqID_103534
ggaaagggaagaatcaaaagaaatctcagactgtatcggtttgaattctttgaaaagggagaagggagacacaaaagaattcaggcggttagtccttcgttcttttggaaaagggagaagagagacacaaaaagaattcaggattcaaaagaaagcaagcttcatgatgatgaatcaagttgattcaagtagttttgatgatggcaaagatgatgacaaaaagctcaagagaatgatttcaagattgagtcaacaagttcaagatcaagagtaa

SEQ ID NO: 11850 - DNA, 180 bp, Glycine max
  Peptide Sequence Number=SeqID_103535
atgggggtgcaaatagcaaccaggcccacttgggacctccggacgaaattaggaaaatctaagccgaggcacttccgaaacgtttccgtaacgttttccgtgaagaatttcgcaaaggtttcaatcgttcttcgacgttcttcattcgttcttcatcgttcttcgatcttcaatgggtaa

SEQ ID NO: 11851 - DNA, 228 bp, Glycine max
  Peptide Sequence Number=SeqID_103536
atgcccgtccccccaacaagggcatgccatcgtgatatagggatctcgcctgcaagacacccagtagacccagagaagtccaatagagttatggggtttccaactcggagtgcccgtcgcccccaacaaagtcatcaggaccctattaactgggctttcatcatgaagtactgcacccccaggcaggcgcagggcgagacaccacaacagtctggggacggccagtag

SEQ ID NO: 11852 - DNA, 483 bp, Glycine max
  Peptide Sequence Number=SeqID_103537
atgcggctaccacaagagcccttgaacaagaaaccaagagggctcgcaaggaagagcatggccgagacaaattccgtggagctttgtggggcagcaacagagttagctgcttgctcaagatccaagagaagcttgtctcagcgtttatgcgagacagagaccaacatgttagccatcatcagcaagtaccaagaagaattaaatctagtcacggcccacgagcacaaagtggcggacgagtatgcccgagtgtatgtggaaaaggaggctagaggaagggtgatcgacttgttacatcaagaggaaaaaatgtggatggacctatttgctcttactttgaacaggagtcaagaacttccccgattgctagccaaggccaaagcaatggcgaacaccaactccgcccccaaggagatccacggacttcttagctattgtcagcatatgatagaattaatggcccatataattagaaaccgctag

SEQ ID NO: 11853 - DNA, 825 bp, Glycine max
  Peptide Sequence Number=SeqID_103538
ggaaaagagggaggtggttgccgcccagctcgcccaggcgagctgggttgcttccaacagaaggcaccgccttctgttggaacatcctggaaggctcaagagacaagactcaaggaaatttttgatagtattcctaccttggacgagcttcatgctctgggtggagagggtttaaaggctgatatcattcttgaggatttggagaaagataaaaagctatacatgttaaagaaattaattatggcattagttagaggattaaactctaatccagctgccataattaagaagatagttggattagtttctgatttttataagcgtcccaatgtggaaagtccagcaaaagctgcactagatgaaagctctcacatgtttgagaatcgaggagtccaaatgctggggcaaataaagcatggttcttgccgtcctcgagctatcttatttaaagtattagctgatactattggtcttgaaagtaggctcatggtggcacaacggcatatattggctggtcttgcctcagttgttggtgatttaagtgcaccatatgagaaggcttgtcatgtacatgagagccccattgtgaattggctttgggctgttggttgtcattcatttggaccattctctaatacatctcacatcagtcaaatgctcctagataggaactcaatatatgcccgtgtggattctgtgcttcataaaattcgtgatacgtcagagaacttcagattatttgggtatcgtgatcctggttcagaatattcccagattgtgttggtttcttcctatgctaatttctccaacaggatctatatttga

SEQ ID NO: 11854 - DNA, 313 bp, Glycine max
  Peptide Sequence Number=SeqID_103539
atgcagcaacaacagcaacagtcacaacaaagacaacaagcaactaaggctcctcctcaaccttccttagaagagttagtgaggcaaatgaccatccaaaatatgcaatttcagcaagagacaagagcctccattcagatgaagaatccgaaaaatgtgagtgccatcaccttgaggtctagcaaccaaattcaagtgcctccaccagtagcagcacctgcacctgtacctgtcaagcttcattctacacctgaaaaagaggatgagatagttgcacaaaagagaaagtttcctaacaaaaattttcatgcag

SEQ ID NO: 11855 - DNA, 408 bp, Glycine max
  Peptide Sequence Number=SeqID_103540
atggtggccataaccccacctagggttcctcaacctccatttttccaaggatatgactcgaacgcaacatatgcatatcatggaagagttctgggacattccattgagcattgtatgaccttgaggcacaaggtgcaaggtcagattgatgcgggctggctgaaatttgaggagaatcgcgttaaaaaagaagaagaagagttgacttccaagactattcaatcagagattactcatcctgcacgttggcggggatgccgtaaaatgatgagttgtgaaaagaaaacaacgatggatacctcagagccctacactggggtaatgaaaggcaccatgcataaatctcaagcgaacctaggggcagattataagttctcacccaataggttcccagctacaaggtcatga

SEQ ID NO: 11856 - DNA, 360 bp, Glycine max
  Peptide Sequence Number=SeqID_103541
atgactcattacacgttgatgaggtgcaagcaaatcgtaatgatcatgatgaaggactatgggaaaacaataatcatggcaacaccaccagcatcccctccgcggtccaatcagcagtcagaggcgatgtctaggaatactagacgatccacatggctcaggatgttgactagaagaaccttggatcagctgcgacctattgtcaccgttgatgctgcaactgggcgaggatcgagcccacataaagagaaattccacagctatttaggtgttgtagttagagaaaaagttccaattgtacataacagttggaaggatgtaccggacacactaaaggagctagtatggaatgacattttg

SEQ ID NO: 11857 - DNA, 610 bp, Glycine max
  Peptide Sequence Number=SeqID_103542
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatccccgggaggttatggtagaagtaacggtggtcgtaatacttcatctgatcgcggtggtggtgacggtggttttggcagaggccgcggtggaggcaggtcctcaaacacttgggttaatcctaactccaagtctgttgctcagccaactaatcaacctagtgttatgctaacaaactcagcatctcatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 11858 - DNA, 555 bp, Glycine max
  Peptide Sequence Number=SeqID_103543
atgtgtcacaaatttgcatttgaggcactagataaaagtcttaaagacatcatgcaaaacaatcttccttttggtggaattgcttcattactattgcctggtggtcagaccgcacattccaaatttgctataccagtccctgcaacagaaaattcaacatgcaatattcatcaaggcagtgagttagctgaattattaaaggttacaaaactaatagtctgggatgaagcaccaatgtgtcacaaattttcatttgaggcactagataaaagtcttaaagacatcatgcaaaacaatctgccttttggagggaaaattatcgtttttggtggagatttccgacagatcttgccaattgttccaaaaggtaatcgctcagacatcatccatgcaactataaatgcatcatacatttgggaccattgccaaattcttaaacttacaaaaaacatgagattgctatcaaatgctctccaacagcccaacaatgaagaactcaaacaattttcactttggctacttgacataggagatgggaaaaattggataatataa

SEQ ID NO: 11859 - DNA, 246 bp, Glycine max
  Peptide Sequence Number=SeqID_103544
atgtcattctccctagcagttgaggcacttcatgcattcatacaagatgaatcagagcacaaccaagcaaggaaagtgttaagtgtctgccctactaacttaacctctttaatgggtacaggaatgggagcatctacatctctaacctccttattacttgatcatgcatcaaagggatgttgtgcatggttatggacccctcataaacttttcgtagggcaaccaggcaaggaggattttcgttga

SEQ ID NO: 11860 - DNA, 270 bp, Glycine max
  Peptide Sequence Number=SeqID_103545
caaaagaatgtttatacggataaccactcgggtatttccgcccgtcagcgtgactcaaacgtcagtatgacagatcttgtgagcgcggaagaggaccaaaagaatgtttatacggataaccactcgggtatttccgcccgtcagcgtgactcaaatgtcaatatgacagatcttgtgagcgcggaagatgatgctttctgtcttacagattgcaaaagaatgtttatgaaagtgcggacaaccacttgggtatctccgcatgtcacgtga

SEQ ID NO: 11861 - DNA, 570 bp, Glycine max
  Peptide Sequence Number=SeqID_103546
atggccgatttcgatctgggcaacactgccatcacctcaccggtggacggcaccgtggtcggattgaatatcttcactcaggggggcgtcgtgggagcgggtgaccacctgatggacgttgtacccagccaggcgacattggtggtggattctcgcctcaaagtcgacctgatcgataaggtgtacaacgggttgccggtggatctgatgtttaccgccttcaaccaaaacaaaaccccgaaaattccgggaacggtcacgttggtttccgccgatcgcctggtcgacaaagccaacggcgagccttactaccagatgcaggtcacggtctcgccggagggcatgaagatgctcagtggcgaggacatcaagccggggatgccggtggaggctgccggtctggttatcggcacccttttgtttgcgatatctgcgccggtttattcgatagggattttagacgcatattcgctggcattagaaaaggacccgactttccgggcggctataaaagagaaagaagcgggagatgagaacgaaaacatcggcagggcggggctgctgccgaaa

SEQ ID NO: 11862 - DNA, 453 bp, Glycine max
  Peptide Sequence Number=SeqID_103547
atggcctctggtaatcgattaccaaggatcgtgatggcagcgcagttaatccatgatcgcgtggtgatggagtgcctagagggagtttgggagaccctcgaatgcaatgagaggtgccgattctgtggcacgattcgactcactgctacttcattggtacatccagaggtacccgcacgcatgcttcagcagcctgtggagtggatactacctacacctactccatatcgactagtggagccagtccaagtgatagaggtgtcatcctctaaagaggacccagaggagttacctcctgagcttgctatagatgctcttgactttctagaggatgatgaggacccactccctgacgtggattctccaaaggatatcatgtcagcatctgaggcagacactatagaggagagcggccttggagggatagcgaatagtgaagactcttcatcatag

SEQ ID NO: 11863 - DNA, 282 bp, Glycine max
  Peptide Sequence Number=SeqID_103548
atgacagatcttgtgagtgcggaagatgatgtaaatctccgcgtgtcaacgggcttgtcggccgcgattgacgaagggtgcagaatgaccataatttgtctctgcgtgccatcggacacgactgtgtctgaatggcaaaggggtgcggataactgtaaggtgtctccgcaggctaccagctcttgggtcatggtaacaaaaggtggtgtggtcgacaaaagcgaggctcttgctcctacgtatcctccaatgaggaactcagacctacgtagttctggataa

SEQ ID NO: 11864 - DNA, 243 bp, Glycine max
  Peptide Sequence Number=SeqID_103549
atgtccaggatcatcaccgggttcaagtaccacttccttccttttcttgttggcttgcctggcatagctttcgttcttctttgcaatttgcaccttcacttggtcataaaatcttttaacatacgcaactttggcctatgcatccttatgttgagtctcttggggcttgctattgtggcagtccatgaggaatctccttgggaaagacatcttcaaattcctgcaataagggttgaacactag

SEQ ID NO: 11865 - DNA, 842 bp, Glycine max
  Peptide Sequence Number=SeqID_103550
atggtgctgtttatcgccttcttcagccatatctcttccgacgccgcgctggtgatcatgccgccgatgggggcgctgatcttcctcgccgtcgggcgtcacccggtggcaggactgctgtcggcgattgccggcgtcggatgcggttttaccgccaatttgctgattgtgactaccgatgttctgctgtccggcatcagtaccgaggcggcgaaaaccctcgatgcggccatgcacgtcagcgtgatcgacaactggtactttatggcaagctcggtcattgtcctgacgattgtcggcgggctgattaccgataaaatcattgagccgcgcctggggaaatgggaaggccgtagcgatgaaaaactggagacactgagtaaagaacagcgcttcggtctgcgcgtggcgggcgttgtctcgctggcctttatcgcgctggtggcgttgatggtggtgccggaaaacgggatattgcgcgatcccgttaaacataccgtcctgccctcgccgtttattcagggcattgtgccgttgattatcctgtttttctttgtcgtatcgctcgcctacggtatcgccactggcaaaatccgccgccagggcgatctgccgcagctgatgatcgagccgatgaaagagatggctggctttatcgtgatggtgttcccgctggcgcagtttgtggccatgtttaactggagcaacatgggcaagtttatggccgttggcctgaccgacgcgctggaagctgccgggctaagcggcgtaccggcgtttgtcggtctggcgctgctctcgtcgctgctgtgcatgtttatcgccagcggctccgccatctg

SEQ ID NO: 11866 - DNA, 249 bp, Glycine max
  Peptide Sequence Number=SeqID_103551
atggagcagtatttgcggcatttggttcgccagcaggcggccaaccaccgggcacatagtcagggttttacttcttttccgtgccagttcagggcagaggtcgcatggcccggagattggcttgaggcccaggcaggagaggcaccagcagaggcactagcagaggctcccgacgaggcagatgaggcccgcgaggacgaggagatggccgatttacttgatttcttaggagggagcagagccacctga

SEQ ID NO: 11867 - DNA, 387 bp, Glycine max
  Peptide Sequence Number=SeqID_103552
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccgctgaagcaagggattctgcagatatggaaaatagggatgctgatacaaaagaattgggagatcggcaccttgacacggttgagagggtaccgagctcgaattcgtaa

SEQ ID NO: 11868 - DNA, 789 bp, Glycine max
  Peptide Sequence Number=SeqID_103553
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccttggacgaggtttcttgagggataaccacatgaaacaggggtatgcatatgtgataggcacaagggtcatgcttccaagtagtgttgatagtcttggaaggaaagggaacgtgactgagataaaaaatgtcagccccccgaagaataatcttatgcatgttctcactaatggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 11869 - DNA, 510 bp, Glycine max
  Peptide Sequence Number=SeqID_103554
atggtaactgtggatatcggttcggttcccagtttattaggtatgggtgaagactcttggttggtggtcctctaccatcttcttaaagaacttgggaaattctcagaagactatacccgactctttggtggcacggagagatttgaggaattaaggatgtcactacatgttgatgggttaaccaaggtgactacaaataagtggatggatataacggacatgggacatgtcaatgcatcaagatataatgtttatttaaaagaacgttgtcctttaccgcctgtagcattgaagtttgacatttcttccggatgtaccatggatgaactgaaggatttgatcaagcaagttgtgcctcatgggattcccccttatggtattgatcaagaaacacaaacgatgttaattgagtctaactactggaaaaagattgagccaatagaaattttagttatttttagtaaacctgtaatggaaatggaagacgagttgtccttgtcgcaaaattag

SEQ ID NO: 11870 - DNA, 480 bp, Glycine max
  Peptide Sequence Number=SeqID_103555
gcggacaggtatccggtaagcggcagggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11871 - DNA, 834 bp, Glycine max
  Peptide Sequence Number=SeqID_103556
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccacaggtggcgctggagcaaatctgccgactggtgcgcgaacccgatcgcgtggcggcgtggcgtatcgggccggaaggattaagtgccgaagaggcgcgccgtatcggctttcatatccgcgtcaaccgtccgtcggcgctgtttgcccgctgctggttgctggtagagggtgaaaccgaagtgtggatcatcaatgagctggcgcggcagcgcggctaccattttgccgcggaaggcgtgaaggtgattgagtttgcgcagtccggactcaagccgctgctgaaatatgcgcgccgcatgggtaccgagctcgaattcgtaatcatggtcatagctgtttcctgtgtgaaattgttatccgctcacaattccacacaacatacgagccggaagcataaagtgtaa

SEQ ID NO: 11872 - DNA, 386 bp, Glycine max
  Peptide Sequence Number=SeqID_103557
atggaggatttccttgagggtccgaacttaggcaatcatgaaacatcgaattcctgccgcccgggggatccactagttctagagcggccgccaccgcggtggagctcccattcaccctatagtgagtcgtattacaattcactggccgccgttttacaacgtcgtgactgggaaaaacctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 11873 - DNA, 1029 bp, Glycine max
  Peptide Sequence Number=SeqID_103558
atggcgaaggtggtggatgaccaaaattttctccgcgtgccttcggacttaattgtctctagatggcgaaggtggcagatgaccataatttttctccgcgtgccattggacttgattgtatctggaaggcaaggaaagtggatgagcataatttgtctccacatgccaataaacttgattgtctctgaaaggcaaggaaagcggatgaccataatttgtctctgcatgccaatggacttgattgtctatggaaggcaaggaaagcagatgactataatttgtctccgcatgctaatggacttgattgtctctggaaggaaaggaaaacggatggccataatttgtctctgcatgccaacagacttgattgtctctggaaggcaaggaaagcagatgaccataatttgtctctgcatgccaacaaacttgattgtctctagaaggcaaggaaagcggatgaccataatttgtctccgcataccaatggacttgattgtctctggaaggcaaggaaagcggatgaccataatttgtctctgcatgccaacggacttgatagtctttggaaggcaaaaggtgcggatgaccatgttttgtcttcgcgtgccaattgacttgattgtctctggaaggcaaaggaaagaggatggccataatttgtctccacatgccaacgtacttgattgtctctggaaggcaaaaggtacggatgaccatgttttgtctctgtgtgccaacagacttgattgtctttggaaggcaaggaaagtggatgaccataatttgtttcagcgtgccaacggactagactgtctctggaaggcaaggaaagcggatgaccataatttgtttctgcataccaacggacttgattgtctctcgaaggcaaggaaagcagatgaccataatttgtctctgcatgccaacagacttcattgtctttggaaggcaaggaaagcggatggccataatttgtcctcgcatgccaatggacttgattgtctcttggaaggcaaggaaagcggatga

SEQ ID NO: 11874 - DNA, 348 bp, Glycine max
  Peptide Sequence Number=SeqID_103559
atggctccgaagaagcttttagccaagagttctaggaaggatgccactggagagggttctagtgtggcccagcaggcagatatggactttgatggacacagggacaaggagtatgctgagttccaaaaggagatagcctggaggcaatgggctcagctcatatcacccatggctaagttcgattcggagatagcctccaacttcgatgaggaggtgtcataccctaatttcgtccggggaccattgtttggtggcatgcaaccttcgcttgaccgcctcgagaacattttggaagttgggttgcttaaggaggaagcaactgggcagcaagctcctccatgtttttga

SEQ ID NO: 11875 - DNA, 276 bp, Glycine max
  Peptide Sequence Number=SeqID_103560
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaaaaatttgcaatcagcaagtctgctgtggaagttgctgttagcatgaagcttcaagatgatgctattcctgctcttgaaaagcttcggaagggaacaccctcatcttcggttgtgatattttga

SEQ ID NO: 11876 - DNA, 498 bp, Glycine max
  Peptide Sequence Number=SeqID_103561
cagcaagggcatcaggcccctactaatcgagctttcatcaagaagtactgcgtccccaggcaggcgcagggcgaaacaccgcagcagcctggggatggccagcagcgagcaacagacgcaccgccatcacctctagagttcacctcagctgatccacgaaaaggacatcccctttatccccgaaccgctggccaaaccctgacatatatcgtgaccagccgttctacaagccttgagccaaaatcccaactcaccataatccttaccctcggaagaaaacacaaagagaaggaaaattcccaatccaagaaagggagaagacacaaaaagaaaagaaaattcccaaaccaagaaagggaggagactcaaaaaaagagaaaattcccaatgaaagagtgggagaaagcaaaaaaaaaaagagaaagaaaattcccgatcaaggatcggaagaaaacagaagaaacatgcagaaaggtctttagaccagacaatatttga

SEQ ID NO: 11877 - DNA, 192 bp, Glycine max
  Peptide Sequence Number=SeqID_103562
atggaatgtttcatccctctaaggttgcggcaaaggctgtcactttgtccattaggcaacaatttggtcagccttggcctacatggggagcgattccaaaagaacatcaagaactttttttccaacgttttaagagaaaattggtctggagaccccaggaagagaatgaaatacaaaaagcttttaacttga

SEQ ID NO: 11878 - DNA, 150 bp, Glycine max
  Peptide Sequence Number=SeqID_103563
atggtgctggatccagcaaggctggtgctggtgcttttgatcagcacctgcattttggccatcaatggtgacacagatccaaatgacgctttgcacttttcatcactctgtgtgtgtgaccattgtggggtaccgagctcgaattcgtaa

SEQ ID NO: 11879 - DNA, 561 bp, Glycine max
  Peptide Sequence Number=SeqID_103564
atggaagaaagcatgtctcctttccttgtgagggatttcggcgcacaaaatttcaaggctatacaagcaatccataaggcatgggaaaccccgttaaggaaagatcaagaacttaggggcattcgtaatggcatcattggtgggtaccatgaatggctgaaagttcatatacgaggtttagattggctcgccaagttaaaagtcatcagcgaagagagttttgaagcaccggaagaggacgaagaagtccaagctctcaaaagcgagttaggaaagacaaaacttgccaaagagaagagtgtgccggattacgggaagagaatgcaactaccgcacgagcccttgaacaagagaccaagagggctcacaagaaagagtatggccggaacaaatttcgcggagctctgtggggagttagttgcctgttcaaggtctgaaagaagcttgtctcagcatttatgcgagacggaggccaacatgctagctatcatcgccaagtaccaagaagagttaggtctagccacggcccacgagcataggatcgcggatgagcatgcctaa

SEQ ID NO: 11880 - DNA, 189 bp, Glycine max
  Peptide Sequence Number=SeqID_103565
atgcctcacgggaaattcaagcaccatggaaagttcaagcatggaaagttcggcaagcatgggaagtttaagcatgggaagtttggcaaggcctttgttgattttattggactgagaacggagtcatcacattgtctttatatgaacaactataaaccgtgtatcttggagacttggatgtatatatag

SEQ ID NO: 11881 - DNA, 610 bp, Glycine max
  misc_feature (105)..(105): n is a, c, g, or t
  Peptide Sequence Number=SeqID_103566
cgcacgagggagcttccagggggaaacgcctggtatctttatagtcctgtcgggtttcgccacctctgacttgagcgtcgatttttgtgatgctcgtcagggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtacccaacgttggcgccaaatcagacaacacttcgaactccacgttggcacaatgcaccaaagctcgtgctggcctcacgttaaacgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11882 - DNA, 150 bp, Glycine max
  Peptide Sequence Number=SeqID_103567
gttcaggttttgatgatgccgaaaagaatcacttgacaatgattgtcatcattaaaaagggggagaatgtgaatcatgcatgttttgatggtgccgaaaagagtttgcttgataatgattttcatcatcaaaaaggggaagaatgtgaat

SEQ ID NO: 11883 - DNA, 774 bp, Glycine max
  misc_feature (170)..(170): n is a, c, g, or t
  Peptide Sequence Number=SeqID_103568
atgtcggcgccgcgatcgcagggcagggcatcgccattggttctccgatcgtgttccagaccgagctggacagcgggcgtttggtgcaggcgcatccggggttggcctgcgacggtcgcagcttctggccgccgaggcgcggcatgcagcccgccattacctggcccggncggtaatgccatgagccagagccccgaactgctccggcgcctgctgcgcgccaaggaccggatggatcgggccagccatgaggaatggcccgtcgcgcgcctggctgaggtcagtgcggtgtcgccggcgcacttcgcccgctcgttcaagcaggccttcgggctgccgccgcaccgttatctgctcagccgccgcatcgaacgagcggtggcgctgctgcgtgataccgatctggcggtgaccgaaatcgccgcgcagaccgggtggcgcagcctgggcacctttggccgcatcttccgtgacatcaccggtgacagcccgggcaatgtgcgcgagcgtgagcgtgcagcccaggcggcgtcggccagtgtgccggaatgccacgcacgcgccgcgcagcgcccccgcctggacacatccgtgctggaacaacgtcgccgtcgcgcgccggcggtggcactcgccgtggagcgtcaggccggcacggcaggagcggtacaaggactgccggcatcggcttcagggtcactcgcggcgagcacaccttcaagaccagaaacgtcggtgtccaggaggcaggtcgcaaacatcaggaagcggtag

SEQ ID NO: 11884 - DNA, 574 bp, Glycine max
  Peptide Sequence Number=SeqID_103569
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctaattcagatgatcttgtaaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 11885 - DNA, 627 bp, Glycine max
  Peptide Sequence Number=SeqID_103570
gatccccggaaatagtagagaaattctgaagaaatacttccctgaatcaaagacagctgaaggcaaggcagctatttcatcattccatcagtatccagatgaatctttgagtgaagcgcttgaatggttccgtgggttgctgcgaaagacacctactcatggattcacagaacctattcagttgaatatcttcattgatggtttgagaccgcagtccaagaagacccaaaaagaagcaatggaattggaatcattcactaagacactcaacaagttgccaacacagttacaagcggctcagccctctcattcagctattatgcaagttggaggctgcaatatttatggaggaggtcatgaatccggctgttgtataccccaagatgattctgctaaaaagcaaggagtgaacttcaatcagaatcaagggcaaggatggaggtcacatccagggaatcagtttaacaaagatcaaggaggaccttccaatagaccccctaatcaagggccttacttgtatgagaggaccaccaagctggaagaaactttggctcaatttatgcaggtttcaatgtctaatcacaagagcactgagtcatccatcaagaacctggagatccaagtggg

SEQ ID NO: 11886 - DNA, 779 bp, Glycine max
  Peptide Sequence Number=SeqID_103571
atgaattcattgcatagtgctgttcatgtgtcctccaccttcgagtttggagccccgcgaattgactgcctagcgctgttcgccaattctccattctccacttttgttcggagccccatgaattcattgcctagcgctgttcatgtgtcctccaccttcgagtctggcgccccgcgaattgattgcctagcgctgttcgccaattctccattctccacttttattcagagccccatgaatacattgcctaggactgttcatgcatcctccacaaacgagtctggaggcctgcgaattgattgcctagcgctgttccccagttctccattctccacttttattcagagccccatgaattcattgcctagcgctgttcatgtgtcttccaccttcgagtctggagccccgcgaattgattgcctagcgctgttcgccaattctccattctccacttttattctgagccccatgaatacattgcctaggactgttcatgcatcctccaccatcgagtctggaggcctgcgaattgattgcctagcgctgttccccagttctccattctccacttttattcggagccccatgaattcattgcctagcgctgttcatgtgtcctccaccttcgagtctggagccccgcgaattgattgcctagcgctgttcgccaattctccattctccactttaattcggagccccatgaattcattgcctagtgctgtgcatgtgtcctacatcttcgagtctggagccccgcgaattgattgcctagcctt

SEQ ID NO: 11887 - DNA, 330 bp, Glycine max
  Peptide Sequence Number=SeqID_103572
atggcagtcgaaaccggatatgttgtggtcagaaagggtgaagagaagatgacgtttgccaatgcaaaagacgcagatgcatgggacaagatgctcgatatggccgacgcgttcaccgactggctgcagcaacatcagccagcgatggatgaggcccaggcagaagcgctgggcatgctgctggccgaacagaaagacgcggtgcaacacattctgcgcaccagcaaactgccggacgcggtgaaagacagcggcgaaaccgctgctgacgacagcgatacggctgcgccggaaaaagagaagaaggtgcgtgcggtcaaagccgcctga

SEQ ID NO: 11888 - DNA, 285 bp, Glycine max
  Peptide Sequence Number=SeqID_103573
atgggggtgaacttatcaagatcttgcacggttttggtgaaaagtgttttccggggcttctggagctttcgtaatgcttccataaaatttctgaaaaccttggtgggattgcttatggaggaagcaacgggcgagctgggcagcaacctcctccccccttttcctataaataggcgaagggagactgttccaaatatccctaacccccttggctatgcatttcagctgttttgggtgaaaaaaattgtttctgtgaagaaaatccaagccgaggtgcttccgtaa

SEQ ID NO: 11889 - DNA, 96 bp, Glycine max
  Peptide Sequence Number=SeqID_103574
aaagaaccacaagaagcaaaaggggaagaatctagtgaagaaatctacccccaagaagaaggacaacctttaatggttaaggaggagtgtaaggag

SEQ ID NO: 11890 - DNA, 436 bp, Glycine max
  Peptide Sequence Number=SeqID_103575
atggttagaacacgaggtctacgtcgtgtggtaggtagaggtagagaccttagtcaggatgtggttgaggatgttcctcggcgtcgtaggcccactgcctcagcacgtaggcagcgggttacccagaaagtcgaggatgttcctcagttgcctgaggatgttcctcagttggctgaggatgtgcctcatgcgtctgatggtagcccagagaggacagcaactgccgatgatgctgagatagatcgattggctagtgatgggacaactgatgatgatgaggggttccccggtgggccacgcgatccatctgttttgataggatttgctgatcatgtggcacacaacatatggagtggacaggagcaagccgatctcaagttggtctcccatggtaggaaagtagataaatttgggagaccggctgctgagatcgaag

SEQ ID NO: 11891 - DNA, 496 bp, Glycine max
  Peptide Sequence Number=SeqID_103576
ggagctagatgagctaatccaactttgtataagagtggagcaacaacttaaaagaaagccttcttcaaaatcttatggttttcactcttatccaaggaaggaccaagcccaaggaattttcagggctgcaccttcaaaacccaaggaagataagggtaagaccatagagaaatccacccataatactagttccaaagaaaggactagcaacattaaatgcttcaaatgtcttgggagaggtgtttcgatgataacaatgatgacaacaaaagatgatgacaaaggtgatgaacaaaaagctcaagtgaatcaaagaacatctcaagtgaatcaagaacaagtcaagagttcaagaatcaagaggaattcaagactcaagaagaaagtctacaatcaagaatcaagaatcaagattcaagatctcaagaatcaagatcaagattcaagactcaagattcaaagaatgaagaaaagactcaatcaagataagtattaa

SEQ ID NO: 11892 - DNA, 627 bp, Glycine max
  Peptide Sequence Number=SeqID_103577
atggtggttgctggcaggataaagcagctaacatcactgcttgcaaatcacaatgcttttgagttacttgctaaatatgggacaactcatctcattttcaatgacgatatacatgggactgcatctgttgttgtagctggagttgtagcagccctaaaactcattggtggtacattgcctgagcacacattcctcttccttggtgctggagaagctgttcactgttctaaacccgaggttgttcttctacaacccgaggttgacttccttaagcttgtgctggaatttcttcctgaactgcttgacactttgaaggacgaggggtactctttgaccaaatctgaagaggcagtgtttcttccatgcttagtagagaagggaaaagagcttgaggaattgggaacatatgaagagggaaatgaaacaacacctacaaagtcaacccctcacatgtttcgcaaaactcttacaacctcagataccaacactcatggggggttctttgtccctcgcagagctgttgaagactgttttcctcgtttggattataagcagcaaagaccttctcaagagcttgttgccaaagatttgtatggtgtggagtggaaatttcgacatatttactga

SEQ ID NO: 11893 - DNA, 426 bp, Glycine max
  Peptide Sequence Number=SeqID_103578
atgataggtgcatgtggcgttaggattgtaccatcagggaaatggaggttgataaacctttttcgggctcaccacgaccatttggttattgagcaaggacggaagttcctccttgggtttgtgtttgtattggggttgggatttacactcggtctgggctgtgtagggaatggattttctggttatattggtgcgggggataccggtacatggggttgtgaggggtttgttaggaacttggtcatgtgggctgccattaggtctttccaggaatggactcaggaagattccagattggtgtaccaagtgatagttgcacatgtcctgcaacagcatggcgctcagcgaggtgtgcaaatgaaaatttctgcaactctcgctcagtctggctcagggccggctcagcgaattaaatgcatcctatag

SEQ ID NO: 11894 - DNA, 987 bp, Glycine max
  Peptide Sequence Number=SeqID_103579
atggcccagaagaagctttccgctaagagagctaggaaggccactacaggggaaggatccagtgattggtcctttctcaaagaaagacgggtccaactagcagagggagagtatgcggaattccaagccgaagttgctaggaggcgttggacacagctgactcagcctatggagaaatatgatccggaagtagtcatggagttctacggaaacgcctggcccactgaagaaggactcatggacaagcgctcctgggtgcggggccaatggatcccatatgacatagatgccatcaaccaattcttgggacatccattggtctttgaagagggacaacaatgtgaatacactgaaagaagaagtcaattctcaggttttgatgaagaggccataggtcagctactttgctccccgggacatgattttgcatggagcatagcagggaggcgggtgcaaatcatgcgcactaacatgaccactctgactcagatctggatgacactcttactcagtaacatccttcccagtgaccataactctgatctcccgctacctaaatgtcagctagtctacaacatcacgacccagattagtgttcatgtggcgcaacttatctcagatgccatccaccagtttgtaggtattgcacctccgagacaccgaatggacccagagaagttcaacaaggcattggaatttctggcattggtcacaggtctcttccaattctacgggataccggcaggcatagcagccggggcaagaccaccaatagcagccggccacagacacaccaccatcgcctcaacatcagccaccatctctagagtccatcttagctcacatacagaggatggagttccaaatgcatgcatgcatgaggcgcattctacgggtgctcaaagagctgcccaagaggacgaaggcagagctgaggaggatggagacatggcagatttgcttgatttcttcattggaggagactga

SEQ ID NO: 11895 - DNA, 165 bp, Glycine max
  Peptide Sequence Number=SeqID_103580
atggataagagcttgaaggtaggagaagatgagagaagggagagggagagatgggggaatgaaatttatgcctcaaatgagctatggttcagcccactaatacaagatcaagtccaagattttccactaagtgtgcttaggtgtcatgaggcatataaagcatga

SEQ ID NO: 11896 - DNA, 126 bp, Glycine max
  Peptide Sequence Number=SeqID_103581
atggataagagcttaaaggtaggagaaggagcacggaattttgtgcctcaaatgaggtgccctaaaatacaagggctgaaaaatcctacatttctagggtaccctacctacattatggagccctaa

SEQ ID NO: 11897 - DNA, 627 bp, Glycine max
  Peptide Sequence Number=SeqID_103582
gctattgaagtttccaaacgccaggcaaaagtaagagaaacaccaggaaattctgagaattctatgaagttggaagcagttgaaacaaagctgcaagacctgaagacaaacatggccatattgggaaaagaagtagctgccgcaatggttgttgtagaagcacaacaacagaggttgaagcaaagcgtgcctatcatcaaagagtactccaaatacttgatcagcttgaggaagagaggatgctcagaagagatttcagaagtccgagatgctcacaatctgaaaaaagaagccacgtacctcaatgaatgctcacaagacatgagggaagcagccacgtacctgaaactcgcggacgaggagacaccaaactcgaggacggcggtgacgagtcgcaaaatgcaatgtcgtggaggagggagacggcgtgtggaagaaggaattgaggagaagatgagaggtggtggaaggagaagagagaggtgggacactacaggttttggaggaaagagaggtggtggaaggagaagagagaagtggggggttttggaggcattgttacgcacgacactgaagcgtcaaggacaacaatacaaaggacttatgttgtccatgacaaatctttag

SEQ ID NO: 11898 - DNA, 285 bp, Glycine max
  Peptide Sequence Number=SeqID_103583
atgaagattatcaagtctaaattgcgcaataagatcaacgatgtgtggttcaatgacttgatggtatgttacaccgagcgggagatattcaagtcacttgatgatattgatattattcgaacatttaccgcaaagaagtctcggaaaggacacttgcctcgctttataatttttctggctccgccactgttctatggtctgtttagtatcaacgccttgacaccagagtttcctgtgaaaagtacctataaagaaagtcatgtgataaggatatatagttattaa

SEQ ID NO: 11899 - DNA, 276 bp, Glycine max
  Peptide Sequence Number=SeqID_103584
atggcccggagattgcccgaggaccagacggaggaggcacctacaggagttcccgatgatgcagaggacgcccgcatggatgagaagatggcagacttgctcggcttcttgggaggaagcggagccaccgcgcgtcttctcgctcggcagatggactcaagcagtgtgcttagcaggatgagccctcgctcagcgaacacgcacagctcatccttcttccagattctttctcgcgctcagccaaaggagtggtgcgctcagcagatgactcgttaa

SEQ ID NO: 11900 - DNA, 141 bp, Glycine max
  Peptide Sequence Number=SeqID_103585
atggggtgtagcctaggatcttcttcatcaatggattcttttgcttcttggaagatgaatggtagcggaatggagaaggaagagagagaggagatgccgcttcaaggagaagatgagtctaaaagaagctcactaacatag

SEQ ID NO: 11901 - DNA, 864 bp, Glycine max
  Peptide Sequence Number=SeqID_103586
atgtgtctgatgcttaagctaacttgcactctttggttgggcacgtggtttgggtgttttgtggaatctggtgggccgttgttgtgtcattttgtttggtttggcttcgttgcttggcttgactgtgagaaaaaagcttttgtgttaatgcattcttatatgtttgtcgccttttttgttaactctgtttactcacatggtcagggtttgcgatataaagttatggcatgttttcctgataagattaagttgatagatggatcaagggaaactcttaagctttttgtaaggatcactgatctttggttcattgggatccctgaaaagtctaaacaagccgaaatggtggttgttgattctgatggagatgaaatccatgttgtttgcaaacaagatcagctaaagtcttggaaggatgattttaaggaaaatttgacttatgtgatgcataattttaaagttatgaagaatgatggaaaattcagaatttgtgatcatgaatataaattatcttttattggagttactgttgttaggcaatgtaatatggaacacttaccttttaggaaattcagatttgttgatttttccactgtcattgctggtcattttgaaactggactcttgtttttgtcttatttgaatgaggttgaagatgaaagactcatcgttattcttttgacacatgccaggatcaaggaagcccagggatcatatccgctgtcagttagtaattctttcagggcgtctaaactcatgatcaacgagcttgtgctggaaatccaagaattcagagaaagccttttagatttagggattgaggttagatcagttttgatgcctattggacaagggagttcatag

SEQ ID NO: 11902 - DNA, 216 bp, Glycine max
  Peptide Sequence Number=SeqID_103587
atgcaatcctaccccgcaagggcattggctagaagactccaagtagattgggctagagatccaagcgaaggccctagggttctcatgagccttagggctctagcttctcatctcaaggaagtgagcttagctattagagagcttctcaaggaagttttctcaaagaagcttctcaaggaagtttcctcaagaaagcttctcaaggaagctacctag

SEQ ID NO: 11903 - DNA, 438 bp, Glycine max
  Peptide Sequence Number=SeqID_103588
atggctaggcttccctctattgatccaaatacaagtactgttttgatctatggatatcctaatgttggtgagagcttgttcattaacaagattatgagagctaatgtggatgtgcagccctatgctttcactaccaagtctctctttgtgggtcatattgattataaatacctgaggtaccaagtaattgatagggattttggacaggcctttgaagattttaatattattgagatgtgcagtatcacggctctagcacatttgagagctgcaatgttgtttatcttggacgtatctggatcttatggcctaggatcttcttcatcaatggattcctttgctttttgggagatgaatggcagcggaatggagaaggaagagagagaggagacaccacttcaaggagaagatgaatctagaagaagctcaccagcatag

SEQ ID NO: 11904 - DNA, 660 bp, Glycine max
  Peptide Sequence Number=SeqID_103589
atgcggggttaccgtatggttacccgcacctttcgtcaaccaggggcaaacgagcccgttgacgcaaagaaactaacatcgtcttctgcaccttttgccatccagggacagcgagtcaggtggcaggcggagataccttatgatcattcgcacctttcgtcaaccgaggagaacgaattcgatgatgtcaggatgatggacgatcgagtgcaatggcgtagggaagtgtcgtggttgtccaactttgtcgctttcaagacactgaagtttgttggcgcttatgatgccttttcttttctttctgaatgtcaggttccgctggggcaactgtcataccctaattttgtctggggaccattgtttgatggccttcaacctttgcttgaccgctttgagggtgtgcaaatagcaactaggcccacttgggccttccagggtgttccaacagaaggcggtgccttttggtggaagcaacccagctcgcctgggcgagctgagctcgcttgggattctcttgaaattagtgagaaaaattgtttccgtgaagaaaatccaagccgaggcgctttcgtaacgctttcgagacgtttccgtgagcaatttcgtgaagattcttcaccgttcttcatcgttctacgtttgttcttcggtcttcaaccg

SEQ ID NO: 11905 - DNA, 891 bp, Glycine max
  Peptide Sequence Number=SeqID_103590
atgaccaaagtgaaggcaagagccatttctagggtaaaattgggtgttgaggagtcaaattttgattcgcttgggaggattgatggggacctggcgttgagaggaacgaggataagggctatgtgggagtacgtgagctcagttgagagtggtacctggagatatgtcgcgggggtcaggagaccttggggacgtcaggcgagctcctggcagtcaaccgataaaagaacaaagaccacaaagcagggaggcttgtgtggtggctggccagcaatgagtcttgagattgaaaacgagatcaagaagctaggagggcttctagtaattgattaccaagggaggaataagccactggtaatcgattaccagtcatgtgtaatcgattacacagtacattttgcaggttttcacgtcctgaagctatgtaattcgagtttggcctctggtaatcgattaccaatgaggtgtaatcgattaccagagatgaaaagccttgagatatcccttttacttgcatgtagtggttatgggacgcattgtgttgctaccgcaatcgcgatggcggcgcaactaatccatgatcgagtggagatggagtgcctagagggagcttgggagaccctcgaaggcaatgtgaggtgccaatttcggggcacgattcgattcacggctacttcattggtgcatccagatgaacccgcgcgcacgcttcagcgcaccgtggagtggatactacccacgcctacaccataccgtctagtggagccagtccaagtgatcgaggtgacgtcatccaaggaagaccctgaggaggatcctgaggagctacctcctgagcctgctgtggatgctcttaactttctagagggtgatgaggacccactcccttag

SEQ ID NO: 11906 - DNA, 138 bp, Glycine max
  Peptide Sequence Number=SeqID_103591
atggagaatgctaagcatatggctacaccaatgaatactgcttgttatttggataaagatgaaaccgatcagtcaatagacattaagcaatatcgaggtttatggtatcctaaaaattccatcttagtgttattctaa

SEQ ID NO: 11907 - DNA, 303 bp, Glycine max
  Peptide Sequence Number=SeqID_103592
atgttattgcctagcgctgttcatgtgtcctccattatcaagcgcgaagcctctggtgactgggaagcacgttattctgttgttttccggatcgaagaaaaaaggagtagagacgagagtcgtcatcacggaaaggcaggacggacgaaatcagtgtcctatctttgctttcctcttatctccgatgagagtcccgagacgtgtcagaaatcaaaaggaagcaggctcgcgcgatccgtgaagttccgtgatgtggcggaaatcgaaaagatgtgtttttgcgcgatccgtgagtttccgtaa

SEQ ID NO: 11908 - DNA, 153 bp, Glycine max
  Peptide Sequence Number=SeqID_103593
atggtgattttcaaccatgatcatggagttgcagtggaagataaaggagaagagcttagagaagaaacttcaatggagaaagagaatgagagagagagagaaaaaaaatggtgtgggaatgaaggaaagatagggagagaagttgaacattga

SEQ ID NO: 11909 - DNA, 570 bp, Glycine max
  Peptide Sequence Number=SeqID_103594
atggtagcaaacatactttgcaaggtccaaggggagaagaacaaaggctccagtggagaaggacgaaggcccaagtggataaggatgaaggcccaagctccagtggagaaggacgaaaggcccaagtggaaaaggatgaaggtcctagtcaagatcacatcatctggtatcagagcttcggctcttgatacaggcaagagtgaaaacatcacacaaaagcctatattgagagcctcaaacatgagtgaactaccatcaaagagagaaacacgagctggtgatggtggtggtgattatcatcaactggatggatctcagcgtttgttattggacgcaatgactacacagatgcgacgattgttgaaccgtaacaataaagagctttatggaagaatagaagatctagagaaccaactgaatcagaatactgggagacattatggtggtaacagagtgggcaatgttggacccaagcaacacaaaatggaggggcagaacaaaattgagggagtaaaactcaatgtaccctctttcaaaggtaggagtgacccaaacgcctatcttgactga

SEQ ID NO: 11910 - DNA, 234 bp, Glycine max
  Peptide Sequence Number=SeqID_103595
atgccaccgaatagaggtggcatggcgggttgggatggtggtcatggcggaatagcagatatttttttggttttttgcgcgtgcaaaagcgcggcgggaggacgcacaacacataacacaacaacacgacccacacgcaccaccccgcacccagcaacgaccagcggcgacgaccccgcacgcagcagcgacgaacccgcacctgcacgaccccacaaaggtgacacacactga

SEQ ID NO: 11911 - DNA, 549 bp, Glycine max
  Peptide Sequence Number=SeqID_103596
atgttatggtgtagtactaacctgctgcgtgaacattatttaggggattgtgtagataaaaaaactggaattaagggacgatgcgttgtggcagcaattaccaattacaccaaccagctcctcgagtatggcagtgacactaaatccaaatataatctcactcaatcacttctattcctttcacattttttgggagacgtccatcagcccctacattgtggctttttctcagacaagggtggcaatgaaatcaatgttcgctggtacagaagaaagcaaaatcttcaccacgtttgggatgcaagcataattgagactgaagttgaaagattctatgatgacatagaagacttcgttgatgcaattcaaaggaatattacgaaagtgtgggccgatgaagtggaagaatgggagagttgcagtaacgatgacatatcatgcccaactatatatgcaaccgaaagtgccaaagatgcctgtaaatgggcgtataaagatgccactgaaggttcagtactcgagggtaaggatgagagctttgatggttaa

SEQ ID NO: 11912 - DNA, 963 bp, Glycine max
  Peptide Sequence Number=SeqID_103597
atggtctgcaccaagaaaactgggcagatgacgtctaaggccgcaaaggaaatcgctgagaagattgcgtcacagggttcatttgtcccccatggacatcaggatgtcctgacagctccagtgtcaccatcaagcaatacttcagatcggctccatgaagctcccgcagttcctactcaagcaactcactcaacaaatcagggaccagctggaggaggacttgcactgcctctggagcctgaggttggtccctcagctactcgtgttagcacaaaggggagctgtgttgatccctcagggaacgatccagagataggtgactcagataaatgtgggttgtacatcgaagaaaatccttctcgcctggttggtgttgaggaggttaaagatgcagatgctcccgttcctgtacccactgacgaggttatgtgggatgctaccgtgttcggggtgtttaatcaagacttcacattgtacatcaagcacgaagatctctctgaaattgcatatggtgacaagtatgcgggggggaatttcgatgtgtatggattcctcaagctacagttcattcagagatctaggcaattacagtttgaattggaaagttacatcaagagttggatgcagagttcaaaacgtgatgtctaccttgaagcctacctgaatgggctagacaactaccttaagggaataattaacagtgctttgaaagaacttgatgatactccacaacctaaatccaaggctggtgctaggtggattgttgttaagtgtaatagacaaaaaggaagcactgagtgtggctattacgtcatgcactggatgtccatgataatcttaggaactttcaggaataattgggaaacgtattttaacgatattagaccattggaagcagagagattgaaggcgcttcgcatccagtgggcacaattttatctcaaagttagaaatcaaacttag

SEQ ID NO: 11913 - DNA, 1418 bp, Glycine max
  Peptide Sequence Number=SeqID_103598
atgtcttcatttttgtctgactccaccattggcataggtggcagtgattttaggggtttgactctgcaacccgtgatggaccgagaggttatttccattgacggttcctccttgaaggatactcattgtggtgcctttgacaacaaatcctcttccttagagaggtttagggctttgtgccgtactggtggaggcacctctcgcctccacaaaagggcgtggtcttccgctgcttcctcggccagggaacctgtcctgatcacgttgggtctccccccttctgcttttttgggagcaaggagaaacggtggggatgttagggcatctccccggtacaagtcctcccttacctttgcggcgattgttgttgatctacaatgccaggcttgtgggagtgatgacttccctttcttgagggctgcatcgggcaatctacctttcttcttcatgtacaaatgtctatttgaggtcttgggtctcgttctacccttgactgcttttcaacgtgttcttcttgagcacttaagtctaactgaaaagattggttgggtctccttgaacagtgtgtccaagaagctatttgagtttgactcaaacgtctttcactacttcaaggaccatttcttcatggtcctggttactgatgtcgtggctgatggtttgccacttatgttcaacagggatgaggaaccccacttcccattctattggcaatttgaccccaccaggttcaagtcatttgatggggatctgttgacacttgtggagagggccatcttgtctcttcctttggtgagcgatcctctcactccttggacggtcagtcttgctggtgggatcgtgacaccatttgttgtccctttattgctagagaagggggttaacctgataaagttgagtgcccctataagccttcatgcagtgaggcaagctacagggttgatgcttggtttgggtcacccttcgagtttgcaagatatgcctccagctccgttgatcatcgaggctcctgctcctactactgttgttgttactcctgctcctccacctctttttgttgtacctgttcaagaggttactcccacaactggagttgataagtcaactactttagctggttttgttgcgggatcttcgtccattgttgccacacctttgttgagtgttggtgtggcgaccactagcgctcctttgatgccaccaccccttctttggctccaccgattcttccctttgctgtgttggcaacatcattgccttcctcatcttctcgtccccatgtttctttggatcacctgtacacttccagcaatgatgattcactgtagggaatacgcgcggagtagccaccaacgtttatttgaggaaaacgtcggaaaaaccggaaaagacgcgatctacgaacttttaagtgaaag

SEQ ID NO: 11914 - DNA, 432 bp, Glycine max
  Peptide Sequence Number=SeqID_103599
atgtcaggggtcttccccccgtgggcagtagcgttgcccactataggtggtttcattcttcttagtctgaccttcgttttagtcccaaagttaggcctcaacttggaaatttgttccatcatgagtgaaggagaaagcaatacttcaacaaacttgattgtcctagaaattcctcctaagatggaatggattggcgaaagtgtatggggaacaaggccaatttgcaatcctagtcacatggaccaactgagagccatagacctcacccgagacggtcaagatcatgtatggatcttgacaccccccaacatggatgaccgaatttgttctcaaggaaccacaagtgatgatgtcgatcaacccatagatgaggacatgttggagtcggattatgaggatcaatgggaagaagcatgcaactacgtactctaa

SEQ ID NO: 11915 - DNA, 495 bp, Glycine max
  Peptide Sequence Number=SeqID_103600
atggtaactcttggcatccagcaagttatttttgaatctgttagcaagacaattgttgatagttgtttaagggtggtcttccccatttttggtactgcacgaggacaggacgagtacagccaggggacgtccttgacttattgggtacggctgaccaagacggggatggtggcttcattttgtggggacaacagcggctacacgcgcatccccacaatccaaggggaaggtttctttgaagacagtgttggagaggttgaggtagcagaggctagagagggtggagagagaaggaacaatagggtagaagaccttgtttgcagcgagggagaggttggagaggaatgggaggtgggcgatgtcggcaaagagcgtgcggaagaggtccaggctgatgaggttgagggcggtgacatggcgacgattgtcatagatgacaccgagctaggagtagtaagggatgaaggtgttccacgaagaaagaatgggtggtga

SEQ ID NO: 11916 - DNA, 318 bp, Glycine max
  Peptide Sequence Number=SeqID_103601
atgagcgtgaagaagaggattgttacgatgacacgacaaggacgaagagtagtcgctcctcatggagcatgtagtgaatcgagcgagtcatggctaggtctcgtgccctatgaaaatcaatttgaagcctatttctatttacttcttgtcactcaattctcaattcaaacctccttcttcaagggactatctcaccgaggttactatgacaacgttaaattccacaggatcatcaaggacttcatagtacaaggtaggggtcccattggaatgagaagaggaggagaatctatatggatatcatgcttaaccttttga

SEQ ID NO: 11917 - DNA, 231 bp, Glycine max
  Peptide Sequence Number=SeqID_103602
atgtctgacttaaaagatagaaaagttttaggaaatatgcttgcatatttagaaacaaagtcaaaaggaagggtaaaatggtcatttacacaagattccagacatccactcgctcaggggaagaggaaaaaagaatccagcaacatgaaagctgagagaaaaacgtggaagaagaagaagaagaggaggaggaaaaatggttattggatagaatgttggatgcatggatga

SEQ ID NO: 11918 - DNA, 468 bp, Glycine max
  Peptide Sequence Number=SeqID_103603
atgcataccgaggcaagatttcacccagaccgccacagggagacgagtgcggatcatgcgcaccaccacaactctgattccccctgccgaagtgtcagttgggatcgcgcctataagacacttagtgggcccggagaagtccaacagggtcctggggtttccagctatgattacgagcctttgtcatcaggcctcctacttatcgagctttcatcgggaagtattgcaccccaggcatgtgtagggcgagataccacaaaagccaggggatggccggcagcgggcaacagacacaccgccgccacctccagagcccctcagctcatctacaaaggctggagcgttgcctacgacccgtggccgaccagcaggcgaccaagtccaaagccaaaggtaagcaaaagtactaggtccatgaccgacaagtcatcacgcgtccagctcaagacattaaagaagcgttactag

SEQ ID NO: 11919 - DNA, 657 bp, Glycine max
  Peptide Sequence Number=SeqID_103604
atgggttctgattatgtttcctttttctttctctattgcaagttagatccaagtgagctaagccttgtgacttgcagtcaaaggttgagtcaaatatcttattcttctcaaattacttcagaggatagatttgtttataatgctcaagaatgtgtttgtgtgattgttgccacaataaccaagttcttagtgaccaatggttggatatatgaggcttgtccaaaatgtaacaagaaagtggattatgagaaatttccatacacctgtcaaggttgtggaaatgaaagtgcgtcaactgtacccaggttttggttagaagtgagagttgcccaaccaaatgaaattgctaactttatactttatgggatcgtgagtgcaatgcactcattaaagaaagtgcaagaaggtgaatttgatccaaaggacattcccgaggctattgataggatactgggcaaaaaatttgcttttagatttaagggtatgctgaacaatactcagtatcctgtgtcgcaaatatcagaggatgaagatctaattatgttattattgaagagacttcctacatatgagcttgttgaaattgagcctgaaatgttagatttgtctatgaagcagagagacgatatatcctatactgccttacggaagcattaa

SEQ ID NO: 11920 - DNA, 282 bp, Glycine max
  Peptide Sequence Number=SeqID_103605
atggagaggctcaccgtgtacttcattgacatgctacagggtctgctagaaggtttcgagggtgtgcacatccaccgcgacgatcatcatcatcatcatcaaaatgacaccctcacgacgttccaattgcttcatgacatgattcaatcaaacattgttaatatccaatgcgaggaagaagttcaagacgatgctttggagcatcgcgacggagaaggggttgccgacaaggacgaagtagaggatgatgcgggcggggacgaacttgaagatgatgcgtga

SEQ ID NO: 11921 - DNA, 222 bp, Glycine max
  Peptide Sequence Number=SeqID_103606
atgattggatgcagtgattacaaagattcaactaggacttcaattcatcatttgaaatataggggactacaaaaggatgagaaccttagcttgggaggagttattactagatcaaggttgaagaaactacaagaggacattaatatgaagatgaactcacttatggagaaggaagaggaaggggctttgaagataataaattttagccaactctttgattaa

SEQ ID NO: 11922 - DNA, 504 bp, Glycine max
  Peptide Sequence Number=SeqID_103607
atgaaaggtttcaagtcattcaaggcacatgtaatcgattaccaatacatcctatccctcttaagattattgaggccacaaggtccaacaatagatgctgatgaagtgatgagtagagaaacaaatgaagtagaattcatgggtttaggtgctactgctactatagacgtagaagaaccaagctctaatacaaaaggaaaaagacaaggttcaacttcttctggtacacattctcacaagatcgaagaaaaagaaggaataacaacttctttggataaaatggccaactcttttgaccggatggtagaaaaaatggatggtaaagtcaatgatgaagatattcaagaagtattacgtgagacaactttgataccagatcttaatagacaacaatgggctaaagctattaaatggttagctgaagatccaaagcagttagctattgtgaaagcccttccaattcgcgaaaagacagattatgttttaacacatcttgcaaaatga

SEQ ID NO: 11923 - DNA, 168 bp, Glycine max
  Peptide Sequence Number=SeqID_103608
atggtttcctccgatggcgtacctctcattggataccctaactatcttatggccaacatagggaagggaccagtcactagagccatgagcaagaggctccaagaggattgggctagagctactgaagaaggccctagggttctcatgaacctcaggatagatttctga

SEQ ID NO: 11924 - DNA, 276 bp, Glycine max
  Peptide Sequence Number=SeqID_103609
atggatcaggttcaacatcagtcttttagcagggtatatggaaagatttgggatctggcaatgatagaagtattagttgaagccattgcttctcttacccaatattatgaccaatcgctgagatgcttcacttttggggactttcagttagcaccaaccatagaggagtttgagaggaactttggatgcccgataggaggaaggaagccatacctcttttctgggtactacccttctatggcgagagtagcgggagtagtcaagatcttagaatga

SEQ ID NO: 11925 - DNA, 564 bp, Glycine max
  Peptide Sequence Number=SeqID_103610
atgcttatattatatgtgcaacagagcaaggttgtcaagattgaatttttcagcattgaaactgaatcccgcaggggagggggggggggggggggttgtaggattgtaacacattgtgaggaaactgttacagtagctactgcttcgaaagacaggacattgaggctatggaagctcaatgctggggatcatgtaaacaatcctatgagggttagggcttacaaaatcttgcgtggtcataagtcttctgtacagtgtgttgcagtgcagactgctggagagatggtttgttcagcttcttgggattgcaccatcaatctatggcaaactaatgactttaatgcggaagatgacctagtgtctaaaaagagaaaaattggagctcaagttgaggagtcccaactagagggagaggcttttactacccttgtgggccatacacagtgtgtgtctgctgtggtttggccacaacgggagtcaatttattctgcatcttgggatcattctattaggaaatgggatgttgagacaggaaaaaacttgacagatttagtcaagctgtga

SEQ ID NO: 11926 - DNA, 199 bp, Glycine max
  Peptide Sequence Number=SeqID_103611
atgagtgaattctcaaagggcatggggattcgaagggaaggggcaagtggtaggcgctctggacaagggaggtggggtcagcaacgaaggccttattggacttcggatgaatatggagcatgcgtagaggtcgatccagaagcagcattggcagtcgacaacacagtcagtgttggtggcactgggttggatgacagtg

SEQ ID NO: 11927 - DNA, 405 bp, Glycine max
  Peptide Sequence Number=SeqID_103612
atgcacggtccaaggcccgagagtcagcaacagcttcaacactcaaacatgatcacaacatcacctcacgaggggtcaaaccagtgcataatgcatttaaagtcaattttgatgcagcaatttttcaatacagaggtatatatggagctgggaagagatcacaatggagcttttgttcgcgcgaagacggtagcaacaagtggaagtccgaacccgagggaggcgaaagcatgggctcttctccaagcattaaaatggatacctcaactagatctcaccgaaattgtcattgaattcgaatctgactacaaaactgttgtggatgtcctacacactcgtttcaagggggcttcagagtttcttattctatacatgagcggtcggctgttaactgactggttgtag

SEQ ID NO: 11928 - DNA, 306 bp, Glycine max
  Peptide Sequence Number=SeqID_103613
atgaagttggtctcaatccttgatggtttaggacctgatgatgacagaagcgatgtaggtgcgctatctgtttccatattaagtaccatgcctgccatgctagacaggctcattgaagatattcatttgaatggtggagacaaaatcacatgcatagttgctgatatgataatggggggatatgcttcagcaactatgtttgccttgcaatacaacattctcacactcattgaagatggcatcatagattctgatgggaattggaaggaggattggtgtcatcccttgaagaatttgagtcaataa

SEQ ID NO: 11929 - DNA, 204 bp, Glycine max
  Peptide Sequence Number=SeqID_103614
atgaaggactcgcctaagcatgagaagaaactggttaagtctatggaggggcagaatgaagtcgataatgctgaggctgagaaagagaaagaagtagaggtggctaaaaagtcaattgcgactaagaaggaaaagatgacggaggtcgctcagaagttgacttcaatcagttttggggatagttcgagtatgggggcaccttag

SEQ ID NO: 11930 - DNA, 550 bp, Glycine max
  Peptide Sequence Number=SeqID_103615
atggggatctggtggcattcagaatatgcatccgaaaaacttaagatagggaacccgaacgctccatcaatgctcgaaagtacatctgcaggggaaaacctcattccattgaatctagagatcgaagcaacttgcagaaggaacaacactgcaagaagaagaagagagcaacaagaggtgcaaattaatcaaggagagagaggaccctcatctgaatcatcttctccctctcctatgaccagtccatatcctttctctgaagaattcatcatggcagaagatcatccacagaggatgacgctagaggactactctagctctgttactccgctgtacttcaccaacatagccagattggacattcaagtgaccaacatcacatatccatattccctcatccatctgatccaggggaatctattccatggcctgacaagtgaagatccatacgcacaccttgccatatacatcgagatttgcaacatggtgaagatagcaggagttccagaagatgccatctgcctcaacctattctctttctccttggccg

SEQ ID NO: 11931 - DNA, 249 bp, Glycine max
  Peptide Sequence Number=SeqID_103616
atggctgcagatggcaacaagacaccagtagggaaaaccaccatagggcaagcttctaccatactcagaatgcctatcatgggaagaattattgtcgtccaggctgaccacatgacagcaagagagtgttatgccgcaagtctcagaatcagtaaaaggacaaaaggagtcgagcctacgacacagctggtggcatacactgacctgaataatctgagggataccaagcttgatccgagagaagaataa

SEQ ID NO: 11932 - DNA, 282 bp, Glycine max
  Peptide Sequence Number=SeqID_103617
atgcttccatttgatttccggtgtgtcacggaaacttacggattgtgcatcaatatttttttggttttccggcatgtcctggaatttcacaaattgcctaatgatgggtgccaagcacctcacaaggaccaaagaaaggtcgcatgtcatcaagcaaagagcgtgatagcagactgggtttacgagaaggtggacacagggtcaaagaaacacagtgacacgatggtgagcatgagtcccgatcagcgcgaaggtggacacagggtcagaggagcacagtga

SEQ ID NO: 11933 - DNA, 183 bp, Glycine max
  Peptide Sequence Number=SeqID_103618
atgcatatgaacatgcatctacaaaacaatgtgtcataccctaatttcgtccggggactattgcttgatggcatgcaacctttgattgaccgcttcgaggtacatggcaccctctgttgcacaatatgtgaagtcccgagatgtgccggaaatcaaaaggaagcgtggttacgcaatccgtga

SEQ ID NO: 11934 - DNA, 1371 bp, Glycine max
  Peptide Sequence Number=SeqID_103619
atgagcattccaactgtgctagtgttaccatttccatttcaaggacatgtcaatcccatgacaaccctatcacaaaagttggttgagcatggatgcaaagtcgttttcgtgaacacagacttcaatcacaagcgagtgttgagttccatggtggagcaacaagatcatagccttgatgaatcactaatgaagttggtctcaatctcagacggtttaggacctgatgatgatagaagcaatataggcaagctatgtgatgctatgataagcaccatgccttctacacttgaaaagctcatagaggatattcatttgaaaggtgacaacagaatcagctttattgttgcagatttaaatatgggatgggctttgaatgttgggtgtaaattgggaatcaaaggagctctattctggccagcctcagcagctgtgtttggcatgttgtacaatgttccaaggcttattgatgatgggatcataaattctgatggatccatattaacttctaataagacaattcgactatcaccaaatatgccagagatggagacaacaaactttttttggcttaacatggctgacacaataaatagtacgcatttcctgaattatttggtgcatcattgcaccccagctttaaatttgacagaatggtggctttgcaacactgcatatgaacttgaacctttgatgttaacccttgctccgaaactcctcccaattggcccattgttgagaagttatgacaacacaaatccaactctaagatcattgggacaattttgggaagaagatctctcttgcatgagttggcttgatcaacaacctcatcgttctgtcacttatgttgcatttggtagtcacacttattttgaccaaaaccaattcaatgaactagctctaggactagacctaaccaataagccttttctttgggttgtgcgtcaagacaataagatggcataccctaatgaattccaagggcataaaggtaagatagttgggtgggcccctcaacaaatggttttaagccaccctgccatagcatgctttattagtcattgtggttggaattcaagcacagaatgtttgtctaatggggtgcccttcttgtgctggccatattttggtgaccaaccttataacagaaaatacatatgtgatgagttgaatgttgggctgggattgaactcggatgaaaatgggcttgtgtcacggggggagattaagaagatattggaccaactacttagtgatgggagcataagatcaaggtctctgaagttaaaggagaaggtaacaagcagcacaacagactgtggtcaatctttagagaacttcaacaagtttgtcaagtggctgaaagaataa

SEQ ID NO: 11935 - DNA, 1065 bp, Glycine max
  Peptide Sequence Number=SeqID_103620
atggcggaacaagctaaacaggtattttatgttcaagacccttgtgatgaaaggtggttagtggttctacacaggaaaacagttggtgttaatgttgaacttgatgattcatacattgatacttatgttagtcctttgtccacacaaatgtcacctaacatcgtcggagaagaagaagctgacgatattcatacaaatggctacaccacccagctccctcctcctcctcttactggtgcagcatcacagttgtcatctaccttgaagcagacaagaaaaaccacacaactaagatcattggcgactagaccaattggggcagagagaccgctggtccatgttgatcctacgaccgggaaagccaaaggtccccacagaaagaagttaagaacatatttggggatcgtcatatgtgataaggcacttgcagccgacaaggaaagtgttgatgacattgatgcgcgaaaaaaggcacaagccatccagaaacaaaacaccacccctcacgtgttgtctcatgggggttatgaatatttagaaaacaagttgacggatgagaagagaaagaaaaaactggaggaagctgctcagtctggaagcactaataccgtgattgatcctccatctcctatcagacgacaggtgaagtggaagatgacccgcactaaggaaactgggcaaatgacgtctgaggcagcaaaggaaattgctgagaagattattcattggaggagtaggtctcacaaggttcctttgttgcccatggacgttaagatagccggtgtcacgatcaagaaatactttggatcggctccaaggacctcccacacatcttcctctatggctcctgaagacctagagcagttgacacaacaaatcagggaccagctggaggtgtcgatcacagaaaaaatgcagtcccagtttcagtcgcagatgcaatcacagggagtcatactgcctcttgagcctgaggttggtccttcagctgcttgtgtcagcacaaaggagagttgtgttgatccctcaaggaatgattcagacacgggtgacttagacaaataa

SEQ ID NO: 11936 - DNA, 1092 bp, Glycine max
  Peptide Sequence Number=SeqID_103621
atgggatggtcaatgtcatcagatgtaagcactactaaaaaaacagctttctacatcgcccaattaacatcggttatagctaaaaccgatgttaacgaaagcgcggtggcattttttcgcctgcgcttccgtgactacaaccacattgtcgagatcgtgtttgtggagatcgtctttagcacttatccattgagttggtgtttgtcgcaaactgggctgcgcttccgtgactgcaaccacactcctttgttgcttggccaagtaaaggtgagtgtggaggaggttagagatgcagatgctccagttcctgtacccactgatgaggtttccttagtggggcaaacacttcacaccttccttgcttggctgacacatctggtcaagtctttatcacagcaggtagttgtgtctccgccaaaaccacctccgaagccagatccggagcttttcttgaggccttatcaggttagatgggatgtcaccgtgttcggggtcgttaatccagatttccccctatacataaagcacgaagacctctccgaaattgcacacggtggtcaatgtctcagcatatcagtgttacagttgtggattctgcatctcactgaaacatgtatgcgagcggggaattctgatatcaatggattcctcgagcctcagttcattcagaggtctgggcaatcgcagtttgaatctgaaagttacataaagagttggatgcagagttcacaacgcgatgtgtatcttggagcctacctaaatgggttccactgcagcggacattggcagatggtggtcatcctgcccaaggaacacttagttgtctggttttgttcattacataacaggctagacaactaccttaaggggattattaatagtgctatcaagggtcttgatgatgctccacagcctaaatcaaaggctcctgctaggtggattgtcgtcaagatgtccaccatcattttaggaagttttagaaataattgggaagcgtattttgacgaccctagaccattggagcccgagagattaaaagcattgcggattcagtgggcacagttttatctccgagttagagatcaggcttag

SEQ ID NO: 11937 - DNA, 315 bp, Glycine max
  Peptide Sequence Number=SeqID_103622
atggccacttctaactcctcttctgtcgagatcataccagccctagagattaccaccatacacactttaaatgaaccttccatccatgttgaacactttttcgacatacaagaactcaaaaaggcaaggcatttctttaacgagtctcagactatatactcaaaactcatcataaccttttggaggaatgataagtttgtcaacaagaaggtcatagtatccaaggttctaggaatcaaggtggtgcagtccaatgacttaattgccaaggcaaccgggcgccttcatgaaggaagcacatatcaagaaggatga

SEQ ID NO: 11938 - DNA, 244 bp, Glycine max
  Peptide Sequence Number=SeqID_103623
atggaggttaaggatgaggataatgttgtgcataagatgaaaactgctgacaagaagaagagtactgatggtaagaaaaatgaggtgagaggtgaaagtaatcaagaaaaggaggaacaaataatggtcaagaataaagaattgaaggaccaagaaaaagaaatagaaaatgaaaaaaatgaaaaagaagaaaaaaataatatgactgcaaagaagagtaggagtgaaaaagctatggatgaag

SEQ ID NO: 11939 - DNA, 1017 bp, Glycine max
  Peptide Sequence Number=SeqID_103624
atgattatggttagaaccaaaggattatgtcgggctttagacaaagttttaggaatagccttagggagacaagttagtggtgatgcggaagaagcccctcaacgtagaaggctaacagcatctgcacgtagacaacatgcaactacaattgttgttgctgaggatgttaaccgtgtggatcatgttgctgacgaggttcatgagcagcctcaggagtcagtgacaagtcatgttgatgctgatatagagggtttttcaggcggaccccatgatacatcaatgttgacgtcatatgctgatcatgtggcagccaaagttcgggcaggagaggaacgtactgcgttgaagttgacctctcatgggaggaaggagaggactataaccctcgatgatgtgacatccttgttacatctgcccattacatgtgccttccataccttcaatgctcttgatgtaaaacaagtcatggacttgttagttgaattgtttgaagtcagtacacaagaagcaaaagatgagacattacaatggataggggcatatgttcgcctagcttggctacgagacatttattgtaacaaatgtgtcacaagacaatggaccctaatagctcgagcatatttattgcttctagtaggtttcacactctttgttaacaagagtgccacacacatcaatgtgatattcttgaacacattttgtgacctcagccaatctggaagctattcatggggagcggctgcactggcctatatgtatgacaatctaaatgatgtgtcaaagcatacaacaaaacatcttgcaagatatatcaatatgttacaatgttggatctacgagcatttccctacaattgcttccattattactgatgaggattaccatgaaaggaaaccacatgcttgtcgttggaagtctgggaagatactaactagagagggtagtgcaacagtttggttatgttcagaccattccttcacttcctactactccatccttatccataaaggagattga

SEQ ID NO: 11940 - DNA, 1354 bp, Glycine max
  Peptide Sequence Number=SeqID_103625
cattccaactgtgctagttttaccatatccagctcaagggcatgtcaatcccttgatgaccctctcacaaaagttggttgagcatggttgcaaagtcatttttgtgaacacggactttgaccacaagcgagtggtagcttccatgggcgagcaacaagatagtcttgacgaatcccttctaaagttggtttctatccccgatggtttagaacctgatgatgaccaaaacgatgcaggcaagttatgtgatgctatgcaaaacaccatgccaactatgcttgagaagctcatagaggatgttcatttgaatggtgacaacaaaatcagcttaagtgttgcagatttctgcatgggatgggctttggatgttgggagtaaactgggaatcaaaggagccctgttgtgggcttcaccagcagctttatttggccttctatacaacatccctaagcttatcgatgatgggatcatagattctgatggtgtggaatatgggcgacacaataaacgtctaaatctgacgaaatggtggctttgcaacaccacaaatgaacttgaacctgggccattatcctctattcctaagcttgtgccaattggtccattgttgagaagttatggtgacacaattgcaactgcaaaatcaatcagacaatactgggaagaagatctctcttgtatgagttggctcgaccaacaacctcatggttctgtcttgtatgttgcctttggtagtttcactcattttgatcaaaaccaattcaatgaactagctcctggaattgacctcaccaatagaccttttctttgggttgtgcgtcaagacaataagagggtataccctaatgaattcttgggaagtaaaggtaagattgttggttgggctcctcaacagaaggtgctaaaccaccctgccatagcttgttttcttacccattgtggttggaattctaccatggaaggtttgtctaatggggttcctttactgtgctggccatattttggagaccaactttataacaaagcatatatttgtgatgagttgaaggttgggctgggagttgacaaagataaaaatggactcgtgtcacgcatggagttaaaaaggaaagtagaccaactctttaatgatgagaacataaattcaagttttctggagttgaaggacaaagttatgaaaaacataaccaatggaggtcgatcattagagaaccttaatagttgtactaatgaagcttcagtaggggaggttgctgaattgaaggctcaagttgaggccttacaggctgcactccaaagaaaagataatgaggatcaaatgatgagacccaagatgagccaagctaagagatga

SEQ ID NO: 11941 - DNA, 180 bp, Glycine max
  Peptide Sequence Number=SeqID_103626
atgtcctcatttctaatcttgtgtcccattgatacaaacccagagatagaggttggtaccacttcatcaatagttgttgatcctctgcttgcattgggaaaaattgccaagtggatggagagctatacatgtggggaaataaaagaacacaagcgggcagcttggactaggaaaaagtaa

SEQ ID NO: 11942 - DNA, 699 bp, Glycine max
  Peptide Sequence Number=SeqID_103627
atggaaaaaactgtgaaagtcggagaagacgatcctagttattccaaatgggtcatcgaagatgcggttgcacagggatggttgtcgaaaaccatggaacctcatcttattggtatgtttattgagttaccaactgctcgagacatttgggatagtattacgttacccaaatgttctatgacggagaagatgaagcccaacattatgaactgtgttgtaatacaacccagattcaacaaaatggataagcgatgcccaagggcaagaaactatgcttggaaggaaggattttgtagtagaataatccatgcaatggtttcaaaaactgcctcagggatgcgacctcgttctttgcgagaccttgatgaagccaagaaagacaaaatccgatgcagtcattgcaatgcgactcgacataaaagggaaacttgctttgaacttcacggctatcccgaatggttcttggagaagaggaggcaaatgagagctaaaggcaagcgttcaggaccagcaaaactcattgattatgtagctggaattgctgctgtagcaacaagtcaagaccagtcagggtcacgatgttttgcgataatgctccaaccatatgggatcagcataggcttaaaggagcactcaaacccggtgacccccaaggcctacactccaaagatttcgtcagggcctctccctcctgattaa

SEQ ID NO: 11943 - DNA, 204 bp, Glycine max
  Peptide Sequence Number=SeqID_103628
atgagcttagatatagaggggtgtgtgtcgctaagctctagcttctcaaggaagtttctcaaggaagcttctcaaggagcttctcaaggaagcttctcaaagagatttctcaaggaagtttctcaaggaagtttctcaagaaagcttctcaaggaagtttctcaagaaagcttctcaaggaagtttctcaaggaagctacctag

SEQ ID NO: 11944 - DNA, 219 bp, Glycine max
  Peptide Sequence Number=SeqID_103629
atggttggagcacccagcaaatttccaaaaggacaaattcgcccttcaacgttttcgccccacttcttccgcgagtgtcaacggaagaagaactgcggaagaaccatcttccgtggaactacgcggaagaacttcttccgccagagtcaacggaagaagttaaatgattttttcctctcacaagttgaccaatggccgattcttgtatgcaccgcatga

SEQ ID NO: 11945 - DNA, 300 bp, Glycine max
  Peptide Sequence Number=SeqID_103630
atggcagcaggaaggcgcgatcgtggggaagaagaaggagcagaagaagaaaagaagcaaagcagaatgtgttcttccgcgctcccttcctcgttcgtgttcttcagtgggcttcctcgcagcagtcttcttcctcctcgtagcagtgttcctcgcagcagtcttcttctccattttggttgcgtcccttcgtgttctccattgggttgtttgagcgtttcttccgccatcgaggttgaagacgaagttcttttgcgagaagaagcttcttccgcgtgtgtgttaggggacgaaaatgga

SEQ ID NO: 11946 - DNA, 171 bp, Glycine max
  Peptide Sequence Number=SeqID_103631
atgtcacaagaagttcatatggattatgattatgataatgaagaagaatgtgatgtgaatgaaccacatgttgattgttcgaatgctgttaatacgtctcaggtatttggtactcgagatgatgttttgcagtgtgtgacactctttacccctcatatatgtatatattaa

SEQ ID NO: 11947 - DNA, 363 bp, Glycine max
  Peptide Sequence Number=SeqID_103632
atggcaaagaatgagatgaaaattactggacttatgattatgttcatgattgtgttgggattttcacaagctaattacaatccttcatttgtgaaaattggctcaaatcgtgtgtatgatggagtctattgtcaggataaatgtagttcagcatgcgcaaaatttctactacttccaggtggtgtccttgcatatgtaatatgtctttatgcatgtactgcaaaatgtcatgacaatcccatcgatgttgcccatgattgtatcactggttgtgccttgaaaaactccgttgatgccaacatcgtagatgctcgtggtcttgtggtgaaggattcttttgtacaagagtgtcgtaagaattaa

SEQ ID NO: 11948 - DNA, 531 bp, Glycine max
  Peptide Sequence Number=SeqID_103633
atggctatttgcttccactgggatgttttgcagctttcttattttttcttggatctccttgatttggatgaggaggctggcatgatccagaagtcaactaaccaaattgatcaaaatgagaatgctgaagaacaagctaatgctgagtcaactaaccaaactcttatgccagatttcatgaagccagctcacaatcacttgagtgtgattgggttggctccttcccacattgctttcaagaatgaaggtggaatcacagccgttgatttcaatgttggaaagtctgatcgcagtaggataaaagtcactggaaagcagaagaagaaactagagatgcagcttttaaacccgctcctctggttcagaagccaatttcttcgatcttggagaaaattcggcagaggaaattggagattttacagaagtgtcaagggggaggggatgatgcaatcctatccccaagggtattggatagaagactccaagagcattgagctagagctgctaaagaaggccctagggttctcatga

SEQ ID NO: 11949 - DNA, 279 bp, Glycine max
  Peptide Sequence Number=SeqID_103634
atgcctttgttaagtggtggaatcaatttgacacaacaaaagcagaaccagacaagatttatcaaacaaaaaatcaaatatcttaaagatttaatctacatcaagatcgttatcaccgacgatcatggtgttggtggatgcgacaatggtggttgtgcagtaacaacgacaacaatcatgttggtggtggtttgcggtgatcacagtgttggtagttgcaatgatggtggtggcaatagtaatgacaacaacaatcatgttggtggtcgtgacagttga

SEQ ID NO: 11950 - DNA, 108 bp, Glycine max
  Peptide Sequence Number=SeqID_103635
atggtgattttccactatagagatgcaatggaagataaaggagaagaggtagggtaccctagaaatgtaggattttccaacccttgtattttagggcacctagactag

SEQ ID NO: 11951 - DNA, 240 bp, Glycine max
  Peptide Sequence Number=SeqID_103636
atgactaagactcatgcaaatgatgatgatcttcacaagccaataattgttatatatggcaaaagatcaagaggtgaagcagaggaaatctctgttgaaggaccaatgtccaagaagcggaagttgcccacctttaatgcaaaggttcctaagtgtccaagagtgaagcacaatgctcaaagggctgaaggtcttattcagaaaacctcagtagaacatgcactagtgaaaagcacctag

SEQ ID NO: 11952 - DNA, 465 bp, Glycine max
  Peptide Sequence Number=SeqID_103637
atggtagaaagggaatttatagaccatgtaaggcaagtccatgaaatccagacatctaaaagggaaaaagctgaagaagaaaccatgcaagctaagatggacaccacaaatgccaagatccatcatgttttaaccacattggacattcatgatgaagtgcaagtggacaggaagaaaccaagagctaatggaagaaaaccagaaagaactaaggacttttctgaacaacaacaccctaagaatgagcaatacaagctatgcatgcaacaagccctttctgctcaaatcacaagtttgtctcagatgctctggcgaaatgttcaacaagctcagataaatatgcttggagtagctattaatcttgtcatccaactgcaacgactagttcaacaacaaccatgcattcttcctacactcattcaatctgatatgccaccaccaactcaaccacctccaccgcaatga

SEQ ID NO: 11953 - DNA, 501 bp, Glycine max
  Peptide Sequence Number=SeqID_103638
atgacccttcgctcagttcaaatgcacagctcatccttcttccagattcttcctcacgctcagccgaggagtgttgcgctcagcggatggctcgctaagccagaagattgggttaatgaggggatgaaaatcagcacttcacaaacttgcctaattaacctgaaattgagaggaaatggcttctctggatacatccctcaaggatgtgaacaaagttttcaaccattggggttctcatcatatatgcctcaatactcatttcaagttctttttacctcaaatgttttttatggagtctcgcaaaggtttggtaccattgtgaacactctaccatcagcatatagcccacctccatcgagcttttgttatcgtacaccattacctactcaaatgcatgacatgggtcatgaggatgaggggaaagatgatgataacaataataccgacaataatgattatgatgatggccacggtggtgatcatgttcctcaacaacaataa

SEQ ID NO: 11954 - DNA, 153 bp, Glycine max
  Peptide Sequence Number=SeqID_103639
atgtctgaagaagtggatatggattatcaaaatgaagaagaatgtggtgtgaatgaaccacatgttgattgttcagatgcgttcaatacttctcaggtgtttgacggccgaaaggatgttttgcggtggctcgatctgttgttcatgaaatga

SEQ ID NO: 11955 - DNA, 132 bp, Glycine max
  Peptide Sequence Number=SeqID_103640
atggttcagctaagagcacatcattgcgctaagctcaacatcttcactaaagcgctaagcgcagcctgccacgctaagccccaaatgcttacgggattttacaacttcaagttgggcttagcgcgaggctag

SEQ ID NO: 11956 - DNA, 234 bp, Glycine max
  Peptide Sequence Number=SeqID_103641
atgaaggagagttcatcttccttagattcttcatcagaggagttttcagctttgagagctttggacgagcttctggaggcttgctttctggacgatgagatcatgcttgcagctggtgtctcgctaagcgaggcttgtgcgcttagcgagaatcataggctaagtgacgcacttagcccgcttagcgagttgggagaatctggaggaaaatctgagaagcatctgcacgcttag

SEQ ID NO: 11957 - DNA, 402 bp, Glycine max
  Peptide Sequence Number=SeqID_103642
atgcttagtacgccatcacctcgctcagcgagacatttgtctcttcctacgctaagcgcacccagctcgctcagtggattttcactaactcgcgctaagtacgaaaatggcactaagcgagcctttgaggatagaaagccctttttaaggctgaagctggaaaaatcaagagaaaggttagaagagaggctaattcagagcgtaaagagtagaatagaggcgcaaaacagagcaaggaagccaaaaacctcagctttcaaaaggatcttaggtttaggagtaatttctaggttcctagagctgaaaggtgctgccttgcgatggaaggctaagtatctctattgggaaattctgctgaaacttgatgctaagtttgacgagacatatgagaatgaggtttaa

SEQ ID NO: 11958 - DNA, 285 bp, Glycine max
  Peptide Sequence Number=SeqID_103643
atggtttacaactcaagaaccttaatagctgaagaagttattcatgtgagttttgacaaaaataagcctgataaagatttattagagctagatgagtcttttgtagatctcagattggacgatggctcaatagaaactagcttgtcgagacagaacccagaaacagaagcgttgaccaaacaagtagtccaagaagaggtaagggaacccattagagtcaaatcattgaagactctgcaaatcatgttcgaacaagatcatcactcagattacactaatttctga

SEQ ID NO: 11959 - DNA, 327 bp, Glycine max
  Peptide Sequence Number=SeqID_103644
atgggacccctaagggtgcatagatcatcaaaaaatggcatttgggaccatggcaactgcccaggcaagctgatgcttcatcctaaagtaactggctcgcccaggcatgctggttccttcatacctaagcaatttgggggcccaggcgagccaaggctagcctgggtgagccagggtccaaaaaactccctcaaaagacccttttgcccctctcttttggtatcttttgcatccttaaccaaaacatcaaacgatctttcatcttgtgcggcaactagtatcgaacaacacagttcggctagcgagaatcaaaacatcagtgaatga

SEQ ID NO: 11960 - DNA, 1086 bp, Glycine max
  Peptide Sequence Number=SeqID_103645
atggctttgcagcagccaacaaaggctcgcaatgacgatggagaccagtgtgatgctcttggctgcgcacatggagtcgtggacgatgtggtggcctttggcgatgatgatgggcattgttcacctgtgaaaaaaaaaagcggaaaggtccaccagggacgccttgagcgtggtgggtcttcagcgatggatgatagtggtcgaagggtgggtgacctcatcattggacatgccgtcatagtggagtgtggaagtgttgtttggcacatgagatgttggatgccaatgccttcatcatcattggatgcagattgtcttgtgcaacggactggctggactagagacccagatgttttcttcctgtggctatcatctataccctttagcggtggcggttttaatgatgcagtgattgctgaagggcttgctgaagctctgatgttatggtacttagaaaatttcccatgtttaactattggaactttgatgtgcatacacatctctgatggagcactgaatgttgagagtgagactgagcaaggcatggatcacttattgggctccaaacaggacaagcccaagatttggaagcggaaggcagttagtcaatttctgggtaattttggacagagaatttgttctgaggagctcggctctgcgaaagagagagagcgatacaccggtgagacaaacgatgggtgggtgagagtgagaaccagaaaggagaggaatgagagtgtgagagtgagagagaagggggacccaggtctgaatatcatcgaaaatgggaaagggaggccgacagagctatgtgggggtcaactggagggaccatcacaatatttcttcgttctatttcactcatttccccgaagacgcaacggagggcgacctgtggcagcacttaaaaaagtggatgatgtgaatcagctggagaggcgtctggacaatattgtgttgggaggattaaaactatatgttaacattccaaaatacgacagagctgcacatggatggagacaaccagagaatagagtcccaccactcactagacaacagactcaggaaaggagaggaggatactag

SEQ ID NO: 11961 - DNA, 117 bp, Glycine max
  Peptide Sequence Number=SeqID_103646
atggcctcctatggtgggggtgttcttcagccctgggcccatcaggaaccttctggaggaagcaaaagctctcctaggcgagctggacagcaagctcctcctccatttttcctataa

SEQ ID NO: 11962 - DNA, 327 bp, Glycine max
  Peptide Sequence Number=SeqID_103647
gggagcgccttggcggattatctagctcaacaacccatcaatgattatcaacctatgcatccagaattccctgacgaggatatcatgaccttgccatgggattggggtagtattggtttccccggacaagcattgaaaggtgaatgggagaccagagaccacaaattggtgccatacatcgaattcagatgtcgtggggagcctgcacattgttgtttcatagaagaagatgaggatgataagccttggtacttcgatatcaaacgatacattgaggacaaggaatactcgcctaaggcctctgacaatggcaagaggacattatga

SEQ ID NO: 11963 - DNA, 459 bp, Glycine max
  Peptide Sequence Number=SeqID_103648
atgaacttacacgagcttacacaagctaaccacatgcatcatatgcctagatcaaatttccagtgttttggtgatgtccttacctttgacacaacttataaaaagaatgaatatgataagcctttggtgattttttttcctgggccaccaaataacttcatggtgaagaaaccaactcgcctgggcaagctcattgcttcagcactaagtttcagctcttctgagcgagttgcctttgccccaagtgcccattttcctataaataggcatgctagggaggttgagggagggttccaaggttcagaggtggagggaattgagagaactaagaaagaagaagaagaaaaaagaggaaacgaagtcgaggcgctaccgaatcgcaaccgcaatcgcccctatgtcgtttcttgttcagtgtttttcatgcaattgtcaattagttttgtttttaagatttga

SEQ ID NO: 11964 - DNA, 975 bp, Glycine max
  Peptide Sequence Number=SeqID_103649
atggagaggcttgctgttgaaattaaagggctaatcgctggcacaagattaagtcctttgatcgcatgttcattggacactgacgatcaggggcttatatcggcttttgtcgagaggtggcataaggaaacaaacaatttccatcttccaataggagaggtcaccatcaccctcgatgatgtggcctttttgcttcatctgcccatcataggcgcattccacaactttgacactcttcatgtcgacgaagcggcgttgatgttaatggagttagttgaagtcattggagatgaagctagagttgagatagtacagtgtcatggggcatattgttgtatttatgagcattttccatccactgttgaggcttttatagacctagactatgatgaaaggtcaccacgtgcctgctgctggacttctacgaaagcctctacgaagtcattaccagcatcgacaccaaagagggtggtgcaacaatttgggtatgttcaaaccattactccacactctccaggatcaaggttatcgttcgaagatattgacgatagatggatgcatttctttgagtaccttgcactggtggggaagatttgtgttgtgcttggacaatgtgcactggactgcatccactggttctacgtgatttcacatccattcatgacgctgaaacagcccggggatttgcccagacatccacttgtcgtgcaagatgagacatatgtggaaccaaatatgcctgagttcccagtggtagcagcagttatggaggaagcacctgcacatgcaccttttgatgtggagcagcctagacatgcagtggaggcttgccaagcaattacagaaaggttggagtggttgctcaacctcaggatagtgactgaaggcacgaaagcacacgatgtcatgcaagactggttaaggatcactaggggtgtcaatgtagagtgcaatgtttatgtcaggtcacgatga

SEQ ID NO: 11965 - DNA, 267 bp, Glycine max
  Peptide Sequence Number=SeqID_103650
atggattcaaagcaattcgatcgctggagtcgtgagactaatcctgaacctggcgcttcgataacggtggagtgggtttcggtgaaccgcgaaatttcggacgatgtcaccgtctccttcttagatcaatcttccaggaaagggattcccaccataagggctgtgtctttgggcaataaaaaaacaggtgagaggcttcctcctccttacttctgcaaaaaggacatattgtgtcattcatctggatttgtctccttctcagattag

SEQ ID NO: 11966 - DNA, 429 bp, Glycine max
  Peptide Sequence Number=SeqID_103651
atgtcctggtggaaggtagatctagtaggcctcccgttgacatcgtgctcgaagaactactgcacgaattgcatcgggttgttcactcatgaaagtccaaatgatatgaagcattttcctcaatggtggtcagtggcacatggggctcatctaacaacaaaacatgacaccagatgtatcaaaaatgtgtgtggaggcatgtctcttcctccatcgtatatctgtcgtgataagtcctctactcctcgaatgtcactgtcgcaatgtgcccttttgcgggcgagcgaggcgaggctcacgggtgcgctttccaaaggaggaaagatgcgcggagtcgccaccaacgtttatttgtgggaaacgtcggaaaaaccgaaggaaaccggtcgaaatgaaaattctaagttcgggatttgtatttacgtttga

SEQ ID NO: 11967 - DNA, 330 bp, Glycine max
  Peptide Sequence Number=SeqID_103652
atggcagtcataaacccaacaaagatttctcaaccttcatttcccagagaatacaaccccaacgtgacattggcttatcatgagggagtttcggggcattccattaagcattgtatgaccctaaaacataaagtgcaaagtctgattgatgtaggctggctgagattcgaggaggagaattgcttgtcaattctaatgtcatcaagcaatactatgtatgatgcttggggcaatttgaaggttgttgttagatgttcccaaggactcattaggattttcagaaattgctcgttctacacgtttggtgagggtgtcgtgaacgacaagtaa

SEQ ID NO: 11968 - DNA, 435 bp, Glycine max
  Peptide Sequence Number=SeqID_103653
atggagttgtcatctatcgcaacctaccctacgatgggagtgcgggcgaaaagccaaaggaacatcttccaaaaaggaaaacgaggtgttgcccttgctcctacgtatcctcagctcgcccaggcgagttggtttgttcaccatgaagctatttggtggctagggaagccagaggctagcctggcatctattccacaaccaccttcacttgtagttgttgatgcagacatgcctcgacatgcagtggccacttgccaaaagatagccgaaattttggaacacatgatcaacataaggatggtcactggtggaattgatgcatacactctgattgagcactatctaagattagccaagggtgttactgagcaaggaaatgtttatgttcgatctagacaaaggagggatacacatgacaaagatggtgatgaatga

SEQ ID NO: 11969 - DNA, 1401 bp, Glycine max
  Peptide Sequence Number=SeqID_103654
gacggtgtggacgacgctgtctgtgagaaatacgacataagcaaggaaaaatgggcccaattttgccagactcgcagagacccttcttgggagaacactgtcccccacgctttatctcgtgggggttatgaatatttggagcagaagctcctggctgagaagaccaagaagaagctggaggaagctacacagtcaaaaagcgttgatggcgtcatcaaccctccatcccttgttagacgccacgtgaagtggaagatggcccgcaccaagaaaacaaaggagatgacgactgaggctgccaaggaaatcgctaagaagatcgattcctttgaggagcatgcaacacagggttcctttgtcccccgtggacatcaggatgttctcacagctgctattggacgtccagagcaccctggacgtgttcgtgctgctagagccgtaagcacaaaggagagttgtgttgatccctcaagaaacgatcctgagacgggttactcagacaggtgcggcttgtacatcgaagcaaatcctgcccgcctggttgccctgggaagagtttatgagggatccactattgttcataacactcctttgttgcctggaaaagtaaaggtgggtatggaggaggttaaagatccagatgctcccgttcctatacccactaatgaggtttccttagtggggcaggcaattcacaccttccttgcttggccaacacatctggtcaagtctttatcacagcaagcagttgtgtctccgacaaaaccacctcaaaagccgaatccggaggtcaatgatccactttatctgataacattgaccatcccagagcttttattgaggccttaccaggttacattggatgccaccgtgttcggggtctttaatccagactttctgctttacataaagcacgaagacctctccaaaattgcacacggtggtcaatgtctcagcatatcagtgttaaagttgtggattctacatctgactaaaacatgtatacgagtggggaattctgatttttatggattcctcgagccacagtccattcggagcggacactggcagatggtgctcatcgtgcccaaggaacacctaattgtctggttttgttcattgcataacaggccagacaactaccttaaggggataattaatagtgctttaaaaggtcttgatgatgctccacagcctaaatcaaaggctcctgctagacaaaaaggaagcactgagtgcgtctattatgtcatgcactggatgtccaccatcattttaggaagtttcaggaataattgggaagcgtattttaacgatcctagaccatttgagccagagagattaaaggcgcttcaagtccaatgggcacagtattatctccgagttagagctgagagctag

SEQ ID NO: 11970 - DNA, 159 bp, Glycine max
  Peptide Sequence Number=SeqID_103655
atggcctgctgtaatgcaaatagttcagcttatatctcaagccacatgaataacaaagaatatgtagttttacgagcaatgtacccatatggatttcgtggtcagcagcagataagaagaagctgctgcttcaaaggagttgctattctggataaatag

SEQ ID NO: 11971 - DNA, 1201 bp, Glycine max
  Peptide Sequence Number=SeqID_103656
atggttagaaccagaggtttaggtcgtgcattagatgatgttccccagcggtgtaggcctaccgcattcgcacgcaggcaatgggaagttgtccctgttgttgaggatgttcctgagatgactgaggacgtacctgcacctggtgaagagggattagttggtgatggtgttgagagatcagctgttgatgatgctgagggatttccaggtgggccacgtgatctatcagtgctaactttatttgctgagcatgttgcacatagcatatggaatggagagaaacgtcctaaattgaagttggtctcctacgaaaggaaggttgagaaatttgagaggtggcacaaggagactagcagcttccatcttccagtagaagagttgactatcacactggatgatgtggcgtcactcctccatcttccgatcataggcaccttccacagcttcgagcctctacatgtggacgaggtggtcatcatgttggtggagttgctagaggtctcgggtgaggaggctagaactgagactacacaatgtcatggggcatatgtatgcctgtcgtggctacgggatatctatcagaggagatgcgaggcccgacagtggatagttgcagctcgtgcacttggctcagagtgggagctatgcctgggagctgccgcgctggtgcatatgtatgaccagttaaatgaagcttctcagagcattggccgacagattgctgacagtgtgactgatgatggctatgatgagacgttaccacgtgcctatcggtggtttactacgaaggcttatatgaagggattaacagcatcgttgtaccgaacatgtatagatgcgctgacgatcattgacggtgagcttagatggggtcccattgtggtcacacttcaactagaaagggtggtgcaacagtttggctactgctcaggagattacatggagtggttcttcgagatatcgcatttgtttatcacacccacacaggcaactgatcagcccaaacatccacctgtcccacaacatgagatatacgtggagccagatatctcggaggttccagtggcagcaggagttggaccgtcacaagatgcttgtgaagcgatcgcagaaaggttggagtgtgtgctcaacctaaggatggtcactgaaggcacaaagttacatgacatcatggaagattgccttaggattgctaggg

SEQ ID NO: 11972 - DNA, 315 bp, Glycine max
  Peptide Sequence Number=SeqID_103657
atggcttctccacctgcctcgcctcctcgtcctcctcctcctccttcttctgacgcatcagcttcatcgtctgccgcggaatttgaaatcctagaggcttttgacactaggatgaaaaagaagttacttcagactgtcgacgagagatggaggcagtttaaatcagacctcatgaggaaatgggcccttgtagccaatcaggacggtgtggacgacgctgtctgtgagaaatacgacataagcaaggaaaaatgggcccaattttgccagactcgcagagacccttcttgggaggatgtgcggaaaaaggcctag

SEQ ID NO: 11973 - DNA, 207 bp, Glycine max
  Peptide Sequence Number=SeqID_103658
atggcattgttaggagtccaaaaggcagatggtgatggaggttctgcagtccagctttatgccaagggatgtagtaagctcctcctacatgttcttaaaagtggacctagtaaaaaggatgatgaagtggtgacaagcataggtgatgagaaagaggtagaagatttttgtgttatggaacgagaattcagaattatgatgcaatga

SEQ ID NO: 11974 - DNA, 1219 bp, Glycine max
  Peptide Sequence Number=SeqID_103659
gggaaatgaccccaaccaaaacccagcgcggttctctgatcttggggagcatcaccatttctctgctgtttttcatcaagaagatgctgctgatttaagttcaagttctatgtttagtgtgaagtcaagcaatgttgttgggggcagtaacatgcagtatgggacgctgaacacggtggtttttcttcctcttactttctgccttcgttgttgtaggaagatgaatgttgggcatgcagagattggttcaagtgggggagggtgcatggatacaagacagcaactgatgtaccacaaaggagtgactatggcagccttgcctttggggaatggtcaagttgagaattgggctgattcaggcaaagcagataatagccaacagactgatgatacatccacagatattgatactgatgatataatcccatgcaatagagttaagaatgggacacgaatggttgttcactccaaggatgagacaaaggtcaaacctggagatcaaaagacccttcgtagactggctcagaatcgggaggctgcaaggaaaagtcgattaaggaaaaaggcgtatgtacaacagttggagagcagccgagtaaagcttgtgcaattagagcaagagcttcaacgagcacgtcagcagggtatatttattgcgactccaggggatcaaggtcatttggctgttggaaatggtgccttagcatttgacatagactatgctcactgggttgatgagcatcaacgtcttctcaatgatctaagaacagcagtaaattctcaaatgagtgatagtgacttgcatattctggtagatagtgtcatggcacattataacgagttatttaggttaaagagcttaggtacaaaggctgatgtattacacatacataatgggatgtggaagacacctgtggaaagatgttttatgtggcttggtggattccgttcatccgaacttctcaagatcatcaagaaccaccttgagccattaacagatcagcagttgatgggaatttataatctgcaacagtcttcccagcaggctgaggatgctttatctcaaggcttggaagcattgcaacaatctcttgtagaaacactttcctccatctccctaggacccactgatagtggaaatgtagttgattacatgggccaaatggcacttgcaatgggcaagcttgctgatctggagagttttgttcgtcaggtatga

SEQ ID NO: 11975 - DNA, 156 bp, Glycine max
  Peptide Sequence Number=SeqID_103660
atgccacttgaaagagaagatgaatcaagaacaagctcaccatcattggaagccatggataagagcttgaagctatggttcagcccacaaatccaagatcaagtccaaggttctccactaagtgtgcctaggtgtcatgaagcatgtaaaacatga

SEQ ID NO: 11976 - DNA, 256 bp, Glycine max
  Peptide Sequence Number=SeqID_103661
atggagaacatgaacgtgcgcataaaaaggggaacctctaaggaagttcaagttggacaactggcaaaacagctatctaaacatagaagtggatctttctcagcaaccacacaggataatgatgagaaaaagaataaagaaagagttgaaaaagaaaatgagaaaaatgatgaagtggagactagtgaaaaagtggaagaaaaagtggtaagtgaagaagagaaaaagaaatcaaatgaacaaaccactaatgaag

SEQ ID NO: 11977 - DNA, 210 bp, Glycine max
  Peptide Sequence Number=SeqID_103662
atgaagatgctcttgataccacatgatgtaagctccattggagcttcggaatggagaaggaagagagagaggagacgccacttcaaggagaagatgagtctagaagaagctcaccaccataggaggccatggataagagctttgaggaagaaggagataaatgaagggagaggaagagaagagcacaaaattttgtgctctgaaatctga

SEQ ID NO: 11978 - DNA, 1037 bp, Glycine max
  Peptide Sequence Number=SeqID_103663
taacgagctcaaacttagaaaagccaagagggacaaatcaagtatggaaaacctgatgttagaggataagttaaagagttgtcagagatcgaagagaagtttgagagaacagttgagcaaaacaaaagaaaatatgttgataatcattgaccaatatgaagagaaggtgaacctagctgctagtcatgggcgaaggctagaagacgaacaggcaaaagtgtcgaccttgcaggttgaaagggaagcaagagaaggggtgatagagttattgcataaagaagccatgaaatggatggacaaatttgctcttactctaaatgagagccaagagatcccaaggttgttagccagagccaaggcggtgactgacacatactctgctcccgatgaaaacgaacgcgctttacggtacccttaccaaacacgtgccaaggctagaatcatgagtgagatagatgaagttcaagagcagatgaaggccgacatggaggccatgaaagaccaaatgaccaccatgatggaggccatgatgagcatgagaaaaaatgatggaggtcaacgtggctgcaatcgttgccataaatgccgctaccgaggtggactcgactcacccatctggtatcaatcaagccaatcgtccagtcctggatatgatgggtcagggaagcgaagttttgggaaggagacacctaaagttccccgagatcacactctggccaacttcaagcctcaccttggatatgccactgaggggctgcctcctgccatggtggaaagggaaaaattcgatcatataaaggaaaggccaagggccattgaaggaggcagagactatccttttgccgacatggaagaattgtgcctagtgtcagatgtcgtcattcctccgaagttcaaggtgctggatttcgacaaatacaaagggactacttgccccaagaatcacctaaagatgttttcactgagctgtcctcctctggctgagcgcatgatccgttgggcgcataaaagaacctggaagaagatgacctgtacag

SEQ ID NO: 11979 - DNA, 186 bp, Glycine max
  Peptide Sequence Number=SeqID_103664
atgggagggtacatcctttgtgaacaagagagggtacatctcttgtggatcagttcaagtgaagggtacatccacttggttgttcaaagagaacaagggagggtacatcccttagggatctttgtttgtaaaggattttcaaaggttgaaaagaaatttgaaggacgcaggtcgcttggggactag

SEQ ID NO: 11980 - DNA, 222 bp, Glycine max
  Peptide Sequence Number=SeqID_103665
atgaatgagttcgagatcatcatttttctgagacagattttgtggtgtgcgagaaaagagagggttttgagaggaggatggaagacaaaattgagaggaagaggaggcctagaagctattgtcagtctgaaaacggatctaacatgccgctatttatcactagttgaccctaagagaataaacggagtgttaggaattaggattggtcttcctttcccatga

SEQ ID NO: 11981 - DNA, 861 bp, Glycine max
  Peptide Sequence Number=SeqID_103666
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggaggatgaccttgttccattaaatttggagattgaggcaacctataggagaatcaatgtttcaaggagacgaagagagcagcaagagagacaagaaaatctaagggaaagaggagcctcatcctctgcatcatcttcaacagttcctgtggtctttgagaaactgacggtgtccaatccgcatcacatctttgaggagcctttaatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 11982 - DNA, 851 bp, Glycine max
  Peptide Sequence Number=SeqID_103667
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcactgtctcaaccatgattccagtgaaattgtagtatcggtgaagatgccgattacccgcgatgggacgaaaagaccccggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11983 - DNA, 818 bp, Glycine max
  Peptide Sequence Number=SeqID_103668
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcacgtttcctgtaccaagtaatttaccacaacagcagcaacatgcaatgactgcaacatccacgcagtcaaaaatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11984 - DNA, 417 bp, Glycine max
  Peptide Sequence Number=SeqID_103669
atgaccatgattacgccaagctcgaaattaaccctcattaaagggaacaaaagctgcccgggggatccactagttctagagcggccgccaccgcggtggaactcccattccccctatagtgagtcgtattacaattcactggccgtcgttttacaacgtcctgactgggaaaaccctggcgttacccaacttaatcgccttgcagcacatccccctttcgccagctggcgtaataacgaaaaagcccgcaccgatcgcccttcccaacagttgcgcagcccgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 11985 - DNA, 187 bp, Glycine max
  Peptide Sequence Number=SeqID_103670
atgacggcaatagcgacgaagtctatttcgttgaagcctttgggaagagatggcaccgtgaggcgccatttggtggaggagattccgattaaagcacggaccaaaggtgacgcggaggtagctgaaggcgtcgccggtgtcgggcatgtcgacgacaaactcagtgtatcagaaggcgaagaggagg

SEQ ID NO: 11986 - DNA, 436 bp, Glycine max
  Peptide Sequence Number=SeqID_103671
cccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccccgtcagtagctgaacaggagggacagctgatagaaacagaagccactgggagcacctcaaaaacaccatcatacactaaatca

SEQ ID NO: 11987 - DNA, 824 bp, Glycine max
  Peptide Sequence Number=SeqID_103672
atggtgaaagttggaacctcttacgtgccgatcaacgtctcattttcgccaaaagttggccagggcttccccggtatcaacagggacaccaggatttatttattctgcgaagtgatcttccgtcacagtggcttctgtttctatcagctgtcccctcctgttcagctactgacgggggtggtgcgtaacggcaaaaagcacccgccggacatcagcgctggcaagtgtagcggggcgatcggtgcgggcctcttcgctattacgccagctggcgaaagggggatgtgctgcaaggcgattaagttgggaattcgatcagtcactccttgtctcagtttctcgttgggcctcactcatccgtcggcactcatctcggcctacaacatcaaagaataccgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 11988 - DNA, 474 bp, Glycine max
  Peptide Sequence Number=SeqID_103673
atggtcgaggaaggccggcgggtcctggtgttctcgcagttcaccggcatgctggcactgatcgcgcatgcgctggaggagctcgggctggcctatgtgaccctgaccggctacacccaggaccgggctacgccggcaggtggcgtcgggttgaacctgaccgccgccgacaccgtcatccacttcgacccctggtggaacccggcggccgaaaaccaggccagtgaccgcgcccatcgcatcggccagcagcagccggtgttcgtttaccggctgatcgccgcaggcagcattgaagaacggatcgccgagctgcaggaacgcaaggccacgttggccgactcgattctggaaggcggcggcgctgcggggccacgcttcagcgaggaagacgtgcaggcgctgctggcgccgttgccgggcgtgcccggcaaacgttcccgtaaagcgggcaaacggtcgacgcgagcctga

SEQ ID NO: 11989 - DNA, 445 bp, Glycine max
  Peptide Sequence Number=SeqID_103674
taccgagaacactaacaatcttagtagtgcttcctccatcttcggaaacgaggagaacgtgagcgaagcgggtggtaaaattcttgagctcctcgacgacgccgttgaaggcgatcccaccagaaaagacgagcaaagcaggctgagggtgagggtgaggagggaatgtcaccattctttctctctcttcgaggaggttcttcagccgtcgcactcgtctctgactcatgcagctccaccgtcggacaccggagcgaatcgatcgccttcttcagcctctggatctcgtccttcttcagccttgcaacactcatcgccatcggagctcgaagatgagagggcagagagtgtttcttctctctcccccactctctatgacgacaatgaagagtcacgatacaagaaaaagcaagatatagggttgttaaagctaacccagttataa

SEQ ID NO: 11990 - DNA, 387 bp, Glycine max
  Peptide Sequence Number=SeqID_103675
gaacatactgagttgaagttggtttctcatgagaggaaggtagagaaatttggaaggcctacacttaagattgaaggcattgtgtctgctatagaattaagttctctgattatatgtttgttggagacaggtgtcttccatatctttgatgctatagatgtagaggaagttgttgacttattagttaagttgcttgaagtcaatacacaagaagcaaaagatgagactaagcaatacagaggggcatatgttcacatagcctggctacgagacatttatcgtaacaaatgtgacgcaagacaatggaccctagcagctcgagcatatttattgcatctagtaggttgcacactctttgctaacaagagtgtcacacatatcaatgtg

SEQ ID NO: 11991 - DNA, 398 bp, Glycine max
  Peptide Sequence Number=SeqID_103676
gcggtcacgctgcgcgtaaccaccacacccgccgcgcttatgcgccgctacagggcgcgtcccattcgccattcaggctgcgcaactgttgggaagggcgatcggtgcgggcctcttcgctattacgccagctggcgaaaggggggatgtgctgcaaggcgattaagttgggtaacgccagggttttcccagtcacgacgttattgattgaaggacaggcccattatgtcattgatacaactagatttggaaatgtctctaggtttatcaataacagctgctcgcccaatcttgtgagttaccaagttcttgtagagagcatggattgtgagcgtgcacatattggtctttacgcaaatcgagatgtaagaacccttctctatatgacgttcccttga

SEQ ID NO: 11992 - DNA, 277 bp, Glycine max
  Peptide Sequence Number=SeqID_103677
atgaacaacatgatgacgctacagcacacggaagttaaagcatcctttgaaacaagcaagaatccttccacttgtgattatgtcatgagaaccacacatggtcttccatgtgtatgtgagctatctaaatatgttgttggttgcaccccactagattcaatccatatgttcttgaggagacttagtttttcagatcaagggttatctgagcccgaagtgaccatcaaggaagagatggaaaccatatctaaaagatttgaagaacttgatgtttgtg

SEQ ID NO: 11993 - DNA, 831 bp, Glycine max
  Peptide Sequence Number=SeqID_103678
atgtcatcaagcaaaggtccccggacgaaattagggtatgacaccgctctttgtgtatggttggttttgcatttattccaacaagacgtaaggcatccatgtccgttcagaagccatcactcgtgtgtcgagaaaagaagagtagattgggaccaacacttggctgggataggaggcagaacagtcaattggttcccacgatggaaagaaggaaaggagggtgttctcttctcatgtgggggctacccaaacatcccgttgataggaacgaggggttgcattaaatacaatccctcacttgctataagacagttatggtaccccatgaggggagcaccgacggaagaaagcctgtctcctttccttgtgagagattttggcgcgcaaaatttcaaggttatacaaagagtccataaggcgtgggagagcccgttaaggaaagataaagaacttaggggcattcgtaatggcatcattggtggttatcatgaatggctgaaagttcgtacacggggtttagattggctcgccaagttaaagattatcaacgaagagaatttcgaagctccagaagaagatgaagaagtccgggctctgaaaatcgaagtaggaaaagcgagacttgccaaagaaaaattcaagttggtcgctatagatgcccggaaagagtgtgtcgagttacgagaagaaaatgcagctaccgcaaaagcccttgaacaagaaaccaagagggctcgcaaggaagagcatggccgtgataaattccgtggagcattgtggggcagcaacagtgagctcaagcttcgaagggaagagagagaccgatcatga

SEQ ID NO: 11994 - DNA, 276 bp, Glycine max
  Peptide Sequence Number=SeqID_103679
atgactcatcaggattttcaagtgcaagccattggtcagtttgctcaagcaacctgcactcctgagtttggacttccaagactgttcaatcagagattactcgtcttgcacgttggtggggttgccgtaaaacaacgaagaagcgagttgtcaagaatagaatgttggacaaatggcctcagttatcttaagaaagggggggttgaattaagatgcaaagactattccccaattgaactatcactctttctttttggattaacaatgcacccttaa

SEQ ID NO: 11995 - DNA, 249 bp, Glycine max
  Peptide Sequence Number=SeqID_103680
atgggccaagggcgatcgagtgcgggtttcgctattcgccatggcgcaaagggcggatgtgctgcaacggcgattactagttgggtaacgccagggtgtccagtcgaacgtgtgtggcaggagaaaaaagcgacgctcgctaccgtcggtcgtcatgcggcgagcgcagaactagtggttaccccaacggggcggaattcggatcgagcgcaccaggaagaacttaacagggcagagaggtcgggataa

SEQ ID NO: 11996 - DNA, 364 bp, Glycine max
  Peptide Sequence Number=SeqID_103681
gaactcgattgcttcttcagtggatattccttttttgctgaagtcatcttcttccttggcaaaccttccggctgggacctcgttatccggaactaggcccgctttgtcgctctcttccatgcccacctttgctttcccctttgggtccatggaccgcactagtggctcaagtgccgcgaagatctgcttgctacgggtcatgccactcatgccagagatgttagtgaccttagaagaggatagatcacctttaaagtgtgttgcaacccaccctttggcgggagggcaacgcggggctcacgggtgtgtcttccaagggagaaagggtgtttccctcgctcctacgtatcctcaatttcgatga

SEQ ID NO: 11997 - DNA, 606 bp, Glycine max
  Peptide Sequence Number=SeqID_103682
atgacgaaagacgtcaatcatccttatcacaacgtctctaacggcagctactccaactttgaaagcctggagtttggcagcctgataaccgccattgataaagtcgatgaccacaccgtgcgctttaccctggcacacccggaagcgccgtttgtcgccgatctggcctggtattttgcctctattctctctgccgagtatgccgatgcgatgctgaaagcaggcacgccggagaaggtggatatggagccgatcggcaccgggccgtttaagctggcgcagtatcaaaaagattcccgcatcctgttcacggcgtttgccgactactggcagggcaaatcaaagctggaccggctggtgtttaccatcacgccggatgcctccgtacgttttgccaaaattgaaaagaacgagtgtcaggtaatgccgttcccgaacccggcggacctgccgcgcatgaaagccaataaaaatattaacctgatgagcaaagccgggttgaataccggtttcctggcgtttaatacgcaaaaaccgccgctggataatgtgaacgtccgccgggcgctggcgatggccattaataagcctgccattatcgacgcg

SEQ ID NO: 11998 - DNA, 660 bp, Glycine max
  Peptide Sequence Number=SeqID_103683
atgcaggacaacactttgatttctgaggtttttgggataaaagtggtcattgaccaatcccttttccatgacttaacccaattgtccagtgatggtgtaccatttgaaggtacactgaatgatgattggaaatttgatttttctgcacatgatgcccgccagttggtttgcaccaaccatacggatatgaccggacgccttcttgtcggttcattggcttttgaaagccgcatccttcattatctgattgtgcggattttgcttccacgatcttccaatcttgcccaggtttctgaggaagatcttgttatcatgtgggcctttcataccgggcgtcaacttgactgggcacaccttgtcagatttcgcatgcataaggcattgcgattaaatgagcatgatggctcttgggtaaaaaagggtgctcaacccgctgatgaagaaggcaacctaccagttgaagataattcctctcttcttcaaaggcttttgggcaagtttgatggtcttcagacttttgttggtgacaagtttgatgccatggaattgcaagtcgacatgcggttcgatgccatggaatcaaggatcaccaaagttgaagatgtctccttcatccgtacttgctttgatccaccaccaccgcctccgtcatcatcttag

SEQ ID NO: 11999 - DNA, 360 bp, Glycine max
  Peptide Sequence Number=SeqID_103684
atggatgagtttgacgcgcaggtggcctggctaggagcccagccttctccttctggaggggatgggacctccacaacccaggagcctgagccagaggagccagcagtagcagcagagggggaggatgagctaattcctcctgagcccttttattttgatgcaggtgtacacatggctcaggaggaggaaacttccacagaccagattccagagccatctccagtacccatacctgatgattccataccatctgcaccagcatttgtgctagagcagcctatccctcaggattcaccagctgctcaggtgttggatctcaatgagcatgcacaggagcaatcacaagagcaggacatttaa

SEQ ID NO: 12000 - DNA, 264 bp, Glycine max
  Peptide Sequence Number=SeqID_103685
atgggtaagggttggggtcctagcgctactggtgcagagtatactggtagaagttgttgttcaattgcacccagcccttatagttggccgcctgctggtcagccaaatgctgcatgtagagctccatcctcttcatgtgagtcgagatggactctagagatggtggctactgtagaggtggcagtggtgcgtttacggccggctgctgatgttggtcctgccccagctgctatgccttccttggcatgcaatacttctcaatga

SEQ ID NO: 12001 - DNA, 477 bp, Glycine max
  Peptide Sequence Number=SeqID_103686
agaaagattgggatttgcaacttctgcctattaccttgatctgttaagcctctttccgaatgctatcaccatcccaggtctagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12002 - DNA, 518 bp, Glycine max
  Peptide Sequence Number=SeqID_103687
atggacctgaatcgaatggaatcaaatgcaatgaaacggaatggaatggaatggagtgtaatggaatggactcaagaggactggactcgaatggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12003 - DNA, 803 bp, Glycine max
  Peptide Sequence Number=SeqID_103688
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattaagagaattatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12004 - DNA, 418 bp, Glycine max
  Peptide Sequence Number=SeqID_103689
gcggcgccgcacagggcggcggcaaacaatacttttttcagaaaacgcatgctgcttccttgttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12005 - DNA, 552 bp, Glycine max
  Peptide Sequence Number=SeqID_103690
atgaagcacttcactgacaccctcatcagtgccaacataggaacaaaagctggtaccgggccccccctcgaggtcgacggtatcgataagcttgatcctgtagtcatcagcacttggacaacaagacgttgtgagcgcgtttgtggacctttaccaagtgcaaatgtctcgaccagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12006 - DNA, 316 bp, Glycine max
  Peptide Sequence Number=SeqID_103691
atggcagacacggctaacaaatcacacattatcttgctttcaaatagtctcccaattgatacacaaagtatgtcatttttaggagaaactagcagtcagacgattatcaactcaaggttggctttcatttttccaaatggatcaattattcacaatgatactggcgtttacttccaaacttcaactccggtgcccattcgagtaccaaatagctgtgattttgcaagcctaaaaaccagaatacacaatacccttcagctatccgacaaacaatttttggatgaaatttactaccggaagccattcaccgatacag

SEQ ID NO: 12007 - DNA, 528 bp, Glycine max
  Peptide Sequence Number=SeqID_103692
atgtgggaaattaaagggagttaccataagcaactaacgttgttctggaatcgcaaaacagccctacacccatatatgtatgcttttgatattattgacacactccaaaatagactcaaattgcttctaccaccactatctgatgtggaagcaaagttttccaaatttattttgatgatgtcaaagactcaagtcaagaatcaagagtcaaacaagtttcaagaatcaaagagtcgttcaatcaagaatcaagagtcaagtgaagagtcaagattcaagtgtagaatcaagattcaagtaaagattcaagaaaagactcaagatatgcaagaacttcaagaaaagcatcaagataagtataaaaagattttttcaaaagaaaagattgaatatcacaatttgtccaaaagattttttcaaagaaaaatcttttaccagagtttttactctctggtaatcgattaccatgaggcagtaatcgattaccagaagcccaaacagttttataactgttttacaaagttgtaa

SEQ ID NO: 12008 - DNA, 200 bp, Glycine max
  Peptide Sequence Number=SeqID_103693
atgccacccgacatgattgtggttatcgttgttgcccctgtcgtcgcgacgagaacaacaatgacaagagtcatgttgatgacaatgtgtggtggtcatggtaggagtagcggcggtgacatcaattatgatggtcatggtggtggttattgtggcgatgatgctcacgatagtgggggtggtcatgatggtgatgaagg

SEQ ID NO: 12009 - DNA, 738 bp, Glycine max
  Peptide Sequence Number=SeqID_103694
atggaggtgaatgcggctgcaatcaccgctaccagtgtcgtcgctaaggtggacccgactccctcatctagcctcaatcaaataaatcatccaacctcggatatgagcaagcatgccttcctgccatatggcttgccccctaactttgcaccacctagtgtaatgcgccctcccgatgagaatgtcaataactccactcttgtactcatcaagaaccaacaacctctatccaatcatgcatatgtccctcaactcatgggggagacatgtgaaataccccaccacaatctagccgacttcgagcctcgcctcggatatgccgttgaagggcaagcagttggtggtgtgcccctgccaaacactttggagggccctcagttcctcccacaaccacaacccttgcattttgtggcaggaagaatccctcttgctatggcgaagaagggaaagttggatcaaatagaggaaaggcttagagccgttgaaagaggtggaagttatgctttcgctaacatggcggaattgtgcttagtgcctgacatcgccatccctccgaagtccaaggtgtcacaacatgcccttttgcgggcatgcgaggcgaggctcacgggtgcgctttccaaaggaggaaagatgcgtggagtcgccaccaacgtctatttgtgggaaacgtcagaaaaaccgaaggaaaccggtcaaaacgaaaattctaagttcgggagttgtatttacgtttga

SEQ ID NO: 12010 - DNA, 240 bp, Glycine max
  Peptide Sequence Number=SeqID_103695
atgccctcaccttcagagggctacgcgccctcaccttcagagggctacacgccctcaccttcaaaggactacacatccacgccatcagaggactgcatgtccaggccatctgaggactacatgtcctcgtcatcgaaggactacacgtcctcgccttcagaggactacacatcctcccctttagaggactacatgtcgtcgccttcagaaagccgcacgccctcgcctttagaggactag

SEQ ID NO: 12011 - DNA, 222 bp, Glycine max
  Peptide Sequence Number=SeqID_103696
atgccagcgcgacatagggatcacgcccgcaggacacccagtggacccaaagaagtccaacagggtcctggggtttccagctctgattacgggcctctaggtactgcgcccccaggcaggcacaaggcgaaacaccacagaagcctggggatggccagtaacaggcaacaaatgcaccgccgccacctccagagcccctcagctcatccacaaaaaggttag

SEQ ID NO: 12012 - DNA, 369 bp, Glycine max
  Peptide Sequence Number=SeqID_103697
atgaaaaccctcaaaggtccaagcctgcatctcgcgcagttcagcgatgagacagcgccgttcaacagcctgcccgccattgccgagtgggcggcgcagaccggctttagcgcgctgcagatcccggcctgggatcggcgtttattcgacgtggccaccgctgcggaaagccaaacctactgcgatgatttgaccggcatgttggcggaacaggggttggtggtcagcgaattgaccagccatatcttcggccagctgatggcggtacacccggcttacgatgcgctgtttgacagcttcgcgccgccggcgctgcagggcaatccgcaggcgcgcggcgagtgggcgcggcagcaaatgctgctggcg

SEQ ID NO: 12013 - DNA, 471 bp, Glycine max
  Peptide Sequence Number=SeqID_103698
atggtgtttttgagtgctccagtggcttctgtttctatcagctgtccctcctgttcagctactgacggggtggtgttatccgtaatcggcaaaagcataccgccggacatagcgctggcaagtgtagcgggcgcgccctttgccagtcgggaacctgcgcaactgtatgggaaggccagcgatcggtgcgaggcggtttcgctattacgccagctggcgctaaagggcggatgtgctgcaacggcgttactatgttgggtaacggccagggtgttccagtcgaagtgcgttctgtggcaggagaaaaaagcgacgggctcagcagaatatgtgaatacgactcactatcagggcgaattcgctcagagctcctaccgctcggtcgtcatgcggcgagcgctcagaactatggcttaccccacggggcggaattcgattcaagcctcctgggaacagccaggaagaacttaa

SEQ ID NO: 12014 - DNA, 339 bp, Glycine max
  Peptide Sequence Number=SeqID_103699
atgagaagtggtgtaagacagtatttagcaaaatcatcacagctcattaacaaggctgcggataaaccaaacaggggttcccgcaccgggagcagcgaacggaggtgtatgtggagagtggcgatatcattctggctggcgtgcgcgtcggcgcgcaatcgctattaccgcagcgcaggcggtgccgcccagcagtcaatgacgcaaacctggcaggatgcggtcagtgcgattcacaagctcggcgatcgggtggagaatctgggggcgcgcgtggtggccgtgaggctgaccgcccagggcaacggcagctgtctggtcggtgctgaaaatcaaccg

SEQ ID NO: 12015 - DNA, 824 bp, Glycine max
  Peptide Sequence Number=SeqID_103700
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12016 - DNA, 213 bp, Glycine max
  Peptide Sequence Number=SeqID_103701
atgaaagtcaaacacaagcgttatgcgacaagtacactagactcaagcctacatgcaatgtggtaccatttttcaatgaaaaacctcatcgggcacctaggagtacacgacaggacatgcctcacagtggaaagaccagtcaaggtcacgctattttgcgagaatgctccaaccatgtgggatcggcacaggcttaaaggagcactcaactag

SEQ ID NO: 12017 - DNA, 114 bp, Glycine max
  Peptide Sequence Number=SeqID_103702
atggcaagtgacagctcatcaaatacaggggataacatagcaagtcaagaggaagatgctacagtagcaacaacaggggtacaccaaccaaacaaaaaggtgcaattaaaataa

SEQ ID NO: 12018 - DNA, 477 bp, Glycine max
  Peptide Sequence Number=SeqID_103703
atgtctcttgctaccttgtttggaaagttacaggaacatgaaatggaaatgatgagattgaatcaacatgaagagaatgataagaaaaagaaaggaattgctcttaaagcttcatcatcaacccaagaaggaagtgataagaaggatttgattgaaatagacgaagatgatgattgcccaaaatgttatgaatgcaatcaacttggacatctgagggttgattgcccaatgttgaagaaaataatagagaaatctgaaaagaaagtcttcaatgaaaagaaggctaagaaggcctatgttacatgggatgacaatgatatggactcttttgaagaatcagaaaatgaagttgtaaacctgagtctaatggcaaggaattatgaaagcgatgaaaagagttggtacatagatagcagatgctctaaatatatgacgggagatgcatcaaaattcactcatttctcccaagaaaaatag

SEQ ID NO: 12019 - DNA, 255 bp, Glycine max
  Peptide Sequence Number=SeqID_103704
atggttgcgtcttccaagaaaggaaaatgtgcgaagtcaccaccaacgtttattcgaggaaaatgtcagaaaaaccgaaaaaggtgtggtctacgaactttaagtgtgaaaggttcagaagttgtttttacgcacggggaagggggagaaacgttaaggcgttggaccattaacgatctcttggggtggtcgacaaaagcggggcttttgctcctacgtatcctcaattgcgatgaggaaatcagacttacgtag

SEQ ID NO: 12020 - DNA, 360 bp, Glycine max
  Peptide Sequence Number=SeqID_103705
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttctgccaacatagtaagccagtatgcacactccgccctttagcgcccgaatacgcaaaggcccgcccatcgccctcgcgcaacgttggccgattcagccttgaatggcgaatggcgacagcgtttccctga

SEQ ID NO: 12021 - DNA, 258 bp, Glycine max
  Peptide Sequence Number=SeqID_103706
atggaagaagatgaaaatgcccttatcatattgggattcccttttttgaatacttgtgatctagaggttgaagttagacttggatatgctactaagttcaagtatctttcagagttttgtgctccggctggagaaaaagagtggaaatgcaggagatttgaggaaggtcttagacatgagcttaagagaatcattattcctctagacatcatagtgtttcatcttcttgtggagaagagtaaaactaaggagtactag

SEQ ID NO: 12022 - DNA, 544 bp, Glycine max
  Peptide Sequence Number=SeqID_103707
atggtctgtaatgaccatgttgatatgaccggcagattgcttgctggctcattcacctttgaatgtcgcattatgcattttatcctttgtcgagttttgcttccacgttccaccaatcttgctcaggtctctgaggaggatttaatcttgctatgggctcttcaaatcggtcaccaaattgattgggcccatcttgtcaggtaccgtatgcataaggcattacgggccaatgcacctctttcgtatcctcatcttgtcactctatttcttcattatttcaatgttcctttagaggatgaaccttttgttaaggttaaaagatcatttgctattgatgctggtgctttcacctcctttgggtaccggaaggatatggatggccaatggatgcgtaaacaagaccttccacctcctattcctgatgaacacacaccctccctaccaccacaacgagatacctcctattccttattgaatgacgttctcactgagctacgggatctttgggctttcatcggcgatcgcttcaatgcaatggactcat

SEQ ID NO: 12023 - DNA, 495 bp, Glycine max
  Peptide Sequence Number=SeqID_103708
tcgggaaacctgtcgtgccagctgcattaatgaatcggccaacgcgcggggagaggtggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctccctcactgactcgctacgctcggtcgttccactgcggcgagcggaaatggcttacgaacggggcggagatttcctggaagatgccaggaagatacttaacagggaatggtggcgaaacccgacaggactataaagataccaagcgtttccccctggcggctccctcgtgcgctctcctgttcctgcctttcggtttaccgttcgctccaagctggactgtatgcacgaaccccccgttcagtccgaccgctgcgccttatccggagttagtcttgaagtcatgcgccg

SEQ ID NO: 12024 - DNA, 240 bp, Glycine max
  Peptide Sequence Number=SeqID_103709
atgtgtcaactatgcacaggtggccttgttggtgcttgcacgcttagcgcaactctggctcgcttagcgcgcattagtaaatttcggcttagcgctcatcttttcgctcagtggatggactcaagcggtgcgcttactgggattagccctcgcttagagaacatgcacaactcatccttcttccagattctttctcgcactcagccaaaggagtgttgcgctcaacggatggctcgctaa

SEQ ID NO: 12025 - DNA, 729 bp, Glycine max
  Peptide Sequence Number=SeqID_103710
atgtcggctctgaaagaacaaatggcctccatgatggaggccatgttaggacggggaagggacgcactggggcacgatggcagccctcacctgagatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgcctcaacccaacctcgcagcatcgccaatagttttgtctatggaaaggccgcccccggcaaccgaagaaaggaggaagctcgacctccttgaggaaagattgagggctgtggaaggatttggggactatccatttgcagacatgacggatctttgcttagtacccgatgttgttattccccccgaagttcaaagtgccggacttcgacaacttggccggagctgcggtagtgtggttgtcgcaacctacccttcggcgggagggcgacgcgtgactcgcgggatgcgtgttccacgaaaggaatacgcacggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 12026 - DNA, 147 bp, Glycine max
  Peptide Sequence Number=SeqID_103711
atgaggacgagagaggcacttgcacagattaccaaacaaatacaaagtgagtgctccaagaaagacagacgaatggactgcgacggaggtgcagcggaggacggaggtgacggcaagcagacaactaaagatgcgaggctgcaatga

SEQ ID NO: 12027 - DNA, 153 bp, Glycine max
  Peptide Sequence Number=SeqID_103712
atgtgggatcgacacaggcttaaaggagcactcaaaccaggtgtatttacccccaaggcctacacttcgaagaatccgtcagggtctctccctcctgattcagaaactgctcatgaattatacaatacccacaacctcacactcgggttttaa

SEQ ID NO: 12028 - DNA, 406 bp, Glycine max
  Peptide Sequence Number=SeqID_103713
atgactagaggcaatccaggtgacttacaaccctttgatcctcaaatagatagaacatttcatagattagttaggcatagtgtgcatcttgattaccctgaacattttgtgccttttgagcatcctgagcattctgttactggtgaatctgagtattctgttgttggtaatttcgaacatcttggttttgagcattataattttgaacattctgattttgagcattctgattttaaacattctgaaaatatggctcaacctccacctcatgagaggactctaaggaaaatggctgcacctgatttcacttatgaaagattgtgcattcaataccctaataaggatgtcccatatgttcttaaaataggactgatccacttgttgcctaagtttcatggacttgcag

SEQ ID NO: 12029 - DNA, 114 bp, Glycine max
  Peptide Sequence Number=SeqID_103714
atggaggtagctgaagacgccgccagcgatgggcatgtcgacgacaaactcaatgtagcagaaggtggagaggagggtaaaggtgttagtaggtataaggcatttttcaagtag

SEQ ID NO: 12030 - DNA, 888 bp, Glycine max
  Peptide Sequence Number=SeqID_103715
ttatccagaactacgtagttctgagttcctcattgaggatacgtaggagcaagagcctcgcttttgtcggcagccccacaatctctgtcatactgaccctggggtcatgtgacatgcggagacaaattatggtcattctgcatcttttgtcatccagaggcgacgggcccgatgacatgcggagacaaattatggtcattccgctcatcttttgccattcagacacagtcgtgtccgatggcacgcagagacaaattatggtcattctgcgtcttttgtcatccagaggcggcgggcccgatgacatgcagagacaaattatggtcattccactcaccttttgcaattcagacacagttgtgtctgatggcggcgggcccgatgacatgcgggaaccatttggtcccgcacttttttaccttttgtcatccagaggcggcgcaccggatgacatgcgggaaccatttggtcccgtactttttcaccttttgtcatccagaggcggcgcaccggatgacatgcgggaaccatttggtcccgtactttttcaccttttgtcatccagaggcggcgggcccgatgacatgcgggaaccatttggtcccgcacatttttaccttttgtcatccagaggcggcgggcccgatgacatgcgggaaccatttgtcgagaggtgggcgaagacaaattatggtcatttccccacaccttttcgccatccagaggcgatcgtgtccggtgacacgcgaagacaaattatggtcattctgcgccttgtgtcaaccaagaggaacgaattcgacagtatcaggatgatgttggtcatcgatactgatcactttaaaatttttgcaggttctgctggcagggagattcaccggtcgaatg

SEQ ID NO: 12031 - DNA, 458 bp, Glycine max
  Peptide Sequence Number=SeqID_103716
atggatggttttgacgttaatcaagctattgtagtaatggccgcaacgaataggccagatatacttgatcctgcactatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12032 - DNA, 366 bp, Glycine max
  Peptide Sequence Number=SeqID_103717
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatggcacgacctctgctcactgcaaactccaattcccaggttcacaccattctcctgcctcagcctcccaagtag

SEQ ID NO: 12033 - DNA, 360 bp, Glycine max
  Peptide Sequence Number=SeqID_103718
ttggaactcttacgtgccgatcaacgtctcatttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 12034 - DNA, 710 bp, Glycine max
  Peptide Sequence Number=SeqID_103719
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtgcaaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12035 - DNA, 75 bp, Glycine max
  Peptide Sequence Number=SeqID_103720
atggaggatagggcaaaagcgctaggcaatgaactcgcggggctccagacagactcgttggtggaggatgcatga

SEQ ID NO: 12036 - DNA, 818 bp, Glycine max
  Peptide Sequence Number=SeqID_103721
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttttaatgaggagtggtgctattttaccactttcttttgtctctaagcaaaattctggttcaatccccaagctgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12037 - DNA, 387 bp, Glycine max
  Peptide Sequence Number=SeqID_103722
atgagtgaaatagaggagcaagagcagatgaaggctgacatagaggccatgaaaaagaaaatggccacaatgatggaagccatgatgagtatgagaagaatgatggaggtcaatgtgactacagttgttgctgcaagtactgccacagaagtggacccgactcacccatctggcctcaaccaagtaaatcgcgcagcctcggatatggtaggtcagggaggcgaagtgttaggaagtacgggcggcccccatttgtgcaagttcagaacaagcattccttcccaccatatggcttgcctcccaactatacaccacccaatgttacacacactcccaatgagaatgtcgacaactctgcacccatacccattgagccaacaaccctaa

SEQ ID NO: 12038 - DNA, 312 bp, Glycine max
  Peptide Sequence Number=SeqID_103723
atggccgctacagggaaacctgtctgccattcgccattaatgaatcggccaactgcgcaactgttgggaagggcgatggtgcgggcctcttgcgtattagcggcgagggcggagtgtcataggcttactatgttgggtacactgatgcagggtgtccagtcgaagtgctcatgtggcaggaaaaaagctgacggtgcgtcagcagaatatgtgatacagactcactatgccgcattctcggactccacgcggtgtgcggcgacggaaagctctagaacgtggcggagatttcccccggagctgcaggaatga

SEQ ID NO: 12039 - DNA, 495 bp, Glycine max
  Peptide Sequence Number=SeqID_103724
atgcccttcttgggacctgcaagtagttcaggccctgtgcccaggcccatgccagggaagcactgcccacagggccacctcctttcttctaaaagggtcagctctagagacttctcaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12040 - DNA, 446 bp, Glycine max
  Peptide Sequence Number=SeqID_103725
gagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctgcacttccctgttgtactatccgcaacaatctacaggaaaatacaccgtatatgatcgaattcctgcgcccgggggataaccactgttctagagcggccgccaccgcggtggagctcaacaattcgccctatagtgagtcgtattcacaattcactggccgtcgttttttccacaaccgcaagaggcccgcactcgatcgcccgcgcgttgccgttctaacagttgccgcagtttccctgaatggcgaatgggacgcgcctgtagcggcagcaattaagccggcgggtgtgagtggttag

SEQ ID NO: 12041 - DNA, 291 bp, Glycine max
  Peptide Sequence Number=SeqID_103726
ggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttctgcaagattatccagaactgaacatcgaattcctgccccgtggggccgcctcgatcgcccgcgcgttggccgtcattaacagttggcacgacaggtttcccgaatggcgaagggagcagcctgagcggcaagcaattaagcggcgg

SEQ ID NO: 12042 - DNA, 396 bp, Glycine max
  Peptide Sequence Number=SeqID_103727
atgacgaaagataacaattggtacctcaaagccttacactggggcaatgaggggcatgaagtgaacataggggcagatcaaaataccctcgtctttagagggctgctcgtcctcgccttcagagggctacaagccctcgcctttagagggctacacaccctcgcctttagagggctacacaccctcgccttcgtagggctacacgccctcaccttccgaggactacatgtcctcaccttcaaaggactacacgtcctcgacttcaaaggacaacacgtcctcgccttcgccttcagttcatgggccacacgccttcatcttcagaggaccaaacatcctcatcctcagaggactacacgtcctcatcttcagagggctgcacgccctcacctttag

SEQ ID NO: 12043 - DNA, 165 bp, Glycine max
  Peptide Sequence Number=SeqID_103728
atgctgaaactaaaggagacagacgagtgcggtggagaaagagagaggaaagtgaaaagtgaaggatgtgcggaaaggaacaaaaattcgagttctgtggaaaaatttataggtgatttggagatggtggcggtgaaggagagtaatggatctaactcgttgtga

SEQ ID NO: 12044 - DNA, 249 bp, Glycine max
  Peptide Sequence Number=SeqID_103729
atgtggtgttatgagtggaaaaagagtgaggctttgagagttggaaggttaagtctgaattctgtggtaaatggagatttttgctgtgaaattgtgcagcaggattttgcacaagtgcagaaaaatgctatgtttttgctggttgtggaaagagtagtgcagaatgagttctggatgtttgctagtagatcccaacggtcacaatgtaggcttatgcactatagacttccagtaaaattttggagttga

SEQ ID NO: 12045 - DNA, 788 bp, Glycine max
  Peptide Sequence Number=SeqID_103730
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatcaaaattttgaagaagaagcatccacctgatcaatctaggtttaccattaggcttcttcaacaggtacctcaaagatgcatggttgataaagacagtgatatgggatccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12046 - DNA, 741 bp, Glycine max
  Peptide Sequence Number=SeqID_103731
atggtgaaagttggaacctcttacgtgccgatcaacgtctcattttcgccaaaagttggcccagggcttcccggtatcaacagggacaccaggatttatttattctgcgaaaagtgcatgctctcgcgcgtcacgagtatcaagcttattcggcataccctgtcttcctgttcagctactgacggggatggtgtccgctcacaattcggcacacaagcataccagccggaacatcagcgggcaagtgtagcctggggtgcagacgctgacgctaactcaccaccccgccgcggcgcgtccgctttgccattcagggaaacctgtcgtgccaactgcttaagcggccaacgcgcgggcgatcgagtgcgggtttcgcgtattacgccagcggcgctaaagggcggatgtgctgcatacggcgattactatgttggcactgataacgccagggtgttcagtcagaagtgcgttctgtggcaggaaaaagctgcaccgcggaaaggctctagaacggggcggagattcccccggaagctgcaggaattgaacttaacagcgcgaagtgagagggccgccggcaagaagaaccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccg

SEQ ID NO: 12047 - DNA, 156 bp, Glycine max
  Peptide Sequence Number=SeqID_103732
gtgatccacccccaacaggaagaagtcgaagaaattgagaaaagaaaaagattcaagaatatagcgcaagatgatgcacctcaatgggagagaagtcaaaaaattcagaaaaacaaagaactcaagaatattacgcaaggtgatccacctaaatag

SEQ ID NO: 12048 - DNA, 573 bp, Glycine max
  Peptide Sequence Number=SeqID_103733
atgactacaggtgatccaccccaacagaagacaagtcaaggaaatgagaaaaagaaagaagatgagaatattactcaaggcgatccaactcaacagaagagaagtcgaaaaatcggcataaagaaaaaattcaagaatatagcacaagatgatacacctcaacgggagagaagtcaaaaaattcagaaaaacaaagaactcaagaatattacaaaaggtgatccacctaaacagaagagaagtcaaggaaatgagaaaaagacagaagacgacaatattactcaagtgaatgtcactctagaagcatttgagaaatatgctttaagggaagggagtggaaggtggaagagaaacatatgggttcattgcgaagacgaagacaaagttccactctggaagacacctctgataaaatattacacacaccaggcaaatgtggctaaccggaaagactctgcaatgaagaaacaaaaatttcacgggatgagttcctgcattggacgagatgcgggaaggagcgcaagttccatctcaagagcagaccagacattaagaactaccatgatgctttaa

SEQ ID NO: 12049 - DNA, 216 bp, Glycine max
  Peptide Sequence Number=SeqID_103734
atggcagaagaagatgcactttctcttgacaacattgaatgtggtgtatgtgctgagtacaccgatgtcggtgtatatggaagacgaaactctggatcaaacaaggaagcgttcgaaatgggagaacgacaattacatttgtcgtgtacacattctgaacggtggaacagaagtatcaaggttcattgcgaagatgaagacaaaggtccactctag

SEQ ID NO: 12050 - DNA, 156 bp, Glycine max
  Peptide Sequence Number=SeqID_103735
atggttgctttgatagaaggagcagcaactacaaacggcagaggaccaagtatatcggacacctacactaaacaacaaccaggaaagaaaatacaatatgctcctcatcaaggagttacttacaacctacattattttaagatcaatctgatttga

SEQ ID NO: 12051 - DNA, 135 bp, Glycine max
  Peptide Sequence Number=SeqID_103736
atgaacaacatcaacggcgaattaaagaggaatacagatttaatacctcacggaggtgcgagggttcagcgaaaaaggtttaggggaagaggttcaggaggcgcgagggttcagcaaaacacagtgaatgcctga

SEQ ID NO: 12052 - DNA, 372 bp, Glycine max
  Peptide Sequence Number=SeqID_103737
atggaagaagaaaaagcagcgtcacacggcgacgagctgacctgtaagggcgagagagctgcgatgttcgagcaaggtcttggcttttcctcttcagcaccaaatgacgacattccaaaaccctcctcctccttcctctccaaattcgtcgaagcctcctccgagtcgaagaagcaagcgcagctccaatccatccacgacaatctcaagaaatatccttcattcgagtctagggttttgagcagggatagggacagcgatagaagtagaagacgaagcaagagcaaagaaaaacgtaggaagaggagcagaagtggagatagatacagggaaacgcgaaggagctactttctttcggtgccgcaaatctag

SEQ ID NO: 12053 - DNA, 222 bp, Glycine max
  Peptide Sequence Number=SeqID_103738
atgacggtctttcattttttcaactgcgccattctcaccttcggcccccatgctgtcttctattttgccacgcccttatctgagtatgatacactcagaacctctatcaaagccgctgttgtttatcttgcaacgacattagtgaagcttatttgtctagctacttttctcaaggtttcggagagtgatagctttgatccgtatcaggttgaggaaggatga

SEQ ID NO: 12054 - DNA, 150 bp, Glycine max
  Peptide Sequence Number=SeqID_103739
atgcctaatcctgcaaagttcataactgagacgtccatctcccaacttgcagggggtgaggaagggacggtgaggctttggggtgggaggacctgtggctgtgactatgaggcttcgggttcggtggcaggagtatcaaagggagcctaa

SEQ ID NO: 12055 - DNA, 495 bp, Glycine max
  Peptide Sequence Number=SeqID_103740
atggtgaaagttggaacctcttacgtgccgatcaacgtctcattttcgccaaaagttggcccagggctgtcccgcgccgtagctgtcccttcctgttcagctactgaggggtggtgcgtaacggcaaaagcaccgaccggacatcacgctggcaagtgtaaagcgggtgcacgagctgagcgtaaccaccacacccgccgcttaattgcttgccgctacagggcgcccgtttcccattcgaccattcaggctgcgcaactgttaatgaggccaacgcgcgggcgatcgagtgcgggcctttcgcgtattacgccggcgctaaagggcggagtgtcatacggcattactatgttggcactgatgcagggtgtcagtcgaagtgcttcatgtgggaaaaaagctgcaccggccagtcgaatatgtgatacaggactcactatattccggcattcctcgctcactgactcctacgctcggtccgatgcggcacgctag

SEQ ID NO: 12056 - DNA, 249 bp, Glycine max
  Peptide Sequence Number=SeqID_103741
atgagtgttactgaatacattgatgagtttgagaacctatgcctaatgggtgaagtggaggaaaatgaagagcaaaaaatgagccgtttccttcgtgggctgaataagaacatagcttttgctgttgagctatgtaactacacagatttcaccactttgtgcaccttgtgtttgaagattgaaaatcaaaacaagagtagtgatacgaaatcagagtgtggtaacggaagcaaacaaccaataacgaag

SEQ ID NO: 12057 - DNA, 872 bp, Glycine max
  Peptide Sequence Number=SeqID_103742
gtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagggaacctgcggttggatcacctccttacctgaagatactttcccgcgaacgcacccctgataagggtgaggtcggtggttcaagtccactcaggcctaccagatttcttctcatgccgcctcagctgggagagcgcctgccttgcacgcaggaggtcagcggttcgatcccgcttagctccaccattacagtactgaaacttacttcagagtataccggcgacgcgactaagcgtacacggtggatgccctggcagtcagaggcgatgaaggacgtgctaatctgcgaaaagcgacggttaacgaggcgaaccgggggaactgaaacatctaagtaccccgaggaaaagaaatcaaccgagattcccccagtagcggcgagcgaacggggagcagcccaggacctgaatcagcttgtgcatcagtggaagcgtctggaaagtcgcgcgataccgggtgacagccccgtacacgaagatgcatga

SEQ ID NO: 12058 - DNA, 1179 bp, Glycine max
  Peptide Sequence Number=SeqID_103743
atgtcgcaacgcccaaccgtgaaaagggatttttcgttcggtaatcctacggttcgcgcctggctttaccagattgtcgcgattgtggcggtgtttgctgtggtgggttatctgatccacaacacggtgatcaaccttgccaatcgcggtattacctccggctttggctttcttgagcgcaacgccggtttcggcatcgtccagcatctgatcgattacagcgaaggcgatacctacgcgcgcgtgtttatggtcgggttaaccaacaccctgctggtctccgcgctctgtattgtcttcgcctcgatcctcggcttcgccatcggtctggcgcgcctgtcggataactggctgctgcgcaagctgtcgaccatttatatcgagacgttccgtaatatcccgccgctgctgcaaatcttcttctggtactttgccgtgctgcgcaatcttccgggcccgcgtcaggcgctgaacgcgttcgatctggcttttgtcagcaaccgcggtttgtatataccgtggccggagtatgcacccggcacctggccattcctgatcgcgctggcgattgccatcgccgccagcgccgcgctgttccgctttaaccgcaagcatcagctgaaaaccggtcagctgcgccgcacctggcccgctgcggccggtttaattgtgctgctgccgctgatcgcccatacgctgtttggtgccgccacgcactgggatgtgcccgagctgcgcggtttcaacttccgcggtggctttgccatgattccggaactggcagcgctgacgctggcactgtcgatctacacctcttcctttattgctgaggtgattcgcgccgggattcagtcagtaccgcatggtcagagcgaagcggcacgttcgctcgggctgcccaacccggttacgctgcgtcaggtgatcattccgcaggcgatgcgcgtgattatcccgccgctcaccagccagtaccttaacatcgtaaaaaactcctcgctggcggccgcgatcggctatccggatatggtgtcgctgtttgccggcaccgtactgaatcagaccggccaggcaattgaaaccattgccatcaccatggcggtttatctgattatcagtctgctcatttcgctgctgatgaacctctataaccgcaaaattgcgctggttgagcgttaa

SEQ ID NO: 12059 - DNA, 655 bp, Glycine max
  Peptide Sequence Number=SeqID_103744
atggccgaggtggccgccacagcggcggcagtgcacctccacccgcagcatcccgaaggtgacgtcccggtcttcgccgatggcgttgtgcagcggcgcccagaagctgggccagccggtgccgctctcgaacttggtggacgaggagaacagcggcagcgcacaaccggcgcaggcgaaggtgccctggcggtgttccttgttgagcgggctgctgtaggggcgctcggtggcctgctggcgcagtacggcgtactgcgccggggtcagctgccggcgccactgtgcatcgctgtgcatgacctcgaactgtcgcgacgggcgcgcttcggcggccgccggggcggcgcggctgcaggcccccaggccgaacaggccggcggcggtggcaacaccgcccaggcccagcagatggcggcgggacagggacatggcgtactccgggaaggggcgacggggccatgctgcgcccgcccgggtcaacgaatcctcacgcaggattcaatttttcgtgaggtatcggcggccgtcccgcgccacaatgcagccagcctccccactggccccgagctgccgatgtcgaccaaacgcgtgctgatcgttgaagacgatgcccacatcgccgacctgctgcgcatgcatctgggcgatgagg

SEQ ID NO: 12060 - DNA, 423 bp, Glycine max
  Peptide Sequence Number=SeqID_103745
atgacaccggggggcggagcctatggaaaaacggctttgccgcggccctctcacttccctgttaagttcttccggctttccaggaatctccaaaaagcccttctaatcatcccggctcgccgcatcgaaccgaccgagcgtagcgagtcagttctagagcggccgcaagcgggagctccaattcgccctatacgcccaatacgcgaagaccgcctcgatccccgcgcgttggcctcattaatgcagttgcgcagccgacaggttcccgaactggaaagacgcagccctgagcggcaagcattaagcggcgggtgtggttacgcgcagcgtgcaccccaggctacacttgctatgtccggctcgtatgttgtgtggaattgtgacgcgaccaccccgtcagtagctgaacaggaagacagctga

SEQ ID NO: 12061 - DNA, 530 bp, Glycine max
  Peptide Sequence Number=SeqID_103746
ggctttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggctgtattgtgagtgtacagtcaatgaaaggatgcttggtatcctcagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 12062 - DNA, 195 bp, Glycine max
  Peptide Sequence Number=SeqID_103747
atggggagtattttcgaagctggattgcttctggaggaaggcgagctgggcggcaacctcctccccctttttcctataaataggctgaagggggctgttctaagggtcctggatctccctggtgatgtatttcagctgttttgggtgaaaaaaattgtttccgtgaagaaaatccaagccgaggtgcttccgtaa

SEQ ID NO: 12063 - DNA, 447 bp, Glycine max
  Peptide Sequence Number=SeqID_103748
atggtgctcggaattaagattcgatggtggagaatgcgcgaacaacgcttgacaatcaagtcatggcgcttcggactcgatggtggaggatacatgaacgacgatcaattcatggggttccgaataagattcgatgatggaggatgtacgaacagtggtaggcattcaattcgtgggactccagactcgatggtggaggatcgcttggcaatcaattcgtggggctccagacttgatggtagaggatgcatgaatggcaatcaattaatggggctccgaataagatttaatggtggaggatgcatgaatggcaatcaattaatggagctccgaataagatttaatggtggaggatgcacgaacagcgcttggcaatcaattcgtggggctacgaactcgatggtggaggatgcattaacgacaatcaattcatggggctccgaataa

SEQ ID NO: 12064 - DNA, 527 bp, Glycine max
  Peptide Sequence Number=SeqID_103749
atggagacgcttcggaaggtccgcaaatcatgggaagtggtacaaaagaaggacaaagagctcagaggcagtaacaatgggcccattggtggctaccatgagtggttgaaagcccacgtgcaaggtttggattggctcccaagtttgagaaccgctaaaagggaggaagttgaggcaccggaggaagacgaagaggtgcaggctcttaggacaggactcgagcaagctcaaacagtcaaagaaagcaacaacgagcttaaactccaaagaaaggaaagggaccaatcgcggttagacagtttgatcttgaaggatgagttgaaggcttgctcgaggtccaagagaagtttgtctcagcgtttatgcgagacagagaccaacatgttagccatcatcagcaagtaccaagaggaactaagtttagccacggcccacgaacatagggtggcggacgagtatgcccaagtgtacgcagaaaaggaggctagaggaagagtgatcgactcgttacaccaagaggcaaccat

SEQ ID NO: 12065 - DNA, 183 bp, Glycine max
  Peptide Sequence Number=SeqID_103750
atggctgctagtgatcatgctatcttgcgtggcaggacacacattcccaccaagagaagtttgttagaactttcatcacaggatgctttgttggcacataacaagttgctgtccaagttggaggttgcactatttgtggtggagttcacgagtcttgttgctgtattcccattgatgaaataa

SEQ ID NO: 12066 - DNA, 869 bp, Glycine max
  Peptide Sequence Number=SeqID_103751
gtcgactctagaggaccccaggtgggggggtttggggacttccagctatcacccatggtagaagaatttgaagagatcctaggatggcctctagggggaaggagaccatacctcttctcagggttctatccctcattagctagaatttctaagatagtccaaatctcggcgcaggaattagaccacagaaagcaagtcgaaaatggggtggccccgttcatatacattctcgcattgttgatcttcggaggagtcctctttctgaatgtggatgggttggtggacctagcaatgatcgacgcttttgttgcctatcatgaccacaaggaaagcccggttgtcgctatgctagccaacctatatgacacctttgatcgaaggggttgcatcagttacaatctcgttcttgctataagacaacttggctaccctatgagaggggcaccactagaggaagagatcgtacctgtcatttcacgaggtttcaataagaccgatgtggagacacttcagaaggtccgcaaggcatgggaggtggtgagaaagaaggacaaagaactcaggggcagtaacaatgggcccatcgatggccaccgtaagtggttgagagcccacatgcaaggtttggattggctcccaagtttgagaaccgctaaaagggaggaagttgaggcaccggaggaagacgaagaggtgcaggcccttaggacagaactcgagcaagctcaaacagtcaaagaaaggttcaaatcagcagctctgaagatccgaaaggagaatgccgaactgagagatataaatacaactactaccaaagccttggaacaagaaaccaagagggctcgtagggaagagcacggccggaacaa

SEQ ID NO: 12067 - DNA, 318 bp, Glycine max
  Peptide Sequence Number=SeqID_103752
gtacaaagaaatcatcatggtgcagcccaaaccaagtgctggcctaaaggggaaacctcaccaacatgctctcactttcatgccttcttgcattcaaaaaatcaaaggcttgggtccctaggcctaagtgccgcaacctacccttcggcgggagggcgacgcgagactcacgggtgtgtcttccaagaaaggaaaatgcacggagtcgccacgaaggtttattcgaggaaaacatcggaaaaaccgaaaagggtgtggtctacgaactttaagtgtgaaaggttcgggagttgtatttacgcatggggaaggtattag

SEQ ID NO: 12068 - DNA, 318 bp, Glycine max
  Peptide Sequence Number=SeqID_103753
atgactaagtggtttgcatctcaatttggttttattaaaattatgctttatgattgtcatcatcaaaaagggggagattgtggaagcaatgacttccaagattattttgatgatgccaaagaatcaagagttaagcaagtctcaaagaatcaagattcaagaacaattaagtttcaagattcaagaacaatcaagatcaagattcaagactcaagattcaagattcaagagaagttgatttcaagattcaagagaagaaatcgagaagcaacagtcaagacttcacaagggaagtatttttcaaaaatccaaacatag

SEQ ID NO: 12069 - DNA, 264 bp, Glycine max
  Peptide Sequence Number=SeqID_103754
atgaacacccactcaaacttagcatacttctaccattgtgcacacagcaccctagtacctagtggaggagtgcatgtagggttttcttcgagccacagttccaagagcagtgtagggggttctgtgggttcgagcgaggggtttccggcagtattgaaaacaatgtgggacaatgtgggtgtcgagggagcggtttccggcagatttcaggtgggaggagaaagagaagagcgagtgcaaggttttcgagcgtgcgggttgtga

SEQ ID NO: 12070 - DNA, 498 bp, Glycine max
  Peptide Sequence Number=SeqID_103755
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggccccgtgatgtcgacgacgatctcgacgccgatgacagaaagagcgagagggagaccgtcaccgcaaacgttcctctggtcgtcacaggagcgagagagagagagatggagagaggaaagacatggataaggatagaaagaggagggataaggataaggataggagagaccgtgatagggacagggagcgcgagagaagagagaaggatagggagcgagagagggaacgagcggagagggagaggg

SEQ ID NO: 12071 - DNA, 228 bp, Glycine max
  Peptide Sequence Number=SeqID_103756
atgacggtgaaaaccttgacacatgcagctcccggagacggtcacagcttgtctatgcgtaaggagaaaataccgcatcaggcgccattcgccattcaggctgcgcaactgttgggaagggccatcggtgcgggcctcttcgctattacgccagctggcgaaagggggatgtgctgcaaggcgattaagttgggtaacgccagggttttcccagtcacgacgttgtaa

SEQ ID NO: 12072 - DNA, 225 bp, Glycine max
  Peptide Sequence Number=SeqID_103757
atgaattgggtacttttgattgaagacattatgttaaagagtcgtgggttagttgactatgaatttccttatgtcgtgcttgcctcaagattcattgaccatttcaatgttgatgtatataatgagataatggattttatcaaagcatctcttgagatcatcgaaagccatctcaagaagcttgggatgaggtttgttgaccatgagtggattatggctggatag

SEQ ID NO: 12073 - DNA, 847 bp, Glycine max
  Peptide Sequence Number=SeqID_103758
atggatgaagatcaatggatgtatgacaatataatgtctgaagaagttgatatggatgatgaaaatgaacaagaatgtgatgtgaatgaacaactgttcacgcctagtcctgatcaagcctcgtctgtagatccctcttgtaagactaaactcaacctagaccgtattaagacacacatactaccaaggactttagaatcagaccagtttctactgttgaatgaccctaacaaagcatgcatctatgtgataaagggaagatccaacagaggatttagctttccattgtccgaaaacctctgttacaacaacgagaagaacaagatgaaagactgcaaaaacacaactggtggccttgttcgtgctcatacgcttagcacacgtatggaccccttagcacatgtgtttgctacccgagatgatgttttgcagtgggctcaatcagttgctcaggaaaacgaatttgtggcggtgattatgaggtctaacacaaacaccggagtgatcagtataggtaggaaatgtgggtgtcccttcaagcttcatgggaaaccagtggttgaagggcaaggaagtgatactgaaatgcaacatctaatgaagcttcttaaacgggatcaatatatttgttggcatagattaaacgatgaagatgtgggtgaacgtgttaataatgtggtgtgggctttagaacggtttcgaggtttatttctaagacatgatgccctccctggaattattgggactgacagagacctagcattgatgaatgcagtgaaaactgtattccctaagtgtacaaacttgttatgtaggtttcacatcgacaataatgtcaaggcaaaat

SEQ ID NO: 12074 - DNA, 648 bp, Glycine max
  Peptide Sequence Number=SeqID_103759
atggacccaattttgttagagccgcagagacccctcgtgggagacgtacgaaaaaaggcacacgccatccagaagcaaaacactgccccccacgtgttgtctcatgggggttatgaatatttagaaaagaagctgatggatgagaagacaaagaaaaaattggaggaagctgctcaatccggaagcattgaggccgtgattgatcctccatctcccatcatacgacacgtgaagtggaagatggcccgcaccaagaaaactggacagatgacgtttgaggcagcaaaggaaattgctgagaagattgattcattggaggagcaagcgtcacggggttccgttgtcccccatggacgtcaggatgtccagactgctgccattaggcgaccagaacacctttgtcgtgtgcatgctgctggagccgggccaggacttgcactgcctccggagcctaacgttgttccttcagttgctcatgtcagcataaaggagagttgtgttgatccctcagggaacgatccagaaacgggtgactcagacaaatgcgagttgtacatcaaagaaaatcttcaccgccagttgccctatgaaaagtttacgagggatcgacaaccgttgacaacatccctttgttgcatgatcaagtga

SEQ ID NO: 12075 - DNA, 318 bp, Glycine max
  Peptide Sequence Number=SeqID_103760
atggatatctttgaagacacagacatccctgtaattttgggaaggccattcatgttgaccgcaagctgcatagttgatatggggaagaggaagctagagctaggttttgaaaatcagaaaattgattttgatttttttgttgaagacaagcctgctccaaaacacaatgtttgcttacaggtaatggaaggaggtcaagaggttctgaaagaattctctgaagaactcgttatgcgcacctaccatgctaagcaagttcattctttgaggatgaacactcatcctcttgctgagctacctgtggctaagcgaggctga

SEQ ID NO: 12076 - DNA, 534 bp, Glycine max
  Peptide Sequence Number=SeqID_103761
atggctcatgagaaccctagggccttctcttgcatctttggcccaatcttcttggagtcttctatccaatgcccttggggggctcgcttgcctctagttgacaaaggtgcagatgatgacgttagtcactgcatgctaccggacccgttaattaggcaagctttggaaaatgttgtttttcaccttctcgctaagccaatatgttggcttaatgagcgtccgctaagcgcaacactgctaggctatgcgcgaggaagaatccaaaagacgatgagctatacaggttcgctgagcgcatcgctccaggtcatcaagcgcaccgcttcagctcatccgctaagcgagagaagtgcgctaagccaaaatccagtaatgtgcactaagcgaacgagcacgaacaaggccacctatttaagcctaaaattagattttgtgaatagagtttggactgggattcagagctttgcatgtctagggtttctagagagagaaaggtccaagttccagagagttttgagagattttgctgtgtga

SEQ ID NO: 12077 - DNA, 387 bp, Glycine max
  Peptide Sequence Number=SeqID_103762
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccaaaattccagagaagcttttgagcttagcgcgcaaggtcgcgcatagcgggtactacaacttcgattggtcctgcaacttgcgcttagccgccaaaggctgcacttag

SEQ ID NO: 12078 - DNA, 579 bp, Glycine max
  Peptide Sequence Number=SeqID_103763
gaaggcgctgaccttgcggttgatgcgggtcatcaaagggctgctgagcgggcgctcgatgtcacagaacagaatcacgcgggttacgtcggtttcgttcttcacccagtgcacataggtctcgtcgaacatcacgtcctcaccgtcgcgccaggcgtagggctggccgtcgacgtagatgcggcaattgtcagaattcggagtagacaggcccaggtgataacgcagggagccggcaaacggatcgcggtgcgggttcagatggctgccaccgggcagcaaggcgaacatggcgcccttgacattggggatgcggctgaccagttcgacggtcttggggcagagcatttcggccgagggcagcggcttgtcgtaccacttcaggtagaagcgcttccagcccttcttgaagaacgagccgaagcctgcgtcattgtccttttccgcggcacgaatgtagccctcgtcgaacaggcgcatggcctcttcgcggatcacttcccagttgtccttgagcacatcgagctcgggaaaccgctgacggtccaggtaaggcttggacggcacgccggaaaacag

SEQ ID NO: 12079 - DNA, 579 bp, Glycine max
  Peptide Sequence Number=SeqID_103764
atgtcgtttgaattacctgcattaccgtatgagaaaaacgcgctcgagccgcacatctccgccgagaccctggaataccactacggcaaacaccacaacacctacgtggttaacctgaacaacctggtgaaaggcagcgagttcgaaggcaaatcgctcgaagagatcatcaagacctcaaacggcggcgtcttcaacaacgccgcgcaggtgtggaaccacaccttctactggcactgcctgtcgccacagggcggcggtgaaccgcagggcgaactggcggcggcgatcgtcaaatccttcggctctttcgctgcgttcaaagagcagtttaccgatgccgcagtgaaaaacttcggcgccggttggacctggctggtgaaaaaaccggacggcgcgctggcgatcgtcaacacctccaacgcggccaccccgctgaccggtgaagacaaaccgctgctgaccgttgacgtgtgggaacacgcgtattacatcgattaccgcaatgcgcgtccaaaatacctggaaaacttctgggcgttggtcaactggaccttcgcagcggaaaacctggcgtaa

SEQ ID NO: 12080 - DNA, 237 bp, Glycine max
  Peptide Sequence Number=SeqID_103765
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcttgtagacaacattgcggttgcagcattcaatgctgaccttttccacctctgtcacccttgttgcccaaattcctttgatctctaa

SEQ ID NO: 12081 - DNA, 437 bp, Glycine max
  Peptide Sequence Number=SeqID_103766
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttgatggtgctgctgcattagtgctagtgagtgaagagaaggcacgtgagcttggattgcatgtaattgcaaagataggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 12082 - DNA, 414 bp, Glycine max
  Peptide Sequence Number=SeqID_103767
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 12083 - DNA, 483 bp, Glycine max
  Peptide Sequence Number=SeqID_103768
atggcgcctactagacaccctctagacccagagaagtccaacagggccctagggttttcggctctaatcacgggtctttgtcagtcctacggagttcttgtcacccccaacaaggtgcagggtgacgcacatcaggccacgagcgcactgccaccacctcagcaggccgatccggctgggccacagggcgtggagcattatctacagcatttggttcgccagcaggcgaccaaccaccgtgggcaggtgcagatacatgagtgtctctaccgattcagcctcaatcagcaggagcagggttccgtcccttttgtatgccttaccccggagcagtttggggccgaggtcacatggcctggagactggcccgatgcccaggtaggggaggagcctacaggatcccctggtgaggcggatgagtcctatatggatgaaaatatgacggacctgctcggtttcttgggagggagcggagccacatga

SEQ ID NO: 12084 - DNA, 251 bp, Glycine max
  Peptide Sequence Number=SeqID_103769
ccttcatcgagaagtactgcacgcctaggcaggcgcagggtgatgcgcatcaggccgcaggcgcaccgccaccacctcgacaggccgatccagctgggccactgggcgttgagcgttatctacagcatttggttcgccatcaggcggccaaccaccgtgggcaggggcagggctccgccccttttgtatgccctaccccggagcagtttggggctgaggtcgcatggcctagagactggcccggtgcctag

SEQ ID NO: 12085 - DNA, 579 bp, Glycine max
  Peptide Sequence Number=SeqID_103770
cggggaacggaaacttgcgcaggatgtcggtgcgcatacagccgaacttctcgcccttgatgcgatagcggaaatacacgtcgaccgcggtgctgtcgaacacgtcctgcggatagcggtcgccgacgatgctgccgtccggccgcgcgcacaggccggtgatggccacgtacgaatcgcgccgcgccggcggaatggcgtcccaggcggccttgaacgtggccagcgcctcgggcggcatttcgtcgtcgctgtccagcgccacgaccagttccccgcgcgcctcgcgcacgccgcgattgaaggcggttttcttgtgctggttgttctgccagacgtaacggatggggaaggcggcgcgctgctgccagtcgagcacggcttcgtgggtgttgtcggtggaaccgtcgtccacgatcacccactcgaaatcccggtaggtctggcgggaaagcgattcatacacccgatgcagcgtgcccgcccggttgtaagtggggggaggacggtgaagaacgtcggcgtagcggtcatgcgaactgtgcccctttgcgatttccggcaaaccgcgcggtcttg

SEQ ID NO: 12086 - DNA, 204 bp, Glycine max
  Peptide Sequence Number=SeqID_103771
atggttgaaaatcttcgcaaaatcacccacggaaacgttacggaagcgcctcggcttggattttcttcaaggaaacaatttttttcactaatttcaagtgatcccgaagtacccggagggttgaaccctttctctttcactcctccccctatttataggaaaataggggaagagcttgccacccagctcgcccaggagagctag

SEQ ID NO: 12087 - DNA, 571 bp, Glycine max
  Peptide Sequence Number=SeqID_103772
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccagtttggaaagatggaggagcaaaatgtggaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12088 - DNA, 569 bp, Glycine max
  Peptide Sequence Number=SeqID_103773
ggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtacccagggtgtggctaaagctgttgtcgctgctatgaattctcataggccatgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12089 - DNA, 264 bp, Glycine max
  Peptide Sequence Number=SeqID_103774
atgacaaaaggtgcagaagacaacgttagtctctacgtgtcaacgggctcgcttcccccctggttgacgaaaggtgcagaatacgacgttagtctctgcacgtcaacgggctcgtttaaccctggttaccgtatagggcgtctccgcgttccaacggactcacaggtcacgatagcaaaaggtggggcggtcgacaaaagcgaggcttttgctcctacgtatcctcaatttgtgatgaggaactcagacctacgtagttcttga

SEQ ID NO: 12090 - DNA, 278 bp, Glycine max
  Peptide Sequence Number=SeqID_103775
ggatcgtgaccacaaggcacccagtggacccggaggagtccaacggggccttggggtctccagctttggttacgggcctctgtcagtcctacggagtggccgttgcccccagcaagttcatcaggccccctattaaccgggctttcatcaagaagtattgcgcccctaggcaggcgcagggcgaaacaccacagaagcctggggagggccgacagcgggcaacagacgcaccgccaccacctctagagttcacctcagctcatccacaaaaaggttag

SEQ ID NO: 12091 - DNA, 489 bp, Glycine max
  Peptide Sequence Number=SeqID_103776
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggctcccaacagagggggtttagcctctcatagccataagaggctttacacttcagaagataatagaagaatgggttggatgactaatagcaagaggctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 12092 - DNA, 561 bp, Glycine max
  Peptide Sequence Number=SeqID_103777
tgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 12093 - DNA, 978 bp, Glycine max
  Peptide Sequence Number=SeqID_103778
atgtccattcatctctttgaactcaatgcaactcaatcagaatcagaaaaggaatatatgtctcatgttccttatactcatgcaattggaagtcttatgtatgccttggtatgcacaaggctagatgaagcacaagtagtcagtgtgcgagatgagcttgctaagcgagatctgcagattataaatacgttcctcggcatgaaaaacacgatttttcactctcgtcttctccaaaacgccacccaaagcctaacacctctttctccaccacccacgaccaccggtggctgctacgagccgctgttgcttgccgctgaacctccacacctagaggaacactttaatctaagcggaatcctcctcaaggatttggtggagaaaattcccccaatcctccatttcaaagcttctcttagaagtgccaaaggagtcatcgcgctcagagagctcaatgcgcttagcgagcatcaacgggaaatcctagcaccagcacactttgcaacgcgacgtcaagatcaggaagtcctttttaagcctgatgtgcacaaaattgaggggggggggggggagccaagagaactgttcactactcagaggcctaaagagtttgaatttcagagagagcgtagagcagagcaaggggccaagttttcatcttttagggagattagtgagtttttgagtgattgtgagattcctagaggtggaggagacatccctactcctttggactttagcattgggaaatgtactgtttccttagaattgatagagcaaggactgaataactgcattgctagggatagtgtgcagagttttagttttctttattatgttaggtatttgactccgaatgttgtcattaaccttgtttctgaaatctatactaaatttccttcaatttggtatataaaaccttgcttttggactgacgaacgtgaacgagagaggtacctgagcgacgcaaagagaaactga

SEQ ID NO: 12094 - DNA, 207 bp, Glycine max
  Peptide Sequence Number=SeqID_103779
atgccacttcaaggagaagatgagtcaagaagaagctcaccaccattggaagccatggataagagcttgaaggaggagaagatgaggggagggagaaggagagaaggagcacaaaattttgtgcctcaaatgagccctctaatccaagatcaagtccaagattctccactaagtgtgcttaggggtcatgaggcatgtaaagcttga

SEQ ID NO: 12095 - DNA, 513 bp, Glycine max
  Peptide Sequence Number=SeqID_103780
atggttcaagctacagaaactcttcaagacaaaatcaatatgcaacaagttgcttttgaaatgacgtttgtttggcatccgaatgagagaaggactccattaacacttgaagaagtcaagaccaatctttattccagagagcttcaactaaaagcatctgggaatggtgatgaagcctttgcatctggattatcgatgactaattctgctagaggagagaaaaagaagaaaagtagagatagagttatgaaaatcagagggaaagggaagtttatggtaatgcaggggaccaagcaaggaaatctatacatccttcaagggtccttcaatggtgattttccaccatggagatgtagcggaaggcaaaggagaagaggagaggggaggcaccatccactagggaataagccatggaagaaggagcttcaccaccaagaatgtgccttggataagaagcttgaagaggatgctttaatggaggaaaataaaagagggagagaagtggaactttga

SEQ ID NO: 12096 - DNA, 306 bp, Glycine max
  Peptide Sequence Number=SeqID_103781
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccgaagcttgcctcggctgtgaggtga

SEQ ID NO: 12097 - DNA, 416 bp, Glycine max
  Peptide Sequence Number=SeqID_103782
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccgctcaaggtacggcggtttacggtctaccggtaggtatcacagcctatggcggtctgcaggtagccgataattatcgggctgcggctgctgtcgggaaacctgtcgtgccagctgcattaatgaatcggccaacgcgcggggagaggcggtttgcgtattgggcgctcttccgcttcctcgctcactga

SEQ ID NO: 12098 - DNA, 996 bp, Glycine max
  Peptide Sequence Number=SeqID_103783
atggtaaaagtggcggaggtgacggtccccggtcacgcccagcagcgcgtttttcccgcacgcattgaatcgggtgatgccacagacctttccttcaagcgcgcaggtcaaattgaggcactcgatatacgtcagggtgcagccatcaagcagggtcaacagcttgcgagattaaatgcccgtgaagcccagcagcgggttaacgacagacaaacagcggcgacgctggcccagcggcagttcgatcgctttcagacgctggcgggccgccaggctatctctaaagcagagatggacgtacagcgcgcgaaccgtgattcggcgaatgcggcgctaaagattgcccgtgaagagctcaatcagatgacgctcgtcgcccccttcagcggaacggtggccagcgtgcatgtccgaaaccatcaggtggtgtctgcgggtcagcctgttgtgactttaacccgcacagacctgctggatgtggtgtttagtattcctgagaacctgttcaggacctttgatattcgtaacgcgcagtatcgccccgtggtgagaattaacgccttcccggatcgggagtttaccgccgtctataaagagcactcgggtagcagcgatagcaacaccctgacctggcaggtgatcctcaccatgccgcgcccggatgattttcccgccgtgggaggcgtcagcggtacggtgacaatcaatttaaccaatctcccggcaggtgcgggcgctgaggcactggtcgtcccggtggaggcggtctttaacccaaacaacagcccgcgcaatgagccgcacgtctgggtcgtcgtgagagaaggcgacgcgctccatcttgaagaccgcaaggtcagcgtggggcaagtcaccactgagggcgttgtcattacgcatgggctcaaggcgggcgaacgcgtggtggctgcaggcgtgggtgagcttcatgctaaccagccggtgcgtatctggacgcgtgaacggggactataa

SEQ ID NO: 12099 - DNA, 305 bp, Glycine max
  Peptide Sequence Number=SeqID_103784
ctttggttacgggcctctatcagtcctacagggtgctcgtacccccccgacaaggtcacatcatcatagggatcgcgcctgcaagacacccagtggacccgaagaagtccaacagggtcttggggttgtcaagctctaattacgggtctctgtcagttctacggaggcgaaacaccacagtagcattgggatggccggtagcgggcaatagacacaccgccaccacctctagagttaacctcagctcatccgcaaaaaggcgtccagctaaagacgttaaagaagcgctactaggaggcaaccta

SEQ ID NO: 12100 - DNA, 192 bp, Glycine max
  Peptide Sequence Number=SeqID_103785
atgtctttgaaattctttgtgtcgcaacgtgcccttcgcgggcgagcgagggcgaggctcacgggtgcgctttccaaaggaggcaagatgcgcggagtcgccaccaacgtttatttgtggaaaacatcggaaaaatcgaaggaaaccggtcaaaatgaaaattctaagttcgggagttgtatttacgcttga

SEQ ID NO: 12101 - DNA, 511 bp, Glycine max
  Peptide Sequence Number=SeqID_103786
gtatatcatgaattcaattattacagtgttgtatttcaacggaagagtatatgaagacaatgatggtgtaatatttgaaggcaataaaaaggccattcaggttaaacgcggaattagtttcaatggaaaatatgttgcgttgcaaatttgtgatgacgaagatgttgaaactatgatcgaaagttttcaacaacaacaacaaatgcaagttctagaattgtacgtagaaaaagatgttgctggtggttcgatgtttcatgctgcaaattctgttacgtcatgtggacgtaatgtatctcatcatgagtcggaactgccaagaaatataagcaatttacatgatgatgaagatgatgatgatgatgatgattatcttgcatctaactcatacgttgaagagtctttcgatgaagatgatagtgatgatggaatatctgatacagacgatgaagtcactgacatcgttgaaccagtttcaattgttcacccaaccgaaggtaaatgtttgtga

SEQ ID NO: 12102 - DNA, 135 bp, Glycine max
  Peptide Sequence Number=SeqID_103787
atgaagaacgaacgaagaatgatgaagaacgatcacaaaattgatcacgaaaacgtcacggaagcattacggaagaaaatgaggggaggaggttgcacagaagctcgcccaggaagctggttgcttcatccctaa

SEQ ID NO: 12103 - DNA, 216 bp, Glycine max
  Peptide Sequence Number=SeqID_103788
atggtggtgagcttgttcttccctcatcttctccttgaagtggcgtctcaaatcaccttttcctctttctcttttttgctgccattgatcttcaagaagcaaaggactccattgatgaagaagatccaaggcctacaagctcaacatggagctacatcacctactatgaaagggagcatatggacaagctccaaaggcttagacaagggagtatga

SEQ ID NO: 12104 - DNA, 246 bp, Glycine max
  Peptide Sequence Number=SeqID_103789
atggggctccgaataagatttgatggtggaggatgcacgaacaacgctaggcaatcaattcgtggggctccggactcgatggtgcgctacgcaatcagttcgtggggttccggactcgatggtggaggatgcatgaatggcaatcaattcatggggctccgaataagatttgagggtggaggatgcacgaatagtgttaggcaattaattcgtggggctccgaactcgatggtggaggatgcatga

SEQ ID NO: 12105 - DNA, 147 bp, Glycine max
  Peptide Sequence Number=SeqID_103790
atgcatattcatggacaagattctaaaggaaaaggagaaggaagcaatgaagatcctccagtagaagtcaaagaaaataatgatcttccaagaaagtggaaagcttcaagagatcatttccccttgaaacaaaccaggaagaactaa

SEQ ID NO: 12106 - DNA, 399 bp, Glycine max
  Peptide Sequence Number=SeqID_103791
atgggctgctacggtattggggtgacccgcgtagtggccgcagccattgagcagaactttgacgatcgcggcattatctggccggacgccatcgcgccgttccaggtcgctattctgccgatgaacatgcacaagtcctatcgcgtgcaggagctggcagagaagctctacgccgagctgcgcgcacatggcatcgacgtgctgatggacgaccgtaaagagcgtcctggcgtgatgttcgccgatatggagctgatcggcatcccgcacaccatcgtgctgggcgaccgtaacctcgataacgatgatatcgaatacaaacatcgtcgcaacggcgagaagcagctgattaagaccggggatatcgtgaactacctggtgcagcaaattaaggggtaa

SEQ ID NO: 12107 - DNA, 216 bp, Glycine max
  Peptide Sequence Number=SeqID_103792
atgggcccgaaatctaccctaaggctcataagaaccctagggccttctcttgcatctctggcccaatctactcggagtttttctatccaatgcccttgcggagtaggattgcatcataaagcccctcaaaactttgctttggtcgtgttcttcctttcgggccttcttggtttctcattccaaggcttcatcggtggccatattgacatcccttag

SEQ ID NO: 12108 - DNA, 951 bp, Glycine max
  Peptide Sequence Number=SeqID_103793
atggttttccaacattacaagggaacaaacagaaaacaaatccaagacaagttctacgaatttgtcgaaagagtcaaaattaatgtctttttctttgattggtttcatgcttatgccatcagaaaggatatagtttacccttggaaacaagaaatcataggtgatccaacaacaaatgtcataacaaactggcaagtgagagatggtgagttaatccaatcggaattacctcccacaacacaatatcaactaccaaatatcaaagacagtagtaataaacctgtcatggcaattccattcaaaacaaaagatgtcaacgaggaagtaacctctaaagacattaaaaacctaatggaacaggcaaattataccaataaatacttacaagctttaggagaaaccattaaaactaaagtagttcctaaacaaaaatcaattgagggagctccgccaagtgtccccaccgaaattgaaaaacctttattcaaacctttcaaagttagtgagaaggctaaacggaaaattagggaacttagaaaaactaaatccttaactgagggcgtaggtgacaatcatagtgaattactaaacaagattggtagtttacttaaggttattccagatactccccaaacctcggaaaatacttccaaaatggtaacaagaagtacctccaaattaattaatgttataaatgaagatagtgaccaaacctcagataacacaactgagataggatcagtgtcagaaaagaatataaatccaattaattccaaacactggaaaacaccctccaaattatattaccaacgtccaactgcccctgaccttctattagaagaaagaggtgaaaacaattttaaaagtttcagtgcaaataacatctacgaatggaacatagatgcacaaacggagtataacatcatgaatacactccaacatatgaccatg

SEQ ID NO: 12109 - DNA, 585 bp, Glycine max
  Peptide Sequence Number=SeqID_103794
atgggtgaccaagaggaagtacaggaacagatgaaagccgacatgtcggctttgaaaaagcaaatggcttccatgatggatgccatgctaggaatgaaaaaactaatggagaataacgcggccaccgccgccactattagttcggctgtcgaagcagacccaactctcccaactaccgcgcaccaacctatcccaaacgtggtaggacgagaaagaagcacactggggtacattagcaacccccatccggggtacaaccgagtggcttacccctatggattaccacctaattacacaccactagtcatacatgacgacgcgggtcatgtccctccccccatccttgaagaggagccttctcgacaaacggacgaggtccacgaggatcaccgagagcatgttcagggagacatcgattcctactccccgttccctcccgagggaccggcacgcaacgtgctacctcagcccaacctcacgggagaacctcgaaaccgcccaacacaacgaatatttttgtccgcaggggggccacccctggcagcagaagaaaagggaaactcgatctcatcaaagagagattga

SEQ ID NO: 12110 - DNA, 204 bp, Glycine max
  Peptide Sequence Number=SeqID_103795
gggcaggatcaccttgggctaccttctggagtagagacaaaacatgaacgacagaaaccaatcgaggacgaacgcaagcggggatggggtcacgaccgaccgatcgttgcctttctctgtgcgaaacgagcagagaatgtcgctgcaaggcagccccgtatcctttgtattttgcagctttcttttactatttgtttgttttaa

SEQ ID NO: 12111 - DNA, 216 bp, Glycine max
  Peptide Sequence Number=SeqID_103796
atggaagacgcacccgtgagcccttgcgtcgccctcccgccgaaggaaaccatggatgaacatcaaccaaactggaaggaaatggctaacacaatgatgaagatgaacaaagaatcagatgaaatgttcaacattgttcatgttattgatcagtcttatagtgaagtgggtaggttatttgctgtaagatggaaggatgaactagagcctatttga

SEQ ID NO: 12112 - DNA, 667 bp, Glycine max
  Peptide Sequence Number=SeqID_103797
gtcgactctagaggatccccacgccgtcctcgccaaacggattgagtggattgttggctgcgatggtcagcggacggccgccgccggcgttgtccaacggggccgacgcataaacgccaacgctcttggtatccgacgcaattgcacggaagaagaacgaggtgttgtcggtcagctggtagttgccgttcagcagcaacgagtcaagcgacatcaatgcttccttggccgaggtcgcgccgtggtcgaagccgcagcgggtcgggctgatgcggacgctgttctcgaaggtgtcgcagttggcgacgctggcgctgccggtgcgggcgccggagaaggtcgcgctcgaattgtacgggctgatgccccaggtcagccctgcatctttgacctatttcttgatgtcacggttgtacatcaactcgcgttcctgatggtcgatcacgaacgtcttgttgccacggtcggatctgatgccaccggacaggctgccggtgcgaccggccgggccgatttcaggattttcatagccgacgctgaagcccaggccttcataatccttacacaggatcacgttgaccactccgcccatggcatcccaaccgtacactgtatctgcgccttcacgcaggatttcaatgcgctcgacggcggccgtcggaatcag

SEQ ID NO: 12113 - DNA, 162 bp, Glycine max
  Peptide Sequence Number=SeqID_103798
aggatccccgcatcccctactccagatcagtttagggctgaggtcgtatggcccggagattggcccgaggaccagacggaggaggcacctgcaggagctcccgatgatgcagaggacgcctgcatggatgaggagatgacagaattgctcggcttcttatga

SEQ ID NO: 12114 - DNA, 405 bp, Glycine max
  Peptide Sequence Number=SeqID_103799
atgggtgatcaagagcaaacacaggaacaaatgaaagccgacgtgtcggctttgaaagagcaaatggcttccatgatggaggccatgttaggaatgagacaactcatggagaaaaacatggccaccgctgccgctgttagttcggctgccgaagcagacccaactctcctagctaccgcacaccatcctcccccaaacgcggtaggacgagaaaggagcacactggggcacagcagcaacccccatgtgggatacaaccgggtggcttacccttatgtattgccacctaatttcatgccgccagtcatgcatgatgacgcaggtcatgtcccttcccccatccttgaaggggagcctgctcgacagcccgacgaggtccacgaagatcatcgagagtatgcctaa

SEQ ID NO: 12115 - DNA, 320 bp, Glycine max
  Peptide Sequence Number=SeqID_103800
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgctagccaatgaagttgtccatgctttagcaaaagtggcttctacttatcctagcttccaagtctttagtcatgtcccccaatgtattgctcaatattga

SEQ ID NO: 12116 - DNA, 120 bp, Glycine max
  Peptide Sequence Number=SeqID_103801
atggaatcaagcaatgtgaagaacaagtcaagtggaaaaagaaagatgtctagtgaggacacaaaaagttacttcacatggaacttggaaatagagcgctcacatgaagaggccaaatga

SEQ ID NO: 12117 - DNA, 465 bp, Glycine max
  Peptide Sequence Number=SeqID_103802
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcctcagtacaatacctatctagtatctaatggtatactgaatttagttatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 12118 - DNA, 237 bp, Glycine max
  Peptide Sequence Number=SeqID_103803
gtgagggtgagaggtcatttagtgaagtttgatgaggatactcttaacacattcttgaagacccctgtagtgttggaagagggggagaacttgtgcacttattccaagtttgcactcctgaggcctgatcctcaagagttggctgctaagctttgtatcccagggaggggattcgagcttaatgctgatgggctagctttgaagattctaaggaagaacatgactactctagcttag

SEQ ID NO: 12119 - DNA, 222 bp, Glycine max
  Peptide Sequence Number=SeqID_103804
atggctcttcaaatccacaatggtgtttgggcaagtggatattggctcgttgaagttggcgggtctggtgagggggaggctaatggtggtgatgtaagctccattggagcttgtaggcctatgatcttcttcatcaatggattcctttgcttcttggaagatgaatggcagcgaaatggagaaggaagagagagaggagatgccacttcaaggagaagatga

SEQ ID NO: 12120 - DNA, 918 bp, Glycine max
  Peptide Sequence Number=SeqID_103805
atggaggaaccatcaaagaagcacaaaggttcttcgagtagaagccaacgacactccgaggctcaggatactccaattccttcctccatttcctcatcctcattgttctcatcggaagaacaacacatacgaaagtaccttgatttcagaagtttatgggataaagatggcattgaccaatccctcttctatgatttgacccaattgtctagtgacggtgtaccatttgaaggtgcactggacgatgattggaagtttgatttttttgtgcatgatgcccgccggttggtttgcaccaaccaagcggatatgaccgaaaggcttcttgccggttcattggctcttgaaagttgcatccttcactatcttattgttcatattttacttccaagatcttcaaaccttgcacagatttctgaagaagatcttatagtcatgtgggcctttcataccggccgacaaaatgattgggcacatttagtccggtatcgcatgcataaggaattgcgattaaatactcctttaccatatccacatttagtcactcttttccttcaacattttaacatccatcttgattttgaaccttatgttccaatcaagagatctttcttgatcggtgctgttgtggttgtgtcctttggttaccccaaagagcgtgatggctcttgggtaaaaaagggtgctcaaccaaatgatgatgaaggacaattaccagttgaaggggactcttctctccttcagagtattttggacaagtttgatggactccaaacctatgttggtgaaaggtttgatgctttggaacaacaagtggacatgcgattcgacgcaatggactcaagaatcacaaaggttaaagaagatgtcaccatcattcgcgactgccttgatttacctccaccaccatcagtttag

SEQ ID NO: 12121 - DNA, 279 bp, Glycine max
  Peptide Sequence Number=SeqID_103806
atgggtcttgcagccgacgagtaccttggctgccagcaagatctatctactcactgtgtcgccactattgttagactagatcttgccatgacggccttgcgcttcgtgccaccaagctctatgcctggtggcatcaaggcccacgccaccctccgtcgtggtgcctccgttttgtttcactgtcaaggtgctgctgttgcacctagggttttccaacctttcccttacttgcgggttgggccagatcactccaacccagctctaaccctagcccattaa

SEQ ID NO: 12122 - DNA, 213 bp, Glycine max
  Peptide Sequence Number=SeqID_103807
atggtgaatcaagagtggttcaaagatgttttgatgataacaaagatgataacaaaagatgatgacaagggtgatgaccaaaagctcaaaggtcaatcaaagaatggattcaagagatcaagatttcaagaatcaagattcaagagatcaagattcaagagatcaagattcaagactcaagactcaagattcaagaatcaagagaaggcttaa

SEQ ID NO: 12123 - DNA, 330 bp, Glycine max
  Peptide Sequence Number=SeqID_103808
atgagggttaaaggaagaaatttcctaatgctggatgggaggtgggtgatagaaaatcagaggctttacatagttaatgtctatgccccttgtgatatagctgggaaaagagccttgtgggaggagttaaggcagctgaaagtgtctaatcctaattgtttatggaaattaaaggctttggtggcaggtttacttggtttaggcccaatggtactgtcaagagcagacttgatagatttctggtttcagatcaatggatatctctatggcctgataccttttagcatatccttcaaagggactactcagaccattatccagtcatcttga

SEQ ID NO: 12124 - DNA, 69 bp, Glycine max
  Peptide Sequence Number=SeqID_103809
atgaatccgaacacggtgtcgaatgttttgaggatcaacggtgaacaagaaaaagatagctacatgtga

SEQ ID NO: 12125 - DNA, 117 bp, Glycine max
  Peptide Sequence Number=SeqID_103810
atgggacaccttagggttcccatgaaccctaagagaataaaggtcattcctgagtggcctgctccaccaagtgtgttgaggaaaaaagcccagagtttcaagaacctcgggatttga

SEQ ID NO: 12126 - DNA, 66 bp, Glycine max
  Peptide Sequence Number=SeqID_103811
ggaagagatatgaggctctcgaccgatagggagaggaggaaggatttgcttttgaatctagtttag

SEQ ID NO: 12127 - DNA, 579 bp, Glycine max
  Peptide Sequence Number=SeqID_103812
atgcttccttcgaaagtcgtacgtcataaagcaggacgcctggtccctgttttgctcgcgggcctgattctggccgcctgtagcggccagggaccgcagcaaacctcaagcgtaaacgttcaggggcctgccacgggccgctctgactattatctgcagcaggtgcagcaaagcagcgatgatagcaagaccgactggcaattacttgccatccgtgccctgctgaaggaaggaaagtatccacaggcgcaaaaccagctcggtcagctgccacagcagctctctgatgtacaacagcaggaactgctgctgctgcgcgcccagctgcaaattgcccagcaggatttcaacggtgctcagcagctgctgggacagataaaagccgctgacctgtcgcaggatcagcaggtgcgctactacgcgctgcagattgccgctgcgcaaaatcgtccgtcgctcgcgctgctgcgcgcctatattgctcaggaaccgctgctgaaaggcgccgatcaccagagcaatattgacgccacctggcaggcgctgacccagctaacccaggatcagctcaacagcgtg

SEQ ID NO: 12128 - DNA, 453 bp, Glycine max
  Peptide Sequence Number=SeqID_103813
atggcgtcatcgaagaaaacaagggagatgacgactgaggtctcaaaggaaatcgctgagaagatcataagtcattttcaactaaccattagaattatatttcaatattttgtgaatgccatgtacaactgtgtgttttctgtgcatgattcctttgaggagcaggctacacagggatccttcatccccaatggacgtcaggatgttctcaccgctgctattggacgtcgagagcatcttggaagtgttcgtgctgttggagccggtgtcaccatcaagcaatactttggatcggctccacagacgtcccgcaactcttcctccctgcctcccgaagaattgcaacagctgacccagcaaatcaaggaccagctagaggagtccatcacagaaaaattgatgcggcagctcatggcatcattcagccagatgcagtcccagatgcaatcttag

SEQ ID NO: 12129 - DNA, 354 bp, Glycine max
  Peptide Sequence Number=SeqID_103814
atggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgattcccactgtccctgtctactatccagcgaaaccacagccaagggaacgggcttggcggaatcagcggggaaagaagaccctgttgagcttgactctagtccgactttgtgaaatgacttga

SEQ ID NO: 12130 - DNA, 249 bp, Glycine max
  Peptide Sequence Number=SeqID_103815
atgtcagcgtcttccggccgagactgcaaaaaagtctcatttgctatccagtccggtggcatgcggagacacctgatggttatctgcccacacacttttgctatccagcgacccgagagtccgatagcatgtggagatgccttacggttatccacacctcgtcattcagagaccccaagtccgattgacaagcagagaccaatgtggtcatttgcaccctttctggagatgtcaacatcttccggttga

SEQ ID NO: 12131 - DNA, 609 bp, Glycine max
  Peptide Sequence Number=SeqID_103816
atggcaggcacctactccgcccccgaagagattcatgggcttctcggctattggaaaaacgccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcctctcccgtccatgaaaagagagcctccctcagcagcccgacgaagtccataaagaccctcaagattatgctcgaagggatgtcgagttctatcccccgatccccgaagggccggcaccaggcacgttgcctcaacccaacatcgcagcttcgccaatag

SEQ ID NO: 12132 - DNA, 480 bp, Glycine max
  Peptide Sequence Number=SeqID_103817
atgaaaacgtttcagtttgctcatggaaaacggtgtaacaagggtgaacactatcccatatcaccagctcaccgtctttcattgccatacgaaattccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggattcagtttgtatcagctgtccctcctgttcagttactgacggggtggtgcggaacggcaaaagcaccgccggacataagcgctggcaagtgtagcggaccctctgggcgtaaccaccacacccgccgcgcataa

SEQ ID NO: 12133 - DNA, 136 bp, Glycine max
  Peptide Sequence Number=SeqID_103818
atggggactaacaataacaactcagactctcacatcatagctgatttcaatgagtggcttgctgatatggaggtggaggacattccttgcttgggtaagccttttacttggatgaggcctaatggaacctgcaaaa

SEQ ID NO: 12134 - DNA, 306 bp, Glycine max
  Peptide Sequence Number=SeqID_103819
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatccccctcatctccgctgtcgacgagattcgcaacatgcggtgcttgtggcggcacaccaaaacctccttcccgtggctcctttgcttcctccttgcatctgagaaaaagtttgagagctgttctctgcttcttatcgtga

SEQ ID NO: 12135 - DNA, 273 bp, Glycine max
  Peptide Sequence Number=SeqID_103820
atgtctgcgtatttcggccgaaactgcgaaaaagtctcatttgctatccgtaagactcaaagcccgataggatgcagtggcttacgtcatcacttgcaccttacccggagatgtcagggtcttccggccgagattgtgaaaaagtctcatttgctatccgagatgtcagcgtcttccggccgagactgcgaaaaagtctcatttgctatccgtaagactcaaagcccgatagcatgtcgtgaggaacgtcgtcatcagcaccttccccgatga

SEQ ID NO: 12136 - DNA, 189 bp, Glycine max
  Peptide Sequence Number=SeqID_103821
atgtgggatgttgtgggaaatggagatcaaattcctattgatgaagaaagtatgaaacaactgtgggacacccttgccataacatctgaagggtcgtcacaggtaaagaggaacaagcttatagagccttttgaagttttaaaacatggtttggaagtgtatgatcttcaaagccaggaggttgtctga

SEQ ID NO: 12137 - DNA, 552 bp, Glycine max
  Peptide Sequence Number=SeqID_103822
atggcggtgcagctaatccgtgatcgagtagagatggagtgcctggagggagcttgggagaccctcgaaggcaacacgaggtgccgatttcggggcaccattcgattcacggctacttctttggtgcatccagatgaacctgcacggacgcttcagcgcacggtggagtggatactacccacacctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttctcgaggtggattctcccgaggaagtcatgtcggcatctgaggcagactctacggaggatagtggcccgagggagatggcgatcagcggaggctcttcgtcctaccaccgctacggacaccttgctctggatgacactgtattttgtaaaactctcatattttggacagctttaaatgatatatgcatttataatcgatctcgttatttgaaaagaaagcattag

SEQ ID NO: 12138 - DNA, 390 bp, Glycine max
  Peptide Sequence Number=SeqID_103823
atgggggcaaatcaaaacggaaaaagattctatcaagtcaagattaagggcctagatgtcaccagccttaaggagttaggaccattgatgggacccctccaaaggcaagccttccgcaaaatgtacgaaaagattttatatttgaccacagcggaggtatttacggaagccgttgtatccctcgcacaatactatgaccagccgttgagatgcttcacgtttggggacttccaaatagtaccgactgttgaagaatttgaggagattctaggatgccctcttgggggaagaaaaccatatcttttcttcgggtttcttccctccttgagcaagattgcagctgtggtcagagattcggcaagagagttggatcgtatgaagcaaacttga

SEQ ID NO: 12139 - DNA, 1101 bp, Glycine max
  Peptide Sequence Number=SeqID_103824
atggctccaagaaagctttccgcaaagagatccaggaaggacgccacggctgaagggaccagtgcccctcccgagttcgacagccatcgtttcaggagcgctgagcaccagcagcatttcgaagccatcaagggatggtccttccaccgagagagacgcgtccagctcagggacgatgagtacagagatttccaggaggagatagctcaccggcgttggacgtcgctggtaaggggccagtggattccttttgatgcagacgccctcagccagttcctgggatacccgctagtgttggaggagggccaggagtgcgagtatagtcaaagaaggaaccgggccgatggatttgacgagaaggccattgcccagctactatgcataccaggtcaggattttgcccggaccgctgccgggagacgggtgcgaatcatgcacaccaacatgactaccttgacccagacatggatgacgttgctgctcaataacatcctgcccagcgatcataactccgacctccctctgccgaagtgtcagctggtgtacgccgtcctgacacggatgagcgtccatgtggctcagttgatcgctgatgccatttatttatttgcaggtatgccgcctactaggcaccctttagacccagataagtctagcagggccctgggttttccagcattgatcacgggtctctgcaagtcgttcggggttcccgtcacacctagtaaggtgattcgaccgccgatcaccagggccttcatagagaagtactgcacgcctagacaggcgcagggtggcgcacaacaggccccagacacaccgtcgccacctcatcaggctaatccagctgggtcatttgacatggagcagtatttacgacatttggttcgccagcaggcagccaaccacagggcgcatggtttcgctccttttccgtggcctactccagatcagttcagggcagaggtcgcatggcccggagattggcctgagccccaggcaggggaggcatccgtagaggctcccggcgatggagaggaggtccgcatggatgaggtgacagatttgttcgatttcttgggaggcagcggagccacgtga

SEQ ID NO: 12140 - DNA, 291 bp, Glycine max
  Peptide Sequence Number=SeqID_103825
atggcccgcacgaagaaaacaggggagatgacgactgaggccgcaaaggaaatcactgagaagattgattcctttgaggagcaagcgacacagggatccttcgtcccccatggacgtcaggatgttctcaccgctgctaatggacgtccagagcaccctggatgtgtccgtgctgttggagccggtgtcactatcaagcaatactttggatcggctccacgaacgtcccgctgctcttcctccatgcctcctgaagaattgcagcagctgacccaacaaatcagggactag

SEQ ID NO: 12141 - DNA, 240 bp, Glycine max
  Peptide Sequence Number=SeqID_103826
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttttgtgcccgacaaaaatggacaagaacgaccaagaggatcaagggggcagtactgtcaagagaatgctga

SEQ ID NO: 12142 - DNA, 1205 bp, Glycine max
  Peptide Sequence Number=SeqID_103827
atggttcgtggtgccgtcgctgatcgccatgatcaccaccatcggcgtgctgatcgtcacctcgctgtcggtggcgcgcgaacgcgaacagggcacgctggaacagctgctggtctcgccgctcaccacctggcagatctttatcggcaaggcggtgccggcgctgatcgtcgccagcttccaggccagcatcgtgctgctgatcggcatcttcctgtatcagatcccgttcgccggatcgctgctgctgttctatgccaccatgctgatctacgggctgtcgctggtcggtttcggcctgctgatctcgtcgctgtgcgccactcagcagcaggcgttcatcggcgtgttcgtgttcatgatgccggcgatcctgctctcgggttacgtctcgccggtggagaatatgccggacgccagcttcgacatcatctggcacagcctgtggccgctgctggtgatcaccgccaccaccggcagcgccgcctacgcgctgttccgccgcaagatcgcataaaaaaggctctgcatgatttagcggcggttgccgaagatacgcagcaacatcaggaacaggttgatgaaatcgagatacagcgtcagcgcgccgacgatggcgtacttgcggaagctgtctttatcatcggcgttcagctgctcgcccattgccttgagtttttgcgtgtcgtacgcggtcaggccgacgaacaccaccaccccgatgtaggtgatcgcccacatcagcgcggtgcttttcagccagatgttcaccagcgaggccagcacgatgccgatcagcgccatgaacagcatactgccgaagccgctcagatcgcgcttggtggtgtagccatacaggctcatggcgccgaacatgccggcggtgaccacgaaggtgctggcgatcgagctgtaggtgtaggcgatgaagatgctcgacagcgtcagcccggtcagcgccgagtacagcatgaacagcgaagtggccaccgcgccgctcaggcggttgaccatgccggagatcacgaacaccagcgccagttgggcgatgatcaggccgaagaaggtgatctggctggagaagatgaagttgaggatcgcgggcgtgttggccgcataccaggaaacgaacgccgtcagcagcagaccgcaggtcatccagccgtaaacctgcgccatgtaggcctgaatgccgctgttggcac

SEQ ID NO: 12143 - DNA, 466 bp, Glycine max
  Peptide Sequence Number=SeqID_103828
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcccgaaccccccgttcagcccgaccgctgcgccttatccggtaactatcgtcttgagtccaacccg

SEQ ID NO: 12144 - DNA, 468 bp, Glycine max
  Peptide Sequence Number=SeqID_103829
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccaagagagggtctcctccaagagttaggggaagggttgcggagagggagagagggagagaaagtgaaagccgcgctctgcatttttcgagatctgaaaaaaaaacagagaacggagaaacagagagaaacagaacacgagcgagcagtgcgctttttctcttgtgttgtgggtcgggttgtgtgagttttttgggttttattgtggagagggagaggagagagaggcccctcggagtgtccgccaccagcaaggctttgtttggtggtgttggtgagtga

SEQ ID NO: 12145 - DNA, 375 bp, Glycine max
  Peptide Sequence Number=SeqID_103830
atgagttcatctcataagggtggacccttgggtactagtaccctcaccttcagaggactacatgtcctcaccttcagagggctgcatgccctcgccttcagagggttgcacaccctcaccttcagaggactacacgtcctcaccttcagaggactacaagtcctcacctttagaggactacacatcctcgccatcagagaactacatgtcctcaccttcagagggctacacgccctcaccttcagaggactacacgccctcatcttcagaggactacacgtcctcaccttcagagggttgcacgtcctcgcctttagagggctgcataccctcctctcctttagtgggctggacaccctcaccttcaaagggtga

SEQ ID NO: 12146 - DNA, 378 bp, Glycine max
  Peptide Sequence Number=SeqID_103831
atggcatctaagaagaggaaagcaccctctacacctacccaagctagatttgatagatccagattcacatcccaagaggcttgggagagatacactgacattgtagtgccacgaaagctactaccagagaggaatgtggtagtccattacacagagtttgatgagttcaaggaggaactcgagaaaggccattgggatgagaagctgactgatttttctgacagtaacatagacattgctattgtgaaggagttttatgtgaacctctatgaccccgaggataaatcacctaagcaggtgagggtgagagacccctgtagtgttggaggagggggagaacttatttacttattccaggtttgcactcctgaggcctga

SEQ ID NO: 12147 - DNA, 57 bp, Glycine max
  Peptide Sequence Number=SeqID_103832
ccttgggatttgtgcaaggcattctgttagactattattcagagcttagggtttatg

SEQ ID NO: 12148 - DNA, 847 bp, Glycine max
  Peptide Sequence Number=SeqID_103833
gttgcctacagactatagagagatagaggttgccttatgcacacctggtcgagggttcatcttgaactctgagggccatcctgggaagattctcaggaaggatctgactacactagctcaggtgtggagtgtcctcttatactccaacttagcccccacatcacacacttctgacttgacagtggatagagctaggctgatctttggcctagtctctcgcatggatatgaacataggagcgctgatctctggccagatgacctctatagcccagtctaacacttctagacttgggttccctgctttgatcaccgcattatgtagagccagaagggttacctctgatagcctcacttttgagcgcctaagcccaatcattaacttggcctacatcaagaagaattgttggaaccccgaggatctaacagtttctatccgaggggttaggagggcaagggctaggccagctgagctcccttccacttctgcggctcctactccagcatccacgatctattccctcagtcgagcagttcagagagttggtagcctggcctggactcagtcttctcttcacagggaagatgaaggtcccacagctcaggtagctgctgctacttctgagagatctcttgaggccatttcagagcctccaacaccagcagtggatccatcttcacctcagcacgcagcagactcttccactcctgtcttagagatacctgagggccagaccacaccagtcctgactctggagacttctcctccagctactctggtgcttcatctgacgaacgaggaggatgtgcagacacaggacactcaggaccagtcacatgaattttga

SEQ ID NO: 12149 - DNA, 339 bp, Glycine max
  Peptide Sequence Number=SeqID_103834
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggaacgccagggttttcccagtcacgacgttgtaaacgacggccagtgccaagcttgcatgcctgcaggtcgactctagaggatcccctgaatgtttga

SEQ ID NO: 12150 - DNA, 489 bp, Glycine max
  Peptide Sequence Number=SeqID_103835
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtaccccctacagatgctcaaggagatggaggaagagtcgaggaagatgaagacatggcatatttggttgattatttcattggaggagaagtaatgcctcagccatga

SEQ ID NO: 12151 - DNA, 348 bp, Glycine max
  Peptide Sequence Number=SeqID_103836
atgtcacatcttaggccttactcccataggagagaaaaggaaagaaagcctcaagaggccaacattatcctcccatacatccatgggaaggacaatgtagaggtttacttagattgggaaataagggtagagcaacaatttaaaaggaagtcaacttcaaaatattatggccctcactcttatccaaagaaagaccaaggtcaaggcatcttaggggcagcaccttctaagcccaaagatgataaggggaagacaatagaaaagcaaccccttaaggctagtatgcaagagaatactagctctataaagtgctttaaatgtcttggaagaggacacattacttcttaa

SEQ ID NO: 12152 - DNA, 321 bp, Glycine max
  Peptide Sequence Number=SeqID_103837
atgagagaaaaggaaagaaagcctcaagaggctaacattaacctcccatacttccatggaaaggacaatgtagaggcttatttagattgggaaataaggatagatcaaaaacttaaaagaaagtctactttaaaatcttatggatctcattcttatccaaagaaagaccaaggtctaggcatcttaggggcagcaccttctaagcccaaagatgataagggaaagacaatagaaaaacaaccccctaaggcaaaagtggacacattacttctcaatgccccaccacaaaaccatgattatgaggggccaagaaatttatag

SEQ ID NO: 12153 - DNA, 225 bp, Glycine max
  Peptide Sequence Number=SeqID_103838
atgggctcagaaatctaccctgaggttcatgagaaccctagggccttctttagcagctctagcccaatcctcttggagcctcttgctcatggctctagtgactggtcccttcctagggaggattgcatcacaccctcgccttcagaggactacacatcctctccttcagagggttgcacaccttcaccttcagagggctacacgccctcaccttcatatgactag

SEQ ID NO: 12154 - DNA, 159 bp, Glycine max
  Peptide Sequence Number=SeqID_103839
atgtttcaatcatatgggatcagcaaaggcttaaaggagcactcaaacccggtgacccccgaggcctacactccgaagagtccgtcagggcctctccctcctaattcagacactgctaatgaattatacaataccatcgacctcacactcgtgttttaa

SEQ ID NO: 12155 - DNA, 426 bp, Glycine max
  Peptide Sequence Number=SeqID_103840
atgtccccgaccatcaatgggtatgtcctcatcagcgaaggtgaggaactcatttgcctcttcagcagatatcttctttctgccgaagtcttcctctcccttaggaaatctcccagtcgggatctccttatcaagaatcgggtttgccttgtcgctttcttccaggccgtgaagattctcctactacgggttacgccactcatgctagagatgttagtaactttggcagaggatggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatcgacgaacttttaagtgaaaggttcgggagttgtatttacgcacgggaaaggtattag

SEQ ID NO: 12156 - DNA, 442 bp, Glycine max
  Peptide Sequence Number=SeqID_103841
atggcagaatcgtcaaagaaacgtaagggttcctccacctccacttcggcttcaagagctcatcgttccaaagccactagcgcatccacagcaccaattccaccctcattatcctcttccacattgttttcttccgaagaacagcagaaacggtattcaaatctcttctcatctcgttccattatcgaccctaagtttattgatatggaattcttttctgctgaaacttttgattgcattcaagcctttcagaacctaggtcttatacctttcatgtcattacaattgcctgtttatcctgaattggttaaagccttttattgtaatcttgaaattcaggacaacactttaatttctgaggtttttgggataaaaatggtcattgaccaatcccttttccatgacttaacccaattgtccagtgacggtgtaccatttgaag

SEQ ID NO: 12157 - DNA, 375 bp, Glycine max
  Peptide Sequence Number=SeqID_103842
atggcctcgaggaagcttgcctcgaagagatctaggaaggacgccgccgccgtagggactagtaccgctctcgagttcgatagccattatttcaggagcgctgagcaccagcagcgttgcgaggccatcaagggatggtcctttcaccgagagagacgcgtccagcttagggacgatgagtacacggatttccaagaggagatagctcgccggcattggacgtcgctggtcactcccatggccaagttcgatctagatatagtcctcgagttttacgccaatgcttggcctacagaggagggcgtacgggacctccgacgccctcagtcagttcctgggatatccgctagtatcggaggagggccagaagtgtga

SEQ ID NO: 12158 - DNA, 577 bp, Glycine max
  Peptide Sequence Number=SeqID_103843
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaggattccttacaatccagaccataagcccaaatgagaagtttgttttcatggggaatagagtgaaagctccagtggaagcgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12159 - DNA, 93 bp, Glycine max
  Peptide Sequence Number=SeqID_103844
atggagatcgaagaacggacatcaacaaagcatggtgaaggccttctttctaggacatctttgcagaacaaacatgaacatttaagcaattaa

SEQ ID NO: 12160 - DNA, 432 bp, Glycine max
  Peptide Sequence Number=SeqID_103845
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgggcaagagctgttgaagaaggccctagggttctcattaaagcgaggaatatgactcttccaaaggactttttcccaaggcatggcattgttgctttgagataa

SEQ ID NO: 12161 - DNA, 378 bp, Glycine max
  Peptide Sequence Number=SeqID_103846
atggcacctaccagacaccctctggacccagataagtccaacagggccctagggtttccggtgctgatcacgggcctttgccagtcctatggagttccagtcacccccagtaaagtgatccgaccgccgatcacccaggccttcatcgagaagtactgcacgcctaggcaagcacatggtgatgcacatcaggccacagacgcaccgccaccacctcggcaggccgatccagctgggtcactgggcatggagcgttatctacagcattttgttcaccagcaggcggccaaccaccgtgggcaggtgcagatacatgagtgtctctaccgggtgaatgctgtgaaaattttcccgaacgcccaaaatggactcggatga

SEQ ID NO: 12162 - DNA, 462 bp, Glycine max
  Peptide Sequence Number=SeqID_103847
atgaccacaaatgattattacgtccctcatattgaacccaccgaattcgttacccacattagttcatacacacaactgcttggtggatcgtcaaagtactgtgagatgtctccccaactaaatgagtcatcccaactaaatgttgactcaattactgatattcatgttactcagtctgaaagcaacgaaatgtcacatgactatcatgctcaaaatggattgtcggatgaagtagttggtgacttcagtgacgacgaagacaaaattttggtggacaataacaacaacaacaacaatgacaacgacaacgacaacgacgataatgacatacagttccttttccaacaaacatcaattaaaaatgtatatcgtccatatccaaatagtactgatgttggtgacaaccaagtgcttgacaaccccgactataggcatttttttggaccaacaacaacaatctga

SEQ ID NO: 12163 - DNA, 398 bp, Glycine max
  Peptide Sequence Number=SeqID_103848
atggtgagggcgaaggttttgtctgtcaccgggttactcaccttgagtctctgtgtggtgggagagattttggagctgaggtcgtccatctcttcgatgattagggttatgtccggggagaagcgcgagaacatgctgtggatgccgttgctgatgaaggatcggagctccgacggaaggaggtcgcacgccacggagcggaccaccattgcggtggcggccagagaggccgccgccgagagcggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 12164 - DNA, 297 bp, Glycine max
  Peptide Sequence Number=SeqID_103849
atgcacgagacatcggggtttagcatttcaggagacaacatagaacacatgagcattgttagatacaaccctggatggaggaatcaccctaacctcagatggtccagccctcagcaacaacaacagcagcctgctccttccttccaaaatgctgttggcccaagcagaccatacattcctccaccaatccaacagcagcaacaaccccagaaacagtcaacagttgaggcccctccacaaccttccctcgaagaacttgtgaggcaaatgactatgcagaacatgcagtttcagtaa

SEQ ID NO: 12165 - DNA, 414 bp, Glycine max
  Peptide Sequence Number=SeqID_103850
ctgggttttccggcgctgatcacgggtctctgccagtcgttcggggttcctgtcacacctagtaaggtgattcgactgccgatcacccgagctttcatagagaagtattgcacgcatagacaggcacagggtggcgacccgcaggccccagacgcaccgccgccacctcatcaggctgatccaactgggtcatttgacacagagcggtatttacggcatttgagccagggttttgcttcttgtccatgccctactccgaatcagttcagggcagaggtcgcatggcccgaagattggcctgaggcccaagtaggggaggcgtccgcagaggctcccggcgatgcagatgaggcccgcatggacgaggagatgacagatttactcgatttcttgggagggagtggagccacatga

SEQ ID NO: 12166 - DNA, 630 bp, Glycine max
  Peptide Sequence Number=SeqID_103851
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaacgacggccagtgccaagcttgcatgcctgcaggtcgactctagaggatccctccatcaagcttcatgcacatgaagctaagtttcttgcttctaagaggaattgggagtttggtagtggtgttctcttttatgaccgtctttacggcgggggtaccgagctcgaattcgtaatcatggtcatagctgtttcctgtgtgaaattgttatccgctcacaattccacacaacatacgagccggaagcataaagtgtaa

SEQ ID NO: 12167 - DNA, 753 bp, Glycine max
  Peptide Sequence Number=SeqID_103852
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctgatgcagaagtcagtcattggactaacctccactgggatggcttccagatcaccgccctcaaatgtcaatactcaagtataagacatttgcgaatccaaccggattcatttgacaaactggttaaacaaccaaatgttgagatagaagacccagatctctccggatctgtatctcgctaccgattgttcgcctcatggacagtcggcaccatttctggcaatccgaccgcaaagggtgattcatcccttacaccaactgggtcgaccccatggcagcaagaaaaaaaaggcgatcttgtgctatactccggtgatctctttcctaccgaggcacgcaaacccccatcgtgtcccagatcacattccgtaaatcgaaaggggaagcctactcatccatcagctcctctcgtagatcggtgcggttttacgaagcgtctaagcacagttcactcgcgttga

SEQ ID NO: 12168 - DNA, 99 bp, Glycine max
  Peptide Sequence Number=SeqID_103853
atggaggagtatcatggagaagaagatgaagaacaaggacttaaacaaaatggagaaggaggaaaggtgattggagatgccacttcagggagaagatga

SEQ ID NO: 12169 - DNA, 323 bp, Glycine max
  Peptide Sequence Number=SeqID_103854
ggaaagaatgtcatgaacattatacaactttccattgcattgtgtcgcaacgtgcccttcgcgggcgagcgagggcgaggctcacgggtgcgctttccaaaggaggaaagatgcgcggagtcgccaccaacgtttatttgtggaaaacgggaaaaccgaaggaaaccggtcaaaatgaaatttctaagtccgggagttgtatttacgctttgaggaaggtcgacaaaagcggggcttttgctcctacgtaccctcctttggagaggaaatcagacctacgtagttcttacttatgtgtgaaacaagtgattcttttaacttga

SEQ ID NO: 12170 - DNA, 784 bp, Glycine max
  Peptide Sequence Number=SeqID_103855
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaacacccagctggcctacataaactatgatgagttcctggaggagctcgagctgagacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12171 - DNA, 231 bp, Glycine max
  Peptide Sequence Number=SeqID_103856
atgaaaagaaagaaatggaaaggaagaaatgaaaagaaagaaaagaaaaggaaaagaaggattcccgatcgaagatcggaagaaagtaaaaaggaaaagatcggtggaaaacagaataattcccgatcaataaaggaaaccaggaaagagaacagaagatcttcggataaattttcggcgaggatttccattcaaggtcgctcccaactggtgatgtcccgccccagataa

SEQ ID NO: 12172 - DNA, 586 bp, Glycine max
  Peptide Sequence Number=SeqID_103857
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccggacgaaattagggtatgacacctgtcgcaacctacccttcagcgggagggcgacgcgagactcgcgggatgcgtgttccacgaaaggaatacgcgcgaagtcgccaccaacgtttattcgaggaaaacgtcggaaaaaccggaaaagacgcgatctacgaacttttaagttgaaaggttcgggagttgtatttacgcacggggaag

SEQ ID NO: 12173 - DNA, 111 bp, Glycine max
  Peptide Sequence Number=SeqID_103858
atgatcatggttaggactagaggattaggtcgtgccttaggtcaggtaactagcagaggtctgggcagaggagatcatgatgattctgatgatgctccgcaatgtcgatga

SEQ ID NO: 12174 - DNA, 144 bp, Glycine max
  Peptide Sequence Number=SeqID_103859
atgagactgctccggggagatgtcaccaatgagggtggtgccatcaacaaggcgagccctgatgcagcggtaaagttgtgccttggtgacttgttggtcatgggttcgaatccggaaacagcctctttgcatatgcaagggtaa

SEQ ID NO: 12175 - DNA, 276 bp, Glycine max
  Peptide Sequence Number=SeqID_103860
atggagcagtatttacggcatgtggttcgccaggaggtggccaaccacagggcccatatgcggaccaatgagaccctttaccagctgagcctcagcatgcagagccagggcttcgcttctttttcatgccctactccagaccaattcagggcagaggtcgcatggcccggggattggcccgaggcccaagcaggagaggcacccccagaggctcccgacgatggagagaaggcccacgaggacgaggagatggccgatttgcttgacttcttgtaa

SEQ ID NO: 12176 - DNA, 375 bp, Glycine max
  Peptide Sequence Number=SeqID_103861
agacaggcccagggtgatgcaccacaggccgcaggcgcgccaccaccacctcatcaggctgacccagctgggtcatttgacacagagcagtatttgcggcactcgatgcgccagcacgcggccaaccacaggggactggggcaggtccatgagtgtctctaccagctaagcctcagcatgcagagccagggcttcgctccttttccgtgccctactccagaccagttcagggcagaggtcgcatggctcgaggattggcccgaggcccaggcaggggaggcacccgcagaggctcccgacgatggagaggaggctggcatggataaggagatgtcagatttgctcggcttcttgggagggagtggagccatatga

SEQ ID NO: 12177 - DNA, 348 bp, Glycine max
  Peptide Sequence Number=SeqID_103862
ggcgcgtcccattcgccattcaggctgcgcaactgttgggaagggcgatcggtgcgggcctcttcgctattacgccagctggcgaaagggggatgtgctgcaaggcgattaagttgggagagccagtttcagtgggtgtggacaatctaacttggacattggtgaagtttatccaccctgacagtaagctccatcttgctatttcggtgatgcacgaatgttttgagcccctaaaggaatccttatcaaacagagatcttgtggaagatgttatattcagcagatggagtgcagcaaagcaaaccaccatcaagcttatcgataccgtcgacctcgagggggggcccg

SEQ ID NO: 12178 - DNA, 300 bp, Glycine max
  Peptide Sequence Number=SeqID_103863
atgtacaaagataagtgggctcatacagagcccatgggctcaaaatctaccctaaggcccatgagaaccctagggccttctccagcatctctggcccaatcttcttggagtcttctatgtagaagaaagtttcatgatgatgattcaagtatgaatcaagtagttttgatgatgacaaaaagcccaagatcaacaagttcaacaagttcaagatcaagaataatttcaagtttcatgagaagaaatcaagaagattcaagattcaagaaaagtttgatttcaagattcaagagaggatga

SEQ ID NO: 12179 - DNA, 240 bp, Glycine max
  Peptide Sequence Number=SeqID_103864
atgtgggatgataccatgttcgggatgtttaatcaaaacttcccattgtacataaagcatgaacatctctctgaaattgcacacggtggtcaatgtctcagcatatttattatacatttgtggattctgcatctgactgagacaagtatgccagacaactaccttaagggaataattaatagtgctttgaaaggacttgatgatactccacaacctaaatccaaggctgctgctaggtga

SEQ ID NO: 12180 - DNA, 684 bp, Glycine max
  Peptide Sequence Number=SeqID_103865
tggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgattgggtgacaagcttgctagcttagcttttctgttcaaggatatgtactgggtggaagagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12181 - DNA, 627 bp, Glycine max
  Peptide Sequence Number=SeqID_103866
atggccaagttcgatccagacatagtcctcgaattttatgccaatgcttggcctacaaaggagggcgtgcgagatatgaggtcctgggtgaggggacacccaatccccttgggagaaaaggcaatcggccagctcctgagatatcctttagcgctggaagagggtcaggagtgcgagtatggccagaggaggaaccgggccaatgggttcgatgaggaggccatcgcccatttgctatgtatactggggcaggattttgcccggactgctgccgggagacaggtgcggatcatgcgcaccaacatgaccaccctgactcagatctggatgaccttgctgctcagcaacatccagcccagcgatcataattccgacctccccctgccgaagtgtatggcgcctaccaggcaccttctggacccggataagtccaacagggccttgggatttcccgccttgatcacaggactctgccagtcgttcggagtccccgtcgcacctagcaaggtgattcggctgcccatcacccgaacttttattgagaagtattgcacacagagacaggcccagggggatgctccgcaggccgcagacgcgccgccacctcatcaggctggtccagcctaa

SEQ ID NO: 12182 - DNA, 432 bp, Glycine max
  Peptide Sequence Number=SeqID_103867
atgtctctcaacccatgggggagatacatgaaaattccccaccacaatctagccgacttcgagccttgcctcggatatgccactgaagggcaagcagttggtggtatacccctgcaaaacactttggaggggcctcaattttgcccccaaccacaacccttctatggaaaaatggtgggttacacaccttcaagctttgcagatttggtcttcaccggcaaaaggatcaaagtgggtctggaaaaaggcaaatctgatcatcctactttgataaatgcgaaaactggggcaaatgaaaaggatgagaataagggagaaacccttgctatgaccgccattcctacacggtcaaatttcccatcagcccaacaatgtcattactcagctaataacagtccctctcacccaatcatccacaaaggccatccctaa

SEQ ID NO: 12183 - DNA, 432 bp, Glycine max
  Peptide Sequence Number=SeqID_103868
atggcctggcccaaattcaagagaaaaaaactagcataccctagtgcccagaggctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12184 - DNA, 420 bp, Glycine max
  Peptide Sequence Number=SeqID_103869
atgaagcacttcactgacaccctcatcagtgccaacataagatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12185 - DNA, 186 bp, Glycine max
  Peptide Sequence Number=SeqID_103870
atggattcctcgtcaagtcagtttggggggtgtggacacacttgcgcgaattcgggtaacggctacaagggagaaatcgaaaggaaactgtacccaaccagggatggacgtaaactcctgccccgccacagcaggcgggttgcttcctctgtcgtcgccggggagctcttggtgaggagaccttag

SEQ ID NO: 12186 - DNA, 742 bp, Glycine max
  Peptide Sequence Number=SeqID_103871
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggataagtgggagctggaaacagcgaaagtgaaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12187 - DNA, 351 bp, Glycine max
  Peptide Sequence Number=SeqID_103872
atgtcggctttgaaagagcaaatgtcttccatgatggatgccatgctaggaatgagacaaccaatggagaataatgcggccaccgctgccgctgttagttcggttgccgaagcagacccaactctcccagctaccacgcaccaccctatcccaaacatggtgggacgagaaagaagcacactagggcacattagcaacccccatccagggtacaaccgagtagcttacccctatggattaccacctaattacacaccaccagtcatacgtgacgacgcgggtcatgtccctccccccatccttgaaggggagcctcctcgacagttggacaaggtccatgaggatcgttga

SEQ ID NO: 12188 - DNA, 174 bp, Glycine max
  Peptide Sequence Number=SeqID_103873
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttctcaccctggacaggataa

SEQ ID NO: 12189 - DNA, 290 bp, Glycine max
  Peptide Sequence Number=SeqID_103874
atgtcaggatttacacgcgattctcctcaaatttcagctagcccatatcaattagaccttgcaccttacgcttcagagccctacaatgctcaatggaacgccctggggcttctccgtgacaagcacacgttgcgttcgagtcgtattctcggagaaatggagatatgggagcaagtcagcataggatactggaattggggtgaattctacaggctttctcgctgcaaaattcatttcttggttggtgttttgatttatgctaaaggtggtgttttgtcattggaactgcg

SEQ ID NO: 12190 - DNA, 932 bp, Glycine max
  Peptide Sequence Number=SeqID_103875
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgaccacttctgcgctcggcccttccggctggctggtttattgctgataaatctgggagccggtgagcgtgggtctcgcggtatcattgcagcactggggccagatggtaagccctcccgtatcgtagttatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctg

SEQ ID NO: 12191 - DNA, 204 bp, Glycine max
  Peptide Sequence Number=SeqID_103876
atgggggatttctttagaattgcagaaagtgaggtggggaagcgagcaggagtacgagagttctttcaacgcgccttgtgcggcattatcaatatgattgcagaacgctttatcgccttccgggcagttatccgcggcgtttctcacgactttatcgagatcccgatcgttcgtggtcgtattgatgtgattaatcatccatga

SEQ ID NO: 12192 - DNA, 464 bp, Glycine max
  Peptide Sequence Number=SeqID_103877
atgattcatcctatgatttccacatcaggggtatggagagccatgcccagggatatgtcaagcagtgctgcagggatagctgctttgtccacctcttgtgcagggatccacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccc

SEQ ID NO: 12193 - DNA, 744 bp, Glycine max
  Peptide Sequence Number=SeqID_103878
atgaagcacttcactgacaccctcatcagtgccaacataggaacaaaagctggtaccgggccccccctcgaggtcgacggtatcgataagcttgatctgctcgatctattcaagcaagtccagcaaaacgaacaattcgacgcgatcaagatcggtctggcttcgcctgacaagatccgctcgtggtccttcggcgaagtcaagaagccggaaaccatcaactaccgtaccttcaagcctgagcgcgacggcctgttctgcgccaagatcttcggccccatcaaggactacgagtgcctgtgcggcaagtacaagcgcctgaagcaccgtggcgtgatctgcgagaagtgcggcgtggaagtgaccctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12194 - DNA, 734 bp, Glycine max
  Peptide Sequence Number=SeqID_103879
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12195 - DNA, 267 bp, Glycine max
  Peptide Sequence Number=SeqID_103880
aacatctcaagtgaatcaagaacaagtcaagagttcaagaatcaagaagaatttaagactcaagaagaaagcctagaatcaagaatcaagattcaagattcaagatctcaagaattaagatcaagattcaagactcaagattcaagaatgaagaaaagactcaatcaagataagtatttgtcgcaacatgccgttttgtgggcgtgcgaggcgaggctcacgggtgcgctttccaaaggaggaaagatgcgcatagttgccaccaac

SEQ ID NO: 12196 - DNA, 285 bp, Glycine max
  Peptide Sequence Number=SeqID_103881
gttgggaaatgtccacgacgagcttgtggaggtcagggcagggtgaagggcgagagtgagatgtatggaggtcacggcaaggtgaagggtgaagggcgaaagggcatgcgcagtaataagaaggcgaaaggagggcgtagtgatcatggtggtggccgtgagatagttcgtgattggcctagcgattacgacaaagggacttggggggtagcttcgcccaatattgacaagaaagctcgtattttcatcgacaagcaaaagaaccgtgttcaccatcaactttga

SEQ ID NO: 12197 - DNA, 304 bp, Glycine max
  Peptide Sequence Number=SeqID_103882
atgccggaattcaaattatacacagccgcaatttcagcctctaaggtagctagtgcccttgaagaatctccctcaagtataatggaagaagaagaaaaatactctccaagcagctcagttgctcccaaatggatagtagcccgatcaaacatgacagaaactttaaggagttctttgacggctgcagtatctggctcaattcctgcaaatctaccagttctcacaggaaagaactatgaaaattggaagattcagatcagggtggtgatgcgattccaaggggtttgtgagttcgtagaagaag

SEQ ID NO: 12198 - DNA, 1128 bp, Glycine max
  Peptide Sequence Number=SeqID_103883
atgggtgccggtctagttgcgttcctcttaatggttcttgtgcaattggtctatgcagtgatgaacattacttcaaagcttgcaatagaatctggaatgagccctcttgtccttgttgcttatcgacaactctttgctactgtgtccattgctccctttgcttattggctcgagtggctttttcttgccttgctgagagtctacaaaagaagaaaatgcatgaagagaaggagagaagatcacaaaaaggaatacgcttcccaggattacacagcgtcttatgattcagatattattttcgtccctgaccggagttacaggaaatcagatgctttattttgtggggctgaaatattcatccgctacaattgcatgtgcactgacaaatttgctcccagctttcactttcatccttgcagttctcttcagacaagagaatttgggaatcaagaagagggctggtctagcaaaggccaatcaagtattcactggagatatgctgagaaaatggaaggaactagctcttctggcaaaggaaacatgttcctaggccctttggtcgtaattcttagcacccttgtttgggcagcatggttcataattcaaaaagacataagcaagacatttccagctccttacacgagcactggcttaatgtgtttcatggcaagctttcaatgcgtgatcattgccgtgtgtgtcgaccacagggcctcagcttggtcactccacaatgctatgagactttcctctgccctttatgcgggaatattttgcactggattagcctattgcctcatgtcgtggaccattgagagaaaaggtcctctttatgtctctgtatttacccctttgcagcttgtcctcactgccattttgagctgggctttgcttcgggagaaattatatgttggaactgccgtagggtctctcttgatagttttgggactctattctgttctctggggaaagagtgaagaggtgaataagggagacggtattgaagaagatgcagttaaagaagcagtcaaggattcgaagaatgacatggaattgcaatcatatgtgccatccaatgggacgcggcagagtgagattcctcgcaagatgctagtagctaaggattga

SEQ ID NO: 12199 - DNA, 2505 bp, Glycine max
  Peptide Sequence Number=SeqID_103884
atgttttcactacatccatcgcttgctgttggttgccacagtgatttggacttgaaagcgcccatcttttcatgtctattgatattgattgttgatgcatcacttggcttgttgatgtcctctttgaatcaatctctctttccatacgactcttcgtccttgactgtttcttcatctgtgttcaacccttatgcttttttaagcaaccgtcatcacactctcacactcacacttcacacttcacaacatagaagacagatgagttctttgctacctcaagttgccaagaacaaagcaatgtggctgaatcccaaggttttgggttttaatcctcctgaaagatggggccactctgcttgcttctccaaggggcttatgtatgtctttgggattaaagttgtgaatttgggttgctgtggtggactgcatttttgcgatgttctgactttggaccttaacaaaatggtttggagcaagcttactaccacaggtgaaaagccggggcctagagatagccatagtgctgttcttgtggggcataaaatgatagtgtttggtggcacaaatggcttcaagaaggttaatcacattcatatacttgatcttgttaccaaagagtgggttcgacctgagtgtaaagggaatcctccttctcctcgtgaaagccatactgccacacttgttggtgatgaaaggatagtgatatttggtggaagtggagaaggtcatgctaactatttaaacgatttgcatattcttgatcttcgaaccatgagttggacttcccctgagttgaaaggtgatttgcctatccctagggacagtcatagtacacttgcaattgggaacaagcttattgtgtatggtggagactccggtgatcagtatcatggcaatgttcatatgcttgatatgacaacaatgacttggtctaaattgtcaattcaaggttctccaccaggagtcagggcaggtcatgctgcagtgaacattggaaccaaggcaagttatgtctatatcattggaggagttggagataaacgttactataatgacgtttggatctttgatatatgcaatttttcatggactcaacttgatatacgttttcaccagccacaagggcgattttctcatacagctgttgctgctggcatggatattgcaatatatggcgggtgtggtgaagatgaacgtcctctcaatgaattgttagtgttgcaggttggagcagagcatttaaatggagtttactacattcccatgtgcaaaccttttggaacttattggaatcaagaaaagaagattatcccaggagaagcagatgccaactcgaaaactttactcgtgaggaataacgtggaagcttttggcaaaggagcttatgaagttgcatcagaaaaattgccaccttatcactttgattcaggtgggttgagttttatgccttatttggataaacttcttagtaggtattcctatacttcacgacagaagaggaggagaattgctgctgcaaaggtgtgcgatgttgaatcagaacaagaagaaaactttcttacattgtcccttcattcatttccatgtcaatccgatcaagaacagaccccaagtcaaaaagcaaagacattgtttccatccacttgccaatacaacaatggctcaaattataagagaactttgaagaatgttcatttcctacaacatcaactaaaacaagaacattgcctttatgttcgtgaggatagaaaaagagctcaacttcaggctgcagagcagaaatccatggggcgaggaccaattcaacacctgagattgatcgtggccatggtgattggtgctgaagttcgggggagagttgatggaccctttgactcagtttcgctctctcctgcagctgtgaatggaaggattttcaggggggtcatattttcaccttatgttgtaaccagtttaagtaacaaacaaaagttgcatcagggagcagcaggagttgtctcaaaagggggcagtgtcgaaccaaagtgttctctaacaagttcttttcctttttcctctcaagcatatttgaactccaatcatgtgggtaatttaacggcttcccaacaagcacctattcgtttgcatgcagagccatgccatggttcatggcaaacgccagttgcattaccatttccaatcattcgaggcactccaagtgttgtttccaaggagaataaaatcaatagtgaccttcaagggttggttttaaccctcggaggacctgctagtggacaccctcagataggttttcagggtaggaaggatttgaagaggaagcgggcgggtgagtcgggcacagttcacaacagaaaaattcgcccgtgcttcccgcgggacgctgtcgctctgtcttctaacgttgaaattgggccacactgtcacttgtctcatctgtctgccacgtctacggatagatacatacaatacacactgcgcctcattaaatcaattatatgttcataa

SEQ ID NO: 12200 - DNA, 1749 bp, Glycine max
  Peptide Sequence Number=SeqID_103885
atggtatcaaaaaggcaatctggtcagaggcacgaaggcagtggcaaagttccaattcaggagcaaaaacaaacatcaatcagtggccttagaaatgtgatcaacgcgctatggatgagtgaccactctgcctatttggaaaattttctgcgaagagtggtaagcgaggtggtggaacaaaaattcgaggaccaagctcatctatttccaagaaaaagggttggtgaggctggcatatccggagccaaaccctttaagttgtgttttattaataagctgcccgaaacaatttttactcggtctagtataatagcagaagataaatcaccccttcaaattgtcctatttgatgttagaacccagtctgtagtaaatgatggtcctctctcctcactaaagatagagatctgtgtcctggatggagagtttggatctcaaggcagtgaggattggactgaagaagagttcaattccaatatcttacgcgaaagagaaggtaaagagcctctattgattggagagaggtttgctagtctaaaaaatggagttggttgtatacctaaaattgccatctctgacaactcgagatggctaagaagcagaaggttcagcattggagtcaaagttgtgcaaccaacttccaacggagaaaagattcaggagggtagaagtaaaccttttgtggtcaaagataacagaggagagtcctacaagaaacactaccctccgtacttgaagttgaatgatgatatatggcgtttgaagaaaattgctaaggaaggaaaaatccacaagcagctgtcttcgcgtggaattcacaatgttaaggatcttttgcggttgtacataaccaacgaaccttcattatatgaaatgtttggaaatattccaaagaagtcatggttagtaatcactgaacatgccaaagcctgcgtgatagatgattaccagctttacagctatcattcacaagaactgcaaataggcttgctattcaattccatctacatccttgtgggagtgacatttgattggcaaaattattactcaccagatactctcaccccaagagaaaagcatttggtggaaatagtgaagcagcaagcttataaaaacgtcaacaatttggaattgattaatgacactaaattgaactatttaaatctagctgcatgtctaaaagcaagagaatctgatcctccagatcaaggtctgcaccatattaacatctcaactgtacaaggtatatttaaagatcaatcagtaacattccccggttgtggtcaaccatctatctctccttcatatactgatgaaggaatgcatgaccaccaagtttatgctgatccactgtcaggcataacagaaatgtcaaaaaacagtcatctgttagatgaactttcctctgaaatgtacactgaagaggatagttgtcaccttaatggatctcaatttccattcgtgcgaggcggttattcaacagagaatgaatggtcagagattcaattcatagatgattgcccttcttacacaacatgggaaccagaaactggcattttctttggttctcctgttggagcagaatttagcagctattcgactttcatcaattctgatgaggatacatcaagcagtggcaaaaccaaagcagtgtggtataagattcgtgttgctctcaaatgggtcatatcagtgaaaagggatgcagctgccagaaagaatgctcagctgttttactataactattag

SEQ ID NO: 12201 - DNA, 543 bp, Glycine max
  Peptide Sequence Number=SeqID_103886
atgatagcctttctactctttctactaactagtcttggtctagtaatcaatgcatcaacctttagtgcttgttcgaattgtggagactttgtagtcccatacccactcagcactaacgaggactgtggagacaataggtacaaagtctactgcaacgatggaaatttagagttcttgtcagcaacagggacttactataagatccttagaattgacccaagtgctaacaagcttgtcattagcccacctcctatactgaaaaacacttgttattcttctgatctctatatgggaggcttgttgcttgatgaaagcttgcccttcaatatatctacacaaaacacggaaaaggtggaagaaggaactgggtgtatggacaccctttgttgccattacttaaaggactcagccatgaattcccacaagattagggtaaaggttgggagttgcactgcttatacttgtttggttggtttcaagcctaatgaccaacttgaaacttggaattatgggattgagctacaatggttgtctcccaattga

SEQ ID NO: 12202 - DNA, 455 bp, Glycine max
  Peptide Sequence Number=SeqID_103887
atgtcccacgaatcatggcgcttccttgagaagcttcaacagcggtggcacgcctccttcttcgatgatgagtttcccgtaacgatcattgtcgcgagcgagggagacgaggaaagcggctgcgtcggaatgttcgtccaaggaagcgccggagagaagaatggcgacctgttcctagatgaggcagaggatgggctcgttggcggcgatgggagggaggccgaggtacttgtcgtcgcgctcgtcggcggaggcatagacgcggaggtgcgtgggacgctcgtagaggtcgttgctgttcctggcggcctggcagaggaggcccgccagcttctcagttttggatttcagctccagacattcctgccggaaattctgggccttttccggaagcttcgaaacctgattcgccatttgtattgggctcgccaggatctcctgacgatgctcgacat

SEQ ID NO: 12203 - DNA, 855 bp, Glycine max
  Peptide Sequence Number=SeqID_103888
atggcatcttgctccttcaacatagaatcgttgccccacgattgtgtttctgaaatcttgtcacacacatcacctttagtggcatgcatagtttcacttgtctccccctccctttgctcatgcgccaactctgacaccgtttggagaagcttcttgccctctgattacgaggacattgtttcacgtgctgtgaatcccttcaccctcagtttctcttcatacaagcaactcttctattcactttgccaccccctcctcattgaccagggcaacaagagctttaacttggaaaagtcttcgggtaaaaaatcttatatcatatctgcaagggaattgtcaatagcatggagcagcgacccaatgatgtggagctggaaaccaattcctgaatcaagattcgcagaggcggctgagctgagaacagtgagttggttagaagttgaaggaaaaatcagaacgcggattctaacgccaaacacgtcatatttggcttatctgataatgaatgtttcacatcgagcttatgggcttgattttgcgccgtcggaggtatcggttatggttggaaacaaagtgcacagagggaaggcgtatttgggggataaagatgagaacaagcgtgagatggaggctctgttttacgggaacagaacagaggtattgagaaacgcagcgtttcaagaggggattccttttccatcgaaaagagaggatgggtggatggagattgagctcggggagttcttcagtggtgaaggagatgaagagatcaagatgagtctcagggaagtgggttatcaattgaaaggagggcttgttcttgaaggcatccaagtcagacctaaaacatcatag

SEQ ID NO: 12204 - DNA, 393 bp, Glycine max
  Peptide Sequence Number=SeqID_103889
atgggatccatgatagacaagaaaactctagaaagagggtattggcacaaatgcagattttgtgcaactgttcccccagaactaactgggaagtcatcaacaaacagagtgacaccaatggcaaggctaacagctgcacatggtgacttgttaaatggtgatggtactaggaagaattgtgaaaagaatcttggggaatgtagttccttttcccttcctcgagctgcctttgaacttttctccagcattaaagccagcattttccaaacttttagtggaactctactttcaggagcagtttcctcagtacctacatttgaaaaggagaatagatatgcttatccagacaagaaggattcggaaacttgtgacctctttaattgttttgcttaa

SEQ ID NO: 12205 - DNA, 1719 bp, Glycine max
  Peptide Sequence Number=SeqID_103890
atggggggagatgcacagaagagaaacgtcatcattggcgtctctactttcttgttggtggccatggtggtagcagtcacagtcaatgtcaacttcaataacaagggatcaagcagtgattcaaaggaagaaagcaaatcccatgtagcttcctcgatgaaggccgtgaaaaccctttgtgcacccaccgattacaagaaggaatgcgaggacaatcttattgaacatgccagtaacatcaccgacccacgggaactcatcaaaatcgcattccacgtgaccatctccaaaatcggcgaaggacttgagaagacacaactcatgcatgaggtcgagaatgaccctataaccaaggaggcactcgacacgtgcaagcaactcatgaacctctccatcggggagttcacgaggtcactcgacaagttcgccaagtttgacctgaacaaccttgacaacatcctcacaagtttgaaggtttggctcagcggtgcaatcacgtaccaagaaacatgtttagatgctttcgagaacacaaccaccgatgctggtcaaaaaatgcagaagctcttgcaaactgccatgcacatgagtagcaatggcctctctatcatcaacgaactgtcaaaaactctctcggaaatgcacgttaacagacctggccgtcgacgccttttgaacaacgttgatgatttaccagttcttggccacgactttgaccttcccgaatgggttgatgatcgcgttggtgttcgcaaactcctacgtatgactggacggaaacgcatggcgcatgtggttgttgcaaaggatggcagtggaaatttctcgaccatcaatgaagctttgaaatatgtgcccaagaaaaacctaaggccattcgttatctatgtcaaggaaggagtttacaacgagtacgtcgaggtttccaaaaatatgacccatgttgttatgattggtgatggtggtaagaagtcaaggatcactggtagcaaaaacttcatcgatggggttgggacctacagaaccgccagtgctgccattctaggagatttcttcgttggcataggtatggggtttgagaactcagctggtgctgaaaaacatcaagcagtggccttgagggttcaagctgacaggtccatcttttacaaatgtcgaatggatgggtaccaggacacactctacgcacacaccatgcgtcaattctaccgtgattgcatcatttcagtggctgttctccaaaattgcactttcgtggtgcgaaaaccattggaaaaccaacaatgcattgtgactgcacaaggcagaaaagagaggaaccaaccatcaggattagtcatccatggaggaagcattgtgtcagaccccacgtactacccagttagattcgacaacaaagcttacttggcacgtccatggaagaatttctcaaggaccatcttcatggactcctacattggtgatttgatcacacctgatggttacatgccatggcaaacattggagggttttagtggaatggatacttgtttctacgctgagttcaacaaccgtggccctggttcagacaaaaccaagcgtgtgaagtgggaaggagttaagacccttgattcagatggaataacaaacttcttgccatccatgtttttccatggagatgactggattagggtcactaggattccttactactctggccaggtctcccacactaactga

SEQ ID NO: 12206 - DNA, 1074 bp, Glycine max
  Peptide Sequence Number=SeqID_103891
atggatggaagtagtatttggagtaaattaaaacggctggatagctctaggagcctatggtttggcatggtttggcatggtttggcattgagtgtgaaacaggctaataaatgtgagtggttcaccgtcgcaacttccaatgtgcgagcacttactcgtctcactgtcttgctatatttggagaaaggagagggtccagtggtgttgttcctccacggcttccctgagctctggtactcatggcgccaccagattctctctctcagctccctcggctaccgcgccgtcgctcccgatctccgtggctacggtgacaccgaggcaccaccttcaatcagcagctacaactgcttccacatagtgggtgatctcgttgcgcttattgactctctgggtgtccaacaagtgttccttgtggctcatgactggggagccatcataggttggtatctctgcatgtttcgccctgacaaagttaaggcctatgtctgcctcagtgtccctttctggcccagaaaccccaaagtgaagcccgttgatgccatgcgggccatatatggagatgactactacatctgcagattccaggagccaggcaaggcagaaggtgagttagccaaaaatagcactgaacaggtaataaaaaacgtattcataagtcgcaaacctgggccaccaattttggagaaggaaggaatgggtttcaatcccaatacttcaatgccccttcccacttggctctcacaagaagacctcacgtactatgcttctaaatttgaaaagacaggcttcactggaggactcaactactatagaaatttcaacttaaattgggagctcacagcaccatggactggagcacaagtcaaagtaccagtgaagttcattacaggtgatttggatctagtatacacttcactggggacgaagaactatattgagagcggtgctttcaagaaagatgtaccaaatttggaggaagtagttgtgcaagaaggggtggctcactttaacaaccaagaagctgcagaggatgtcagcaatcacatttatgattttatcaagaagttctga

SEQ ID NO: 12207 - DNA, 957 bp, Glycine max
  Peptide Sequence Number=SeqID_103892
atggaaggagtgatacacagaacagtggaagtgaatggcataaaaatgcacatagcagagaaaggagagggtccagtggtgttgttcctccacggcttccctgagctctggtactcatggcgccaccagattctctctctcagctccctcggctaccgcgccgtcgctcccgatctccgtggctacggtgacaccgaggcaccaccttcaatagacagctacacttgctttcacatagtgggtgatctcgttgcgcttatagactctctgggtgtccaacaagtgttccttgtggctcatgactggggagccctcatgggttggtatctgtgcatgtttcgccctgagaaggtgaaggcctacgtctgcctcagtgtccctttcatccccagaaaccccaacgtcagaaccgtagatggcttgcgtgctatgtatggagaagactattacatctccagatttcagaaaccaggggaaatggaggctcagatggctgaagttggcactgagtatgttctcaaaaacctccttacaactcgcaaaactggtcctccgacctttcccaagggagagtacggaactggattcaatccgaatatgaccgatatcttgccttcttggctcacagaagaagatctagcctattatgtctccaaatttgagaaaaccggcttcactggaggcttaaactactacagaaatatcaactcaaattgggagctgacgacaccatggacaagagtgcaaatcaaggtgcctgtaaaattcattgcaggtgaattggacatggtatacacctcgctaggaatcaaggagtatatccacggtggaggtttcaaggaagacgtgccgaatttagaacaagtgattgtgcagaaaggagttgctcacttcaataatcaagaagcagcagaggatatcagtaattacatacacgattttatcaacaaattctga

SEQ ID NO: 12208 - DNA, 1779 bp, Glycine max
  Peptide Sequence Number=SeqID_103893
atggtgaagcactacagacccccggggaagaaaaaggagggaaatgctgccaaatttgtcattaggtcacaagcaatcaagcagcttcaaatcagtctaccccttttcagggagcctaagaaaaagttcaagggaactcatcagacttattaccatgtcaaggatgtttccttccttcatcacgagcctttggttgaaatacatagagcaatacgagtgcatgagaggaaaataaagaaagccgaggcaaagaaaaaccatgaacgtgcaaacaggctgcgccagaaaacacccaaacccaagatcgataggattattcggcagaggtacccgagatttgtggatgcacttggagaattggatgactgccttacaatggtgcacctttttgcagcattgcctgcatcagagagtaaaaaaattgacgtggagtgtgtccataaatgtcgaagattggcacatgaatggcaagcattcgtatctcgcactcacaagttaagaaaaacatttgtatctgtgaaaggcatatactaccaggctgaggtcgagggccagccaataacatggttaactcctcattcactacaacaggttgtatccgatgatgttgacattactaccatgctaaactttctgcaattgtatgagcctcttcttagttttgtcaatttccgcctctaccattctataaatttgaagtatccccccatacttgatcctcggttggaagctttggcagcagatctatatgctctgtcaaggtatgccagtgccaataccagaccctctgtactgaattctgaagcttctcaagctgaatctgaacaagtggagaccaagcaaaaggaggcagagactggaaatgaaacatctgaactaagacttgctcaacttcagcatcaacttccttctaatgaacctggtgcactaatgcatcttgttgaggaagtgactggtgaagatgaagaggatcaggatacaaaagactgtaaaaagctctttaaaaatatgaaattcttcgtaagcagggaggtaccaagggaatcgatgctttttgttattcctgcttttggtggcatagtttcctgggagggagaaggggcaccttttggggaatctgaccagagcatttctcatcagattgttgacagggaagcacaaggacatcggttcctctcaagagaatacgttcaaccacagtgggtatatgactgtgtgaatgcacgaattattttgccaactgacaattatttggtgggaaggactcctccaccacatttgtcaccttttattaactacgacgaagaaggagcatacattcctgattatgcaaagaccattaaacacttgcaagctgctgccagaaaggaaatccttccacttccaggtgttgggaaggatgctctggaagatcctcaaaatcttctggttgaaggtatcattgatcgagcagaggctaatgatgcagctcagagaaagcagaagatgatgattctggagcagcaataccgtgatgatttgaaaaaagaacttcaaggtattacatgtacctcagcaggttctatagaaacatctactgaagtggtacagactggagaatcaactaccagtgttcatgaaaatgttgatcatgatgacatgggtaaacttatgttgtcacgtaaaaggagggggctagtgaaagccattgagaaatctagggaacggaataaagctcagactgatctcattaaacaacggaaaaagaaaattgatgaagagcaacggcaaaggagttga

SEQ ID NO: 12209 - DNA, 1197 bp, Glycine max
  Peptide Sequence Number=SeqID_103894
atggagatttcgttaagcgacaacgctctaaaaacctttgcgcgatgcatcacttgtctcgcacgcatcggaaacgagctcgctattcaagtctattcctcccagcttcttttccatactattaattcatcacgttctgcttatcaatgcatcgctctcaagcctggcttctttgatgcgtataacgtttccggcaattccgtgcaatgcagtgtgcttctgaaggctgtttgtgctgttctcaggacacctattacgaatattgaccatttgaccgtgagactgcctgatccagatgcttccaaactgcagtggattttggattgctataatggtatgagaaaaacctattggattacttgcaatgtagaacctgacatacaacacttgtcccttgataggcaaaaatttcccagcaactttgttgtgagccctcgagatctgagcaggttacttgctaattttcagtcatctcttcaagagatcactatcattgcaacagaaccttcttctctacctcttgatgcttcaaatgaaattggtggaaaggcagttgaacttcgaagttatatggacccaaccaaagatttcatggcagacaatgatacgttgctgcacacccaactgtggatagatcctaaagaagaatttttgcagtatgttcatactggagatccaatagatgtgacttttagtgtaaaagaactgaaggcatttctttcattttgtgagggctgtgaagttgacctccatttgcattttgagaaagctggcgaacctattcttatggcacctaaatttggtttggaagatggatctcactcaaattttgatgccacccttgtactggctaccatgttgatttctcagcttcatgagggggctgcctcagaacctcttgcgggggccaccagaacacaccctcatactgaagaaagaaatgcatcttacatgcagcaagagaactgcagagcaaatgtgtcatcagagcttccatctgatcacacccgtatttggtctgacctctcagtaagtgcatttaaaagcattagtcctttggaagaacggcgggcacaaggagaaacaattttgaatgatgatcggcaaagagaaatgcaaaggattagcacaatgcaaatttcaggattaacttcagttccaggaaataatcccattgattccaatgtgtatccttga

SEQ ID NO: 12210 - DNA, 1080 bp, Glycine max
  Peptide Sequence Number=SeqID_103895
atggccgaaatcaaaggggagcacagcctcaatgtttccgaagagcttccactttcagacaaaaaccttcccaaaacaaagcgtgttgcatcccttgacatctttcgtggtctcactgttgcgttaatgatcttggttgatgatgctggagggcaatggccaatgattggtcatgcgccatggaatggctgcaaccttgctgattttgtcatgcctttctttctgttcattgtggggatggccattccacttgctctcaagacatatttgtggggtgaaagacaaaacatcatgctttgttttgatataatggatgacctcaataatgaaggtggtttctctcatgctccggacaatctaacatatggagttgacatgaaacatataaggtggtgtggcattcttcagagaattgctctagcatatttggttgtagcactggtggagatattttcaagaagtgcacaggctagagatccagaacccacccacctctcaatattcaagttgtactattggcattggctagttggggcatgcatacttgctgtttacttagctttactctatggaattcatgttcctgactggcaattcactgtccataacccagacagcatatataatggcacaactttaactgtgacctgtggtgtcagagggaaactggatcccccttgtaatgctgtgggatatattgaccgagaggtgattggaattaatcacatgtataagcgtccagcatggagaagatccgaagcttgcaccgagaattccccatatgaaggtccttttaaaaaaaatgctccttcatggtgttacgctccttttgagccagaaggcattttaagatgtataacttgttcctctgttcctaatagcaatgtcatgtgcaactgcagttcaatatctgctattctctccacaatcattggattgcattttggacatgtactgatacacttacaggatcatccttccaggttgaagcactggcttctcctaggcttagctctccttacttcaggacttattcttcacttcactcatggtgtcaactctaaacttactgttgggtga

SEQ ID NO: 12211 - DNA, 1815 bp, Glycine max
  Peptide Sequence Number=SeqID_103896
atggcgagagcaagttctggtctgcaatacccagagcggttctacgctgcggcgtcttatgtggggtttgatggatcctctccaaccaaatccctcacctccaaattcccccagtccaccgctcttcttctctacagcttgtaccaacaggctagtgtaggaccttgtaacatcacagaacccagtacatggaaaattgtggagcatggcaaatgggccagttggaaccagcttggaaacatgtcctcaactgaagccatgcgtctttttgtaaaaatattggaggaagaagatcctggttggtattcaagattatctaactctgttgtagaacctgtcgtagacgtgcaaatgaatcataattccaaagttgagccagtaattgagaatggaaactcttatccagagacaaagactatttctatttccactcaaaatggaagtgaagttggaacacaggataaagatactgttgtggaaggctttggttcagttgaagtatatgatcaatggattgcacctccagtatctggaggaagtccaaaagcccgatatgagcatggagctgcagtcgtgcaagataaactgtacatatatggtggaaatcacaatggtcgataccttaatgatcttcatgttttggatttgagaagttggacttggtcaaagattgaagctaagactggagttgagtccccaacaacttcaatcccttgtgctggccattcattgattccatggggaaataaacttttgtcaattgcagggcatacaaaagatccttctgaaagtatccaagtgaaagtgtttgatcttcaaatggctacatggtcaactccaaagatttttgggaaagctccggtatcacgtggaggccaatcagtgaaccttgttgggaaaaccttagtaatttttggtgggcaagatgcaaaaaggactctcttgaatgatcttcatattcttgacttggaaaccatgacatgggacgaaattgatgctgttggggtgccgccttctccaaggtctgatcatactgctgctgtacatgtggagcgatacttacttatctttggtgggggttcgcatgcaacatgctacaatgatttacatgttcttgatttgcaaactatggaatggtctcgccccatgcagctaggtgaaataccaacaccacgtgctggacatgctggtgtgacagtaggggagaactggttcattgttggtggtggtgacaataagagtggggtctctgagacgattgtactgaatatgtctacactggcttggtcagtggtaacttctgttcaaggacgagttcctgttgccagtgagggattgagtttggttgtaagctcctatgatggtgaagatgtacttgtatcttttggagggtacaatggacgttacaacaatgaggtctatgttcttaaaccaagccacaaatcaaccttgcaatccaaaataattgaaaattccataccagacagtgtttcagctatcccaaatgtcacaaatgtggagtctgaatttgaagcaggccatgattctaatccaccaaaatccaaaggtgatattgtatcagtcttgaaggctgagaaagaagagttggaatcatcactgatcaaggagaagcatcatgctcttcaactaaagcaagatctggcagaagctgagtcttgtaactctgacctttacaagcagtcttggttggcctcctctgtggctgctggtggggtttttttgcggctgcagaagaagactgctgacggtggtgctaaaccctacctggctctcataccaagtaaagagagataa

SEQ ID NO: 12212 - DNA, 60 bp, Glycine max
  Peptide Sequence Number=SeqID_103897
atgatgattctgaaaggcactgcattcacaggcatagtccgtttccttgaaaaagtgtga

SEQ ID NO: 12213 - DNA, 1073 bp, Glycine max
  Peptide Sequence Number=SeqID_103898
atgatgtccggaaaatatacgtcgattgacgcgcagcagcttcagggatctgttcctgccgttccagattcacgacccgccaccgtcaatttcgcagattcaaatcttcagacatttcctccatctggtcctctgggcaagattactgctgcttccgggcctcctcgtgacgctgatgattgtgaaatcgcacaatcccacatgctaagcagcctcctccgtgctgaatcgttgcctggattgttccagagtgttatcgtgatcttccacttgaaatcttgggagcatcgatccccaatgagtcaagccggcttcttctccttcatttgcaactgctggacctctgtcctacaccaccactgctgcccagggatgccaccgattgcgcctctgtttgcaaactctgttttgcgaactaaaggtggttggtttcagacttttacaattgctgcttacaaaccatactttgatgttgacacttcagatgttctggagaggattatcgactcactatttccatttagaggatctttcaatgaaaaaactgctaccaaccctgatttgtatggtccattctggatttgcactaccttaatatttgttgcggcatctattggcacctttgtgacatatgtagcacacaagctgaagagcaaggaatgggattatgacattaatctggtgacttggtctgctggtgtggcagggttcatgtcagcaacatttgtggcactgaacctccgggcacatatcaaatcagcagctggctctagctgttgtactaaagatttacctcttcacagtatcagtttaagaggaaactggacattcggactccctgtatggccattgctaacgttgaattgcatgtttgggtactgcaaatacatgttcgttttagataaggaattacgtgagaactgtgttgctcacgctagaatgaatgaagttgggtttcaaggagctaatgtactacttttaggacggattgggttaagttgggctgagctgaatacgaacataactgtgaaaaataataggggaactgcttggggcacccagcatttttgctg

SEQ ID NO: 12214 - DNA, 4989 bp, Glycine max
  Peptide Sequence Number=SeqID_103899
atggcggagcaacaccgcaagaccacgctggattcgggctgggtcgcagcgaggtccactgaggtccaattcaccggaatccagctcaccactactcaccctccaacacgccccacttccccatggatgcaagctctcgttcctggaactgttctagcgaccttggtgaagaacaaagccgttcccgatcctttctatggactgcaaaatgagcacatcattgacattgctgattctggaagagactattacaccttttggttctttacaacctttaattgcaagctttcaagcaatgagcattgtgatctgaacttccgtggaatcaattactctgctgatgtgtatttgaacggccacgaaatcatcctaccgaaagggatgtttcgaaggcactcccttgatgtcaccgatattcttcattcggatggcacaaacctgcttgctgttcttgttcatcctccggatcatcccgggagaattcctcccgaggggggacaaggcggtgatcatgagataggaaaggatgtgactacacagtatgttgaaggttgggattggatggctcctataagggataggaatactggaatatgggatgaggtttctatttctgttactgggacgattgtgcttccagctgttccttggtgggatgacttcagtgtctgtgtttggtgcagccagagctccttgactgctgagtgttctttgagtgtccaagtgacaacagaacttgaggatagcatttgcttagtagagcatcttcaaactcaagatctctcaattcctgcaaactcagcggtgcaatatacatttcctgagcttttcttctccaagcccaatttatggtggccaaatggaatgggaaaacaatctttgtacaatgttgttattgtcattgatgttaaaggatttggtgaatctgattcatggagccatcactttggattccgcaaaattgagagtcatattgatgatgctactggtggaaggttatttaaagtcaatggaaaaccaatttttattcgagggggtaactggatattgtcagatggactactgcggctttcaaagaagcggtataatacagatatcaaatttcatgcagatatgaatttcaacatgattcgatgctggggtggtgggctggctgaaagaccggagttttatcattactgtgattattatggccttctgccttgggctttccatgtacaacagctagctcttgttgtgtggttctcccaaggtttttatcacagtatttttcctgtatggcaagagttttggattactggggatgttgatggacgtggtgacccagtgtccaatccaaatggtccactggaccatgaccttttcttgttttctgcaagagacacagttaagcttctaagaaatcatcctagccttgcactatgggtggggggaaatgaacaggttccaccggatgatataaatgctgctcttaaaaatgatctgaggcttcatccttattttgaaagtgtggaggaaaatagcaaacctgtaggagactggtccccaatgtcgacagattttagtcagtatcttgatggcacacgcatttacatacaaggttcaatgtgggatgggtttgctgatgggaaggggaacttcactgatggtccttatgaaattcaaaatcctgaagatttcttcaagaatcacttttataattatggattcaatccagaggttggctctgtgggaatgccagttgcagctaccataagagcaacaatgccctcagaaggatggcagataccagtgtttaagaaacttcccaatggttatgttgaagaagttccaaatcccatatgggaataccataaatatattccttattcaaaaccaaccaaggttcatgatcagattcaactttatggtgatgctaaagatctcgatgatttttgtttgaaggctcaacttgtcaactacatacaatatagagctcttctggagggatggacttctcgcatgtggagtaaatatacagaaccagttcatgtacagcttaatctggctacatatttgatagaggttgttaatactacagcagaagaaatgtctaatgttgccattgaagcttcagtgtgggatcttgacgggacatgcccttactacagagttcatgaaaatttctctttgctgccaaaaaaagtagcacctatttttaagatgaagtatccagagtcaaaagatccaaagccagtctactttcttcttctcaaactctataacatgtcagataatagagttatatccagaaacttttattggttgcatctttctggtggagattacaagttattggagccatatagggagaagaaaatacctctcaagataacatcgaaggtttcaattgaagaatgcacttataatattcaaatgcttgtggcaaacacatctaaaagaccagcctctacaagttcaacagctaggctaagtgatggtttttatggcacacactcactggaaactctggcttgtggggttggaatagaacaaaaatctagttggtttaagaggatacatagatgttttgctgggaaaagtgatggtttgaaagttactgaaataagtgggcctgatgtaggcgttgctttctttcttcatttttctgttcatacttcaaagatggaccacaatgaagggaaagacacaagaattcttccggttcattactcagataactatttctcactagtcccaggagagaccatgcctataaatatatcttttgaggttcctctgggtgtcactcctcgagttattctgcatggctggaattacgatggagagtcacagccaagcgtatcaactgaagcttgtgatgaaacagcagataatgtattagcacaactgaacaatgagacctctgacaatatggatgagagtagtatacccaatggaatccatgaatgttctcctcgtgaggatcatacactcccaatattgaagaaaatccttgacttgagtactaaaattcagaatttgaagaaacaacatgtagccctatctaatcaagtgaaactcacaactgagtcatttccaggcctagatgttttaaagtctgttcagcttcttggtgctgaatatgaagtgttgaaaagaaagtacgtagaggagtcctctgagcgtaggcggctttacaatgaagtgattgaactaaagggaaatatcagagttttctgtagatgcagaccactaaatgaaagtgaaattgcaaatggatcagcagtatctgttgtcaattttgagtcatcttctgatgagctccaagtcatttgctctgattcttcaaaaaagcacttcaaatttgattatgtattcagacctgaagataaccaagagactgttttcgaacaaacaatacctatcgtcacatctgtgttagatgggtataatgtttgcatttttgcatatggtcaaactggaactggcaagacctttactatggagggaacacctcagcataggggagtttacaatgagaagataagagatcttttggtggaaaattcagttgaacctactaagaagttggagataaagcaagctgtagatggaacccaagaagtcccaggacttattgaagctcgtgtttatggaacagtggatgtgtgggaaaagctgaagtctggaaaccaagcccgatctgttggatccactagtgctaatgagcttagcagtcgttctcattgtttgttgcgagtgactgttttaggggagaatttaatcaatggccagaaaacaaggagtcacctttggctagtagatttagctggcagtgaacgtgtggggaaaactgaagctgaaggagaaagactgaaggaatctcaattcataaacaagtctctatcagcacttggtgatgttatttcagctcttgcatccaaatcagcccacataccttacaggaactcaaagctcacccatatactccagagctctttaggtgcagcagacttaacagagacactttgttctctgaattttgccacacgtgtacgaggaattgagagtggcccagcccgcaagcaaacggaccttactgaactgaataagtacaagcaaatggttcgggatcttgagaaccaggtgacagaggagagaaaaatgagactgaaacaagaaagtaaatcacttgcagcagtttcagctcaaccttcaacaatgtcggagtcaatagctgctcggaaaatcatgaagaagccaccgctcgatccaagactgccacttagaagaattactaacattttacctccaccaccagagagaaagccctcatgcagctcttccatggatgaacaggaaaacattgctagaacaacttcaattaacacacaagaccttgtgaaaccaagaaggggggtatccatagctgtaagacccccaaccacaccatcaacatcacggacccttcagcctagaaggaggcgtgtttctgtagctacactatgtcctgtcagaactccactccgttcccccactcagcaatcaccgagaaggccctcatgcagctcttccatggatggacaggaaaacattgccagaacaacttcaattaacacacaagaccttatgaaaccaagaaggagggtatccatagctgtaagacccccacccccaccatcagcatcacaggcccttcagcctagaaggaggcgtgtttctgtagctacactttgtcctgtcagaactccactcggtttccccactcagcaatcaccgaaaaggaaccaaagggaaactcagtattcaaggttgtttgccccattgccagaagctataacctcagtcgagacagcatcaccaactttgatgaggagcagcagtaagtttgccggcagccctaggcatcaaagacgcaaacccttagtgtggactcctctcaagctgaagggcttgaaaaatagcagcagaaagtcattggttataccatctcggcctttctactga

SEQ ID NO: 12215 - DNA, 1047 bp, Glycine max
  Peptide Sequence Number=SeqID_103900
atgggtattccccagatcattttactttcccatttgtactcaaagcatgtttgtgcaattgctgatcaagattgtggaaaatgcattcattgctgcatagtgaaatctgggtttgaagctgatgcctatactgctactgggttactgcatatgtatgtgtcatgtgcagatatgaagtcaggactcaaagtgtttgataatattcccatttggaatgtggttgcttggacttgcttgattgctgggtatgtgaacaataatcaaccatatgaagctttgaaggtgtttaaagacatgagccattgtggtgtagaacccaatgaaatcaccatgcacattcgtaaggctggttatgatcccttcatgtccacatctaatagtaacatcattcttgcaactgcaattcttgaaatgtatgccaaatgtggcagcttcaagatagcaagagacctgttcaacaaaatgcctcagagaaacattgtttcttggaacagtatgattaatgcatacaatcaatatgagagacataaggaggcactagatctcttttttgatatgtggactagtggcatttatcctgataaggctacctttctgagtgtgttgagtaaaaccggcattgggacagacatttcccttgcaactgctcttcttgacatgtatgccaagacaggtgggttaggaagtgcacagaagatttttagcagtttgcaaaaaagggatgtggtgatgtggactagcatgatcaatggtttagccatgcatggtgatggaaatgaagcattgggtatgtttcaaaccatgcacgaggatagttctctagtccctgatcatattacctacattggagttttattcgcatgtagtcatgttggactggttgaagaggctaaaaaacattttaggctaatgacagagatgtacagtatagtgccaggaagagagcattatggttgcatggttgatcttttgagtcgatctggtcatttcggagaagcagaaagattaatggagacaatggccatacaaccaaatatttccatctaa

SEQ ID NO: 12216 - DNA, 744 bp, Glycine max
  Peptide Sequence Number=SeqID_103901
atggcggagagtgcagtggaggtgattcattcttggtctgctccaagatccctcagtactagtctcatgtattcttttgctcagagggatgacatagaagtgcttgatgagcccctctatgcaaatttccttagagtaactggtcttgatagaccctacagggaggagctactctccaaaatgccatcctttgacaaggttgtccctccatctttctatgagttgggtttggctgagctggtttgtatattcaatgagcttcatgaaattggaaaggcaccacctgttattgatgctgcagaacttcaacaagatcctgaggctactctacgtggtctctgtaatgatttggagattccttttcaacctggaatgctcaagtgggaagcaggtccaaagtcaatagacggcttgtgggccccttggtggtataagtctgtacataaatctactggttttgagaaaccaagaaagtatccccagcaaagtctacccctgtataatatgcttcgacgccatgtgaagaaaaagtcatctcttctgagccctcctttacctaatcctgatcttcctgttcctgcaaacgggaaattgcttgcttgggttggtgatgagattctgccacgtgatagtgcaaaggtttctgtgtttgattcagttgtccaaggaggtgactcagtttgggaaggacttcgagtgtataatggaaagatatttaagcttgaggagcatctagacaggtga

SEQ ID NO: 12217 - DNA, 1194 bp, Glycine max
  Peptide Sequence Number=SeqID_103902
atgggtggtagatctggcggcttggtttgttctacttcctcttacactgggattagaacaaggcgtttgtgcacttctaacaacaccacctttcccttcccccaacaacctcaatcactctctttcgctaaacctctcaaactcatgtctcaacctttgaccaccaactctgttcttgttgaagaggctgctgctgatggtgattcctccgccgccgcacctcccctcttcgattatcatcgtatcgaccaaaaactgctccaaaacatagtttacgatgctcttgtctggagcaccctcaactgcctccttgttggtgacaaatctgttcagagatcaggaagagttcctggtgtgggcctggtacatctcccactttccttattacctgggccatttcctgaaagtcattggaagcaagggtgcgaattagctcctatatttaatgaacttgttgatcgggtgagtttggatgggaaatttctccaggaatctctctccagaactaagaatgcggatgaatttacctcaagacttttagatattcattctaagatgctacagattaacaaaaaagaggacatacgcatgggaatagttcgttcagattatatgattgatgagaagactaaatcacttttacaaatagagatgaacactatttccacttcatttgctttgattggttgtcttatgactggacttcataagagcttactttctcaatatggaaaattccttggactaaattccaatagggttcctgccaataatgccgttgatcagtctgcagaggccttggctaaagcttggagtgagtataacaatcccagggatggacaagcaatttcagttgtttacttccgggctggctacacgccaaaggactatccttcagaatcagaatggagagctaggctactgatggaacaatcttctgctatcaaatgccctacaatatcttatcatttggttggcaccaaaaagattcaacaggaacttgcaaagcctggtgttcttgagagggtgctctccacagtccatgccttaggaatatgggatgctagtatgtttgtgaaaaaactgaagtttgttttggggaaagttggaaggcttggggattatggagtttttgatgaaaatgtagatggattggaagaagagtttttattatcagaagcttgtgttatctga

SEQ ID NO: 12218 - DNA, 618 bp, Glycine max
  Peptide Sequence Number=SeqID_103903
atggtgctctctcacaagtcacaccctttatttacttcagcatccaacaaagtgttccttacttacccagatcttcaaatggtgtggagggttcacccaccagagcaaaagctttgtcctaatggtgttttgaggtgggttttggtttggatgagtgtgtgttttcttgtgttcacggttggtccaccctctcgctcgatggtgaagaagagtgcatcttctcaattttcttcttgtcctccatgtgattgtttctgctcgtcagcggaatatctcctcgatcctctgggacttgtcaatggctcaatttacggtgcagattgtggcaaacacgatccagttttgaatgaggaaatgaacaagggtatactgaaaatgctatctgaggagctaaatttgcagaaaattgtggccaacgagaccttggaacacaccaaacagttaataatggatgccaggaaaaccttttcgcattaccagaaggaagcagaaaagtgcaacattggggtggaaacttgtgaagaagcaagggagagggcagaggcagagctcattgaagaacacaagctgacagcattatgggaaaatcgtgctcgtgaatatgggtgggtggaatga

SEQ ID NO: 12219 - DNA, 1602 bp, Glycine max
  Peptide Sequence Number=SeqID_103904
atgggcgctgtgattcactgcattgcatgttgggagccttacaaatcccccttcaccttcttcccttctttctctactcatcgctctcattcttctcctcttccccccaaactcgccatggctccaagcgaacctctctccctcacccccgtccaagactctcccttattcgattaccctcgtctcgatcaacaactcatccacaccatcgcttacgacgccctcgtttggagctctctccacggtctccttgtcggtgacaaatccgttcagagatcaggaagcgttcctggagttggattggtgcatgcgccgcttgccttgttacccacgccatttccggaaaagcagtggagagaagcgaatgagttggcccctatattcaatgaactcgttgatcgggtcagtttggatgcaacgtttcttcaggaatcactttcaagaactaagaaagcggatgagttcacctctagacttttggacattcattccaagatgctacagattaacaaaaaagaggaaatacgattggggttacatcgttcagattatatgcttgatgaaaagactaaatcacttttgcaaatagaactgaacactatttcctcttcttttgccggtcttagtaatcttgtgactgaacttcataggattcctgccaacaatgctgtcaatcagtatgcagaggccttggctaaagcttggagtgagtataataaccccagggccgtgattatgattgtagttcaggctgaagaacgaaacatgtatatgttgctcaatatgcaggaatggagtgctaggatactgatggaacaatcttctgctgtcaaatgtccttcaatatcctatcatttggttggcaccaaaaagattcaacaggaacttgcaaagcctggtgttcttgagagtggtgtcgttcagaatgtggctgcagccattgttggccaatggtggcaagaatgcatggtggattgcaatgagggagcttgctaccaaaagctcatgttgtctacagagcagatcctaattcgagaagagattgatggtaacagaggaaatgaggaaattagaatggggagcttggcttcgaaaacaagcagttctaagttcaaactaaatccttgtgtcaaaactgtaagcaggttcattgaaaacaaagaagaaattgccaaactgcgtaaatgctttactgggttgtggagtttggatgactcaaatattgttagaaaagcaattgaaaggcccgagttatttgtgatgaagccccaaagagaaggaggaggaaacaatatttatggtgacgatgtgagaaaagccctcctaaaattgcagaaagaaggttctctagaagatgcagcttatatccttatgcagaggatatttccatctaactctgcagcaattttgatgcgtaatggctgttggcataaggatcgtgccatttcagaactgggggtattcagtacttatttaaggaataaggataaggttatcatgaataaacaaagtgggtatttgatgcgtacaaaaatatcatcatctgatgaaggtggggttgcagctggttttgcagtgttagatagtgtatacctgacttga

SEQ ID NO: 12220 - DNA, 132 bp, Glycine max
  Peptide Sequence Number=SeqID_103905
atgtggttttggaagctgttgcttttgaatcgaaaggaagacatggagatgctttataacgatacgggtgtcgtgtcggtgtcggacactgacacggacgcatgtcggacaccggacacgacgaaaggctga

SEQ ID NO: 12221 - DNA, 138 bp, Glycine max
  Peptide Sequence Number=SeqID_103906
atggtggaagagggtggggttgaacaacaagatagtgcgattgggggactaaggagtctaaaaggaaggggagagggtgcagagaagatgcgagctgtgctggtggtttattggcgcgtgaagaagataatggattga

SEQ ID NO: 12222 - DNA, 1818 bp, Glycine max
  Peptide Sequence Number=SeqID_103907
atggggggtgtcaacagcaaaaagcccaaaaaaaaaaaagaaacagatcagctgacccgtcttcttccttcctcttcttcgtcgtcttctttcgcgagacagagaaatgggggctcgtcgcgcgttgccggggctcgtcgttggaggtcgtcggcgccgttcgtgcgttgcgggcctcgtcgcggcggcggctgggtgcggcggggagggggtggtgtcgcggcggcggctgggagcggcggggttcgggagggacgcaggcaggttcgggagggaatggaagctgttggagggacggctaggtgttctgaacgcaagctgtggaagttatctctctcagcatctaacttacttgatctggacattgcatcaaagagtgatcccatggttgtagtttatgcaaagaaaagagatggtaaattggaagaattaggtcgcactgaagtcattctgaattgtttgaatccagagtggatagagaaaattagtgttgcatttcacttcgaaattgtgcaaccacttgaatttcatgtgtatgacattgatacaaaatatcatagtgttcccaccaagacgctaaaactgggagatcaagaattccttggaatgaccagttgcactttatcagagattgtgactaaaccaagtaggagcttatctttaaggctccaaaacaaaagcgggcatggtgttttaagaaaccttggggcaataactattcatgctgaggagactgttgcttcaaaaagtgcagttgagatggacccttttctaagaatatcaagaatgattgagagtggaggttatattcctatatgcaagactgaagttatcaacgacaatttaaatccaaaatggaaaccagtttgtcttagtggccacaagtttggaagtaaagatagtccattagtgatcgagtgttttgatttcaatagcagcggtgatcatgtacttattggtaaagtgcagaagtcagtagcagaccttgaaaagctatacggagaaagaacaggcgtaaatttgatcataccatccacacgccacagacaagagaagatttcactgtttgccaagcacttcaacatgtgtccagcttcaaatggaaatcctcaacattcagattctttgcattacattgatgcatatggtcggctaaattcataccaacaggctataatggaggttggagaagttattcagttttatgattctgataggcagtttcctgcttggggctttggaggaaagatacctggtggtaccgtatcccactgttttaatctatgtgggaatccaggtgcctctgaggttgcaggagttgaaggcataatggatgcttatgccagtgctttatgccgtgtcactctctcaggacccactttatttggcccagttatcaacatggctgcacaaatagcttcgcatgctcttacatcacattgcagcactaagtattatgtattgcttatcataacggatggagttgttacggatcttcaagaaacaataaatgctctggttgaagcatctgaccttcccctgtcgatccttatagttggagtgggaagtgctgatttcacgagcatggaggtgctggatgctgataatgggcgtcggttggagagttctactggtcgtgtagctacacgagatatggtgcaatttgtgcctatgagagaagtacaaagtgggcagatatccgttgtgcgagctcttttggaagaactacctgatcaatttttgtcttttatgcgaagcaggggcattaacccactgccttcccatttctcaaaagcatccacttccaccatgcaatag

SEQ ID NO: 12223 - DNA, 3567 bp, Glycine max
  Peptide Sequence Number=SeqID_103908
atggaggacagtgttagtagcagcaacacgagtgccaccaatgtggcacaagctatacacactgcccttgactgggcctcttctcctgacgctcgacaaaacgccgttgcttttctcgattccatcaagaatggtgatatacgggtattagcaaacacatcattccttctggtgaaaaagaactggtcgtctgaaatccggttacatgcctttaaaatgctgcagcatttggtgcgcttacgatgggaggaattaggccctgcagagcacaagaactttgcaaagctttctgttgatttaatgtctgagatttccaatccttgtgaaaattgggctctcaaaagccagacagctgcccttgttgctgaggtagttagaagagagggtcttaatttatggcaagaaatgcttccatctttgatttctctatccagcaatggtccgatagaagcggagttggttgcaatgatgctgcggtggcttcctgaagacattacagttcacaatgaagacttagaaggtgatcggcgaaggctacttttgcgtgggctaactcaatcattgcccgaaattttgccactattatacactttactagaaaggcactttacagctgcaatgaatgaagctggtaggaaacagatggatattgccaaacagcatgctgctactgtaacagctactctaaatgctatgaatgcatatgctgagtgggctccattgtcagattttgctaagtctggcatcattcatggttgtggtgtactactatctgcaccagattttcgtcttcatgcttcggagtttttcaaacttgtctctccaaggaagaggcctattgatgcatctgcctctgaatttgaccaagctatgagcagcatctttcaaatattgatgaatgtatctagagaatttttgcatagatctggttcaggtcctgggtccatagatgagggcgaatatgaatttgctgaatttatatgtgaaagtatggtgtcactgggttcttataacttgcaaagtattgctgctccagcgggttcagacttcggatgcagcagtggcacgactgctatgcctccgcaacagtgtgcctctgttggacttcagacaaaaagctccgcctctgtctaccgcccttgcggcgacgagattcaaacaggcacatcagcgatgaacagacaaagattagggctcactgctcttgtgagaacgcaaggaaaccgagaacgaacagacacaaacaaaccgtttagtgtgttttgggcccctaaggtgctaatgagggatttgatgtcaaagccaaaaagttccacacattcagctgctgacagttcagctgttagtagcacaggttctggagaagttgaaaatgccaagaaaaagactctaagctttgtgagtgatgatttttgtggtgcaattttggatacatctttccctcgcatgctcaagagacaaaagatgctgcatgagactgccatttctttaggggcattggagttgtggagtgatgattttgagggcaagggaacattcagccagtatcgttctagactgttggagttgattaggcttgtttcttcttacaaacccctgatagctgctactaaagtttctgaaaaaattgatacaatcatcaaagatctcttgctttcaccggcaccaactcaggacttagctgtgatggaaagcatgcaattggctttagagaatgttgtaaatgcagcttttgatggatcaaatgactttaccaagacaaatgctgaagtccagtttgcattatgtagaacgtttgaagctgccttcatagcagtcaccttggcctgccttagttatggcttatttggactacttgttgcgttgaaggagggtattgctgatacaatgggatgtttgcaaagggagggtcgtttgcttcagggagagcataatcttttaggcgaagcatttcttgttatgtcttcttctgctgggatccaacagcaacaagatgttttaaggtggttactagaacctttaagcattcagtggacacaattggagtggcaggataagtatttgtcaggtccacacggtttggttcagttgtgctcagatgtgcctgttatgtggtcaatttttcatacagtgacattctttgagagggcacttaagaggagtggattgaagaaagccaattggaattcagaaaacagctcaacaccaaattcaattcctttaaatccaatggcctctcacatatcatggatggtgactcctctcttgaaactacttcgctgtatacattccctttggtctccatctgtaagtcaagctttacctggtgaggtcagagctgcaatggtcatgggtgatgttgagaggttcagtcttcttggagaagggaactctaaattaccaaagggtgtcacagatggatctaagattgacatgaataaagaaggatacgctgaacccaatgaatcagatattcgaaattggtttaaaggcatcagagacagtggatataatgtattgggcttgtcaacaaccgttggggattcgtttttcaaatatttggatgtgcactctgttgctgttgccctaatggagaatatacagtcaatggagttcaggcatataagacagcttgttcattccactttgattcctttggttaaaaattgtcctttggatatgtgggagatttggctggaaaagcttctacacccattttttgtccatgctcagcaagcacttagctgttcatggtctagtcttctacaagatggtagagcaaaggttccagatgctcatggcattcttagtggatcagacttgaaagtggaagtgatggaggaaacaattctgagggatctcacgcgtgagatgtgttcactcctctctgccatagcttctcctccccttaatactggaattccttctttggaacagtctgggcatgtttgtcgattagatatgtcttctctaaaaaacttggatacagttgcatcatgctctatggttggtttccttctaaagcatgaatgtctggtccttccaacactacaaatgtgtttagaagcttttacatggacggatggtgaagccgtgactaaaatttcttcatattgctctgcattggtagttcttgcaatagtaacaaatcatgcagaactcgttgaatatgtttctagagatctttttacatccattattaaaggtttagcccttgaatcaaatgcaataatcagtgctgatctagttggcatttgtcgcgaaatatttgtttatctttgtgatagacacccagctcccaggcaggttttaatgtctctccccaatattaccactcatgatttagttgcctttgaggaatccttaacgaaaacattcagtccaaaggaacaaaagcagcttacgagaagcttgcttcaattagcatctggtaacaaattgaaagcacttgcagcacagaaaactgtgaatatcattacaaatgtttcaatgagaccacgcccagccaatgctcccgagtccaaagttgatgatggtgatgctgtggggttggcagccatcatgtga

SEQ ID NO: 12224 - DNA, 1854 bp, Glycine max
  Peptide Sequence Number=SeqID_103909
atggatcggaggagaatgtacgataggcagaacagctctccagggacgccgtcctcgccgtcctcgccggtgaatgtgatatcgccgctgcaccgccacgcgcgcgcaggttccaccggctccgccatgaccaacgtccggagagcgcagaacaacgccaccaaagccgccgcgcagagacttgcgcaggttatgtcgcaaaccgacgacgatgacgaagacgaggacgacgttcctcttgactattccgcgatcgctggcagcggaggtattggtctcggcggcggaagaccaatgccaactcgctctcccatggcagttcggagcgttcaggatgctgcatctgcaaggtcgcggtcaccaatgccagttcgcgctgttcaagaacaacctccatctgcgagatcacgttcccccgcgtcagttcgctccgttcaagaacaaccgccatctgctagatcgcgttccccagcgtcagttcgcatcgatcaagaacagccacgatctgtgagaggcatgtcgagtgttcgatcatatgcatcttcaaatgctctagctgagcaacctccacctcggacacccactctaatgaataacgcagagcaacaaccaccttctgctcgttcaacgccagcaaaccgaaccctagaattgtctccctccgctcgcactacaataattacacggtcgcctcaacccagtagtgccaacaatgatcagcctccctctgctcgctcaacctctggccgtcccagtggactttctaaggtggttcccatggtgccgcctagtgtacctattacactcagaccagcctcttctgttggtgttcctccctctgagcctcttcttgatattagaaaagacaaaagattgtcacttgatctgggtagtatgaaggtaagggaaaatgccaatcagcagcagcgtcctactagtcatgagcttgaggatgagcttcgacttgcagaagagaagtatgaagaagctgaatcaagagttaggcaactagaacaacaggctgctctgagaaatgcatcaaagaatcatggaggttttcaagcagcgcttcaggcggatgctgagactgcaagggaggagaccgagtctgctttcgaaaaactacggcttatgactcaacgaatgatactcaccccggaagaaatggaagaggttgttttaaagaggtgttggctagctcggtattggggtttatgtgttcggcatggtattcatgctgatattgcggaagcaaaatacaaatactggtctatgttggccccgaatccgattgaagttgtattagcagcagcagagaaagctaaagaggaaacagacctcgatgtagaggatacagaaggtcaacgtgacctgaaggaactttctggagagggaaatattgaaaacatgctttttgttgagcaaggtttgcgacaattggcttcactaaaggtagaagaagcattggtggttgcattggctcaacataggcgaccaaatatgttgaaagctggtttttcagatgacctaaaactaccaattgaagggcagtgtgatgcatttgaattgagtcaggaggaggctgaagatgtatcctttaaacaggcttggcttgcttacatttggaggagagcaaaaaggcatgaaatagagcctgacatagctaatgagcgtttgcagcattggatcaatcataactctatgactcctacctcacaagacgcagttgatgttgaacgtggacttgcagaaatcaaaaggttggatattgaagcgcaactatgggatgaatctcgtagagaattggaggaagagattggcaattcaaacatacccggtcgttctgacttttga

SEQ ID NO: 12225 - DNA, 1995 bp, Glycine max
  Peptide Sequence Number=SeqID_103910
atgagcagcaactccggagcagttaagggaagagaattccctcttcctcgctgcccctgcccctcctcaaattcaaatgccccttcccttgatctctggtcacaaatcgttgccgctgaaacgccccgccccgaacgaatcgacgtcgtttaccggagaagacaccctcgcaatcctcaaaaccacgccaactcgtacctccattttcattccatcatctttcttcttctttatttcattttcattttttttaaaggttttacggaaactgttttccttttcgatcgattttccagaaagcctcccgattctgctataccgcgcccgcctcggcagagtttggccgatccaaacaagcgagtcagttggaaccgttctctttccacccgagggaggacaagtatagccgttggggcttttatggtataccagcctcagttgaagaaggacaaaaggaaaggaaaacccgctcttcccaaaggaaaggttgtgcaacctccaaacgttgacaaggagaggatatactttcaagaggttgatgcttatgagttgttggaggaaagcccctcccccaagaaaagcacatggaccataggaaatatgacacaacaggaaccaattccagctgtatgctccagattagaaaaatggttgcactctagaaggttaaaccccttctgcggtccatctagcacactatcgaagatactggatactccttccacacgtttggaaactattcgtgacattgacttcggtgcttctgacttgaaaacattggaacgaactgaccgaagcaattctcttctgcataccatcaaaactgaggagaaggaaacttctattgagaatggcagtcatttgcaaacaaatgaaaagatgctgtttgctcaaagtggtgaaggatgtgaagatattgaagctggtgttaagaaactttctctgttttgtaatctcacattagctgttaaactaaaaatagataaaaaaatttcccttcaagatcacaagcaatgcaaaatttctttttccagtggctcagaaactattgtgaaagttggtgaaggaacatatggagaagctttcaagattaacaattatgtctgcaaaatagttccttttgatggggaattcagagtgaatggggaagtccaaaagagatccgaagaattgctggaggaagtgcttctttgcaaaactctcaatcaattgagaggaaaagatggagattctgataatctttgcagcgcattcatagattgcatagaatttagagtatgtcagggcccttatgatgcgtctctaattcaagcatgggaagattgggatcttgagcatggctcagagaatgatcacccaaaagagttcccagataaacagtgttatgtggtgttcgtacaagaacatggtggcaaggatcttgaaagttttgcactcctgaattttgacgaggcaagggctttactggttcaggttacggctgggcttgctgtggctgagtctgcgtttgaatttgaacatcgagatcttcactggggaaatatacttgtgggccgaagtgattctgaaacgttgcagttcactctcgatggcaagactatgttggtcaaaactcatggattaataatatctattattgacttcactttatcaagaataaacacaggtgatagcatactgtatttagatctttcctctgatcctgacctatttaaaggaccgaaaggggacaaacagtcagaaacatatcggaggatgaaggaggtgactgaagattggtgggaaggaagctgtcctaaaacaaacgtgttatggttgatctacttggtagacatactcctcatgaagaaatcatttgaacgtactacgaagcacgagagagatctacgatccttgaagaaacgtcttgacaagtatgattcggccaaggaagcaattcttgatcccttcttcactgatttgttcgttgagtctgacccaaacttaacaatctaa

SEQ ID NO: 12226 - DNA, 702 bp, Glycine max
  Peptide Sequence Number=SeqID_103911
atgagaggggagttggatgacactgctgcattcaagaacttcaacaagtggggaaatatagagtttccattgccttttggaagagttctgagccctacagaaagcttcattcattccttggatgataagacaagtgcatcattgaaatttactgtattgaacccaaaaggacgcatctgggcaatggtagcaggaggtggtgtgagtgtaatttatgctgatactgttggagatttaggctatgcatcagagcttggcaactatgctgaatatagtggagctccaaacgaggaggaggtgttgcagtatgcaagagttgtaattgattgtgctactgcagatcccgatggccgtaagagagcccttcttattggaggtggcatagcaaacttcactgatgttgctgccacattcagcaggattattcgagccctgaaagaggaatcaaagattaaagcagcgcgaatgcacatctatgtcagaagaggtggtccaaactaccagactggtttggcaaagatgcgtgcattgggggaggaattgggagtaccaattcagtcaaactattctagtaaatggtgtaaattgagaaatcttgtaactcttagtttttaccttaaggctttggcagtttatggaccagaagccacaatgacgggtatctgcaaacaagctattgattgcatcatgtccgacgcataa

SEQ ID NO: 12227 - DNA, 1236 bp, Glycine max
  Peptide Sequence Number=SeqID_103912
atgcattttactggagacccatctaggaccaagaaacaggctcagaaaaatgctgcaatggctgcttggtctgcattgagaaaattgtcagagcaccatttatcttcttcaacttcatcttcattttctcgagagtctaaagcaaatgaagaacaggagcaagtaatcatcgctggggtccttgcaagtttacacccatctggttcaaagaacttctccacaagtgatagtcaacttggatggcaaaagtccactacaacctctttggtgtctactcagtcaactgcagacttgtatcctatgcaatggcattgtggaatctctagtttctcgccagaggtggctctatatcagacttggcagcaacaacaaattatgcagcagcaaaatcgtctattggaactaaccattcaaccaattattccatctactccagagatttatccgttaatgcaatccgttttccagccagaccactgcctttattttccagctcgagagttagcatcagttcctctaggaccaaaattatcaattgctacatcaaacccttcattttactcttcaaaccaaattgttcccgagttaaacacgggcaggtcaacactaaccatcagagagatacaagaagaaaaaacagaagatcccccagtttgcacttttagcaatgaaactagagtcctaacaccagctccagaggatgagattcagaagcatggtggctctggaggcagaagtagaaatgctgagctggtaggagaacactgtgagaaaactgaatgtgattctcattggagcacgcgatctgtaatcagaccagttaatactgagctgcaaaacccatccagtattgactcatctgttctcagagcacactcacaagcaagttccaacagaagttttagaccaccagctgctgcatcatcctccattgtgagaaccatgtgccctacttcatctgtgggttcaagaccacagcatgctgcatcaaggttgagaaccggaactccacgaagtccaggcattcctacctctgaaaggtttggcatgataagagcacctactcctctattcatggcaccagctgtgagaatccgatcagtggtcccggtctgctcagctcctccaaggagatccatggcagaggtgtcccaaagcaaggaaaaagaagatttgaagcctgaagacaaagaggtgtcaagaactagctctgagctaggccatcttagaatatga

SEQ ID NO: 12228 - DNA, 2241 bp, Glycine max
  Peptide Sequence Number=SeqID_103913
atgcaccgtgtgggtagtgcgagtaacggaaacaattcaactcgcccgcgcaaggagaagagaataacctacgtgttgaatgattctgatgacacaaagcattgtgcaggcataaattgtctggctctacttacatctgcagcatctgatgggtctgattatctcttcactgggagccgtgatggtaggttaaaacgatgggcactagatgtgaatagagcaacatcatcggctacctttgaatctcatgtcgattgggttaatgatgctgttcttgttggtgatagcacacttgtttcttgttcttcagatacaacccttaagacatggaatgccttgtcctttggaacctgtactagaacactccgacaacactttgactatgttacttgccttgcagcagcaggaaaaaatagcaatattgttgcctctggtggccttggcggggaggtttttatatgggatatcgaggctgccatcactccggtttctaagtgcaatgatgctacaattgatgaatcttcaaatggtatcaatggttctggcaacttactaccattgacaagcttgcgtcctattaactcaagcaacaatatgtccatgcacactactcaaactcagggatacattccaattgctgccaaaggccataaagattctgtttatgcattggctatgaatgaaagtggaacaattcttgtctctggtggcacagaaaaggttgtgcgtgtctgggatgcaagatcaggatcaaagactctaaagctaagaggacatacagataacatcagggctctgcttctggattctagtggcagatattgtttatcaggatcttcagactctatgataaggctttgggatataggtcagcaaagatgtgtgcattcttatgcagttcatacagattctgtttgggcacttgccagcaccccaacatttagtcatgtttatagtggagggagagacttttcattatacttgacagatttgcaaactagagagagtagtttgctttgcacaggcgagcaccctattcttcagttggctttgcatgatgatagcatttgggttgcatcaacagactcttcagttcatagatggccagctgaaggatacgacccacaaaagattttccagagaggcaattcttttttagctggaaacttgtccttttcgagagcaagagtgtcaatagaaggatctacccctgttcctgtatataaagaacctaccttaactatcttgggtacacctgcaatagtacaacatgaagttttgaataataagagacatgtgctgacaaaggatgcatctgattcagtgaagctgtgggagattaccaaaggtgttgtgattgaagattacggaaaggtttcgtttgaggagaaaaaggaagagctatttgagatggttagtattcctgcatggttcacagtggataccaggcttggaagcttgtcagtccatttggacactcctcaatgtttctctgcagagatgtattcagcagatcttaacattgtaggcaagcctgaagatgataagattaatttggctcgagaaacccttaaagggctattggctcattggttgagaaaacgaaagcaaagaatggaatccccagctccagctaatggggagttattatctggaaaggatatttcttctagaagtcttgcccattctagaattgaggttgatggtagttctgagaatgatgctatggtttatcctccatttgaattctcagttacttcccctccttccattattactgagggcactcatggaggtccctggagaaaaaaaattactgatttagatggaaccaaggatgagaaagacttcccctggtggtgtctagactgcgttttgaataatcggttacctccccgagaaaatactaaatgcagtttctatttgcaaccatgtgaaggctcttcaatccagatcctcacacaagggaagctaagtgccccacgtatattaagagttcacaaagttattaattatgtaatagagaagatggtgcttgacaaacctttggatagcttaagtggtgatggtagttttgcccctgtacttactgggtcacagtcaccacttcaagcagttggggatggatcttttcaatctggatttaagccttggcaaaagcttaaaccttctattgaaatattgtgcaacaaccaggcaagtaatatgttgtctacttgtgcatatagcatggttttctag

SEQ ID NO: 12229 - DNA, 2088 bp, Glycine max
  Peptide Sequence Number=SeqID_103914
atggagagtagcttgctctttatattttgcactgttcatctaccacccgagaaggcaaccacctcgaatttcacgcacccatcacgaatacgaagtggaaaacaaagccaaagacacaatgatcccattaaacgactgcaacgttgtttcttcttcggacctagcgaggtagcttctctccgtagtttggttcccaaacatcttggtagatgcaccacttttgaggtcatcatcgcatgcacgtggagatgccgcataagagcattgcaacttgaccctgatgatggtgttcgcttcatttacaccgttaactttactaccaaggtgaaccctccgttgcctaagggttattacggtaatgaatttgtgctctcagccgcagtaaaaacatcacgaaggttacgtgagaatccattagggtatgctttggaattggcaaaaaatgtaaaatccaacgtggatgaggagtatgtgcttttggattgcgtggctaactctcagactctttcatcaaccttcgcgaaccaaggccaatggaatctcgtgcaaccaagcgttggcatatcagcaatgcacatgcaacttctccacaacgacaagatcatcatgttcgaccgaaccgattttggccactcgtacctccctctttccaatggccgttgccgcatggaccccaacgacattgccctaaaagttgattgttccgctcactccgtactatacgatgtacccacaaacactcttcgacccttaatgattcaaactgacacctggtgttcctcgggctcggttctccccaacggcacattgatccaaaccggtggctacaacgacggtgaacgtagcattcgcatgttcaccccatgcttcgatgaaacatgcgattgggtcgaattcccaggtttgttgtcacaaagacgatggtatgcaacgaaccaaatactcccagatgctcgtgtaattgttgttggaggtagaagacaattcaactatgaattcttacctaaaacacctagccctaacagttctccctcgtctattccacttaactttctccaacaaaccagcgatagaagtgaaaataatttataccctttcgtgcaccttttacccgatggaaacctattcatcttcgccaacacaaaatccgtgttattcgactacaaacaaaacagtgtgatcaaagagtttcctccaatcccaggtggtgatcctcgtaactaccctagctcgggttcttccgttcttctcccactagacgaaaacttagcttccctcgaagctgaagttgtggtgtgcggcggagcgccacgtggctcgtttgagagtgccgcacgtgggaacttcgtgcaagcccttggcacgtgcgggaggatcaaagtcactgaccctaaccctaattgggttatggagaacatgccaatgccaagagctatgggagacatgcttcttctccctaatggagatgtcgttataactaacggcgtaggggccgggaccgccgggtgggaacatggccatgacccggtcttgacgcctgtgttattccggccatcggagacggtgaatcggtttagtgtgatggcaccagcgtcaagacctaggttatatcactcttcagcggtgttattgagagatggaagagttttagttggtggtagcaacccacatgtcttttacaatttcaccggggttgagtaccccactgatcttagcttggaagcgttttctccgccgtatttggcgctggatttcgatccggtgcggccaacgattaggtatattacgaacaacaatgtgttggggtatagggtcttttgttacgtcacattcacggtgcctaattttgcttcggctagtgaggtttcggttaagatcgtggcaccgtcgtttactacgcactcttttggacagaatcagaggatggtggtgttgaagttgagtggggtgacgtatctggccggcgaggcttattatgccaccgtggtagggccttccacggcggagattgcgccgccggggtattaccttttgtttgtggttcataagggtgtgccaagttcgggttcgtgggtgcaagtgatgtaa

SEQ ID NO: 12230 - DNA, 900 bp, Glycine max
  Peptide Sequence Number=SeqID_103915
atggctggccctcaactgggagaagcagcacatcgtcttgtcaagaactcccttaacattaaatcaaataacatgccgtatggatcaccggagcagtttcctggccatcatgcaatgaaccggctcagatcagctggcccttctggatatggaaaatattatgtcgaggacaaaagtggttattacggacaacaaaacaatcaccaggggatgataactaggcctagatatccggtctcatctaatggtggaaataatgagaaacagaattttaggatacaggataggtcacagcatcatgaacagtactacaacgggagaactgggtttcatactatgacaatggaggaaggtgcaagacctaggccatatgcagtgccttcgccaaggacacaggtggtgatgttatcgaggtcacccaattcagggccaacaactaatggacaacaccaatttgtgcagaacatgggtcctcctataccacctccaaattggattactagagcaccagatacgaatggaatatatgcttggcatcaagaaactgcattgggaggagcttatgataagcagcacataaaggtgtaccaagctaaaactcgacaaccccaagacatgccagatgagagaattgccaccaagcccatattgctggttctgcgcaaacccagcgatctggagtctggacgctcttgctctggaagaaactctgggcggccccacacgtggggcagcgccaatcatccggaagcttctcgaactggtagccgggcggtaagggacgcgggcgtgtcttctttggagacgtcgacggagttgacgggtggagttgggagaaaggggttgagagctgaagccattgtcattatctgtggaggaatcgcaattccacttggataa

SEQ ID NO: 12231 - DNA, 1161 bp, Glycine max
  Peptide Sequence Number=SeqID_103916
atgtcggggtgtggcacacaactccatgcaagtgttgtgcatgactgtattagcggtcaagctgcacatgattgtggtgttgttgttagaggtgatgcatcgagaacgagtgacagtaatgatcacacagggacaggatatgcaatatggattgagccacgtggcgagataagcggaaagtggaaagaaggggtgaggagggatgaaattgaaaaggacagagatttggggcccgaccgtttcactccaatacccgactcgaaacgccgcgtttcaagcgtcaaatgtatctcctcgtcgcggaagccggataacacgtttagtttgcagtccccgtgggaggttctggcgagcacggtgtcgaacacgctgaaggcgctgaagaaaccggccatagctgcggtgttggtggggctgttattaatgtacgatccaacttgcgccttcgcggcatctggagggagaatgggaggaaggtcgttttcttcgtcttcttcttcgtctaggagttattcagtgccgaggacgtcaagctcagggttctctttttcggcgccgtattacgggccttctccgttcggtggggtttatgtgggtcccgccgtgggggtcggagtcggtgctggctcgagtttctttctcatcttagtgggattcctggcttttgttttggtttctggctttctttcggatcgctcagagggtagtgtgctcactgctgccgacaaaaccaccgtgctcaagcttcagttgcacggctgtgcttgtgtttctgaaccaaaggtaacggggccatgtattgaatgttctgaaggtcttgcaaaaaccagccatagctgcaatgatgctgggaggctgacatcctccaaccctggccccacccaaggcacctctttttcagcaccatattatgtgccttctatgttagtgtttggcagtggctgcagtgtgatttacattggtcctgctattggtctcagggtagtgtgcttgctgccactgataaaaacaccattctcaagcttcaagggtggtcaagttggattgttggggatgggtcgcacacttcaaagggatctgaataggattgcagaagttgctgatacatcaacttcagaaggtctgcattatgtattgacaggtgaagttcctaaatattag

SEQ ID NO: 12232 - DNA, 381 bp, Glycine max
  Peptide Sequence Number=SeqID_103917
atgaagtgtttctatttcttaaacggagaagacgaggatttcgtggagggaggagtggcggcgagttcgcgcgacggctccacctcgcacgtgtcatgggctcgttcgctaagcttgatggacacgcacaatagcagcagtcgctcccacttcgtctccgagtcgacggagttctctgatacggtggacttccaccacttcctagcgcaacgtggtgccaacaatctccgtcttttctccttcttcgacctgaaatccgccatgcgcgccttcagccgcaccctcctcgtcggcgagggaggcttcggctctgtctaccgtggctttctcgaccaaaacgatgttgcaatcaagcagttgaaccgcaactttactatgtag

SEQ ID NO: 12233 - DNA, 1053 bp, Glycine max
  Peptide Sequence Number=SeqID_103918
atggcctcgtcacctccaaattctctaaggttcacaatttatcataaccaaccatcaatggcagggaaagaccctgttgaagtcattcggcaggcactggcaaaaacacttgttttctattacccatttgccggtaggcttagggagggccctgaccgcaaattaatggtggattgtactggggagggcgtcatgttcattgaggctgatgcagacgtaacactttatcagtttggtggtgaagctctccaacctccattcccatgcttccaagaacttctatataatgttccagagactgaagaaattactaacactccccttctactcatacaggtgacacgactcaagtgtgatggtttcatcttggccttccgcttcaaccacaccattggagacgcaggtggtatatcacagttcatgaacgcttggtctgaaatggctcgaagtcatgctaccaaaccttccatcgcacctgtgtggcgtagggagcttctaagggcaagagatccacctcgtattacatgcagccatcgcgaatacgaccaactcgaagacaccatcatcaccccttcgaacgataacatggttcagcgatcattcttctttggacccaccgaaatagctgccattcgtcgcttggttccacaccaccttcgtcaatgctcaacgtttgatctcatcacagcatgcttctggcgttgtcgcacaaaagcgttgcagatgaaaccagatgaggaagttcgcatgatgtgcatcatcaacgcacgtgctaggttcaatccccctttacctgttggttactacggtaatgccgttgcactccccgcagcagtcaccactgcagggaagctttgtggaaatccatttgggtatgcggtggagttaatcaataaactgaaacgtgaggtgacagaagagtatatgcattctgtggcatatttaatggtgattaaggaacgatgctcattcacaagcgtttgcgaaagagttagaccacatgcttgggaaccggaaccagaaccagaaccagaaccaaccgacgacaagtag

SEQ ID NO: 12234 - DNA, 699 bp, Glycine max
  Peptide Sequence Number=SeqID_103919
atgttgcttgaagcaaaaggatcctgggaattggcagaaaaggcttacacaagccttttggaggacaatcctcttgatcaagccatccataagaggagggtggcaatggcaaaggcacaaggcaacatttccgtggctattgattggcttaataaatatctggaaacattcatggcagatcatgaggcatggagagaattggctgaaatatacgtctccctgcaaatgttagattttattctactgtttatcttcccctctgcaagtgtgacaattatattgctaattattaacctgcctttgttttttccggctttctgtcctcttgttaggtataaacaagcagcgttttgctacgaggagttgatattaactcaacctactgttccactcttccatttagcatatgctgatgtactttatacgcttggtggattagaaaacctccaaactgccaagaaatactactcatctactatcgacttgactggaggcaaaaataccagagcactctttggtatatgcttgtgcacttctgctattacccagcttacgaaagggaaaagcaaggaggacaaagaagggtcccagttacaatctctagcagccaaagtattggagaaagattacaagcagagagctcccgacaagcttcctcaacttacaactgccttaaagagtttaacattgtcatcatga

SEQ ID NO: 12235 - DNA, 276 bp, Glycine max
  Peptide Sequence Number=SeqID_103920
atggagagcgagaaaagcggttacagtcttacagtccaaggatttcgcggaaaatggagaggaattcaaaaaatgagaaaacgaaataaaagatttgagacggggaaagaagaagttgaggagatagaagggattcaaaaggtagagggaatagacgaatctgagaatgcgagcttcgacattggcagaggaagtgcaaaacgacaccgttgttggagcagcagcagaggaagaagctctttcgccattgtggttggtttggaagaaagaaaatga

SEQ ID NO: 12236 - DNA, 1947 bp, Glycine max
  Peptide Sequence Number=SeqID_103921
atggtgggagttgagttgagtagagagaaagaagatggtggcgcgcaggtttttcaattccagctctattccctctcttccgttccacctcatcaacaaaagattttcggagccgaacaagatactccagtggtcaatgactctgatctcgtcgccatttctgacaaactacgactagtctcggtcaacgactccgaaccggaaccaagcgctgccgatttgttgaaatccgatgaggaattggccagactcttgcaggcagaggaggaagcgctaatgttgcagcagtatgtggcaagccaaaatcctcaagaatttgatagtagagtacggccctacgttagtcaagtcctcatgtatgaggatgcaacacggcaggaggctgctcggaagtccgttcctgtggaagagcttgaggagaaagctttggtctctttggccaaggaggggaacttcaagccatcaaaaatagaacaagatcatgctttcctgctgcaactgcttttctggttcaaacggtccttcagatgggtgaattcaccatcttgtcatgattgtggcaacgatactgtaggccagggcatggctcctccacttccttccgagactctttatggagcttctagggttgaactctatcgctgtactgtttgctcccaactaactcgcttccctcggtacaatgatccaatgaagcttgtggaaacaagagagggccgctgtggggaatgggccaattgctttacgttatattgtcgagcttttggctatgagtcacgtctgatcttggactttacagatcatgtttggacagagtgcttctctcaatacttgggaaggtgggggaaaaaactaaattatgtaatagccatagcaaaagatggagtttatgatgtcaccaaacgatacacaaggaagtggcatgaggtcctatctcgacgtactatccttacagagccttctttgtcaactttactctctaatataacaaaagaaagtcgaagaggctttgcatctcaactactttcaattattgaatcccatgatatggaggaaaacaaagaacttgagaggagtttacatgctgaagatgacaagtcactctcattacctggaagaagaagtgggaatgaggaatggcgcaaatccagattagaaatgggttctgataagctaagttcttctgcttgcccagttcgcttgtgtgtagatgagcatgtgacaaggatttataatgcattccaacctatcctttatcaatttgttggggaagaattaacaaagtcagaagctgttgaagtactcaggactactaaaggaattcttttggatcttagcaagtccccctataaaacaagaaggacctccattgattcagttctagagaacccaaaatttcagaaactatttccatcttttgatgacttactttgtgctctttttctggggaaaaagttgaatacagatgggagagttgaaatttgtttggttggtgaccctgtagtaacttctttagcattgcctgttgcgttagatgctctggatgacatgatttacaatcttaacaagtgtgaaaactatgggaaagatatgtttctgttgccacttttaaagttaaatagaatacattctggttcagcaattgcaagttcagaggagttgccttttgggattataacatcagcatttgatggcactcgaatgtctaaatgggaagaaccaaatggaggaagaggtatgtgtgtcaatggaaaggacactggagggagaatgctgaatgtttttctagggagtcgtgagaggaggaggagaattttgggttgttgggtcgtgtatagaacatttgataacaagatgtttgagcttgcagcatatgagttgatgtcagccaatgatgcaccagaaagggatccaatggactggtacggactttggaatgtatgctga

SEQ ID NO: 12237 - DNA, 954 bp, Glycine max
  Peptide Sequence Number=SeqID_103922
atggcacagagtgtggaaattcctcgtgtgaaactcggaactcaaggccttgaggtttcaaagttgggatacggttgcatgggccttactggtgcctacaatgatcctcttcctgaagaggaaggcatatctattattaagcatgctttcagcaaaggaatcacttttttcgacacatctgatatttatgggccagaccatgctaacgaaattgtggtcggaaaggctttaaagcagctaccgagagaaaagatccaaatcgcgacgaaatttggcattacaaagatcgactcttctggaatgtttgttaagggtacaccagagtacgctcgctcatgttgtgaagccagcttgaaacgtcttggtgttgaatacattgatctctattaccagcacagagtggacttatctgtacctatagaagaaacaattggtgaacttaagaaactggtggaagagggaaaagtgaggtatattggattatctgaagctagtccagatacaataaggagagcacatgctgttcatcccatcactgctgttcaaatggagtggtccctatggactcgtgacattgaggacgagataattcctctctgcaaggagcttggcattggaattgtaccatatagccctcttggtcgaggcttttttggtggcaaaggagttctggaaactgtgtcaacagttagctccctgtgcactccttcccagttggcactagcatgggtgctccaccaaggcaatgatgttgtgcctattcccggaactactaaggttaagaacctagatcaaaacatcggtgcagtatcattgaaattaacagaaagtgacctgagagaaatttctgaggcagttcccattgatgaagtagccggtactcgacactactatggatcggctaatttttcatggaccgttgctaatacacctccaaaagatccgagggtttaa

SEQ ID NO: 12238 - DNA, 201 bp, Glycine max
  Peptide Sequence Number=SeqID_103923
atggagtctccatctttgctgcagacaggtttgtctggtgctcccatggatgttagcagaaagccctctctttgtattgcagtcataggggccactggcgagctggcaaagaggaagattttccctgctttatttgccctctactacagtggcttccttcccgagttaacgacgatctccaacacaccttcctcacgctaa

SEQ ID NO: 12239 - DNA, 666 bp, Glycine max
  Peptide Sequence Number=SeqID_103924
atgaagctgcttctagatcgcaaatggaatgcacgtcaacgtcattcattcggatctcaatggcggggggtgcaggattcgaagtgcaaaaatgatcagcaaagatcccgatctacaagacccctcaacggtgcgtctccattgttggctcactctgccaccaacgcccttctctctgcttgttctggcagtgctggtaactacggttgcgaacctgcgattgacgtgaagaatgctgctgcgatttggtgcatcacatatgttgatcactattcttccatcaacacaacaatgatatttcaacggtcagaaaacgatacacgttacacaattaaggagcagctggcaaatggggttattacagattacattaaagcaaccggggttgagacagcatgccaaagacaagatgaattcaaaattaaatacacggcaaggtctttatcttgcaagtgttcattgtcgatggagatcgagcgtaacaaatttcctttactaatctattcatttgatgtcatctgtacaataacaatagccaccacccaagaacaaagctcatctccaatagaactgcataagcataacctacgagcagaagagacatgctgggatgttggggacgtgcttaaactgagtgaggcaccatttcatatcatggtaaactaa

SEQ ID NO: 12240 - DNA, 597 bp, Glycine max
  Peptide Sequence Number=SeqID_103925
atggtgtttgttttcatttgttctttaaccataattagtagcgttgcatctgcacgcactgccaaatctaaggtaactgtaggttcagcccctacttttagatgctcggatcgcgcagagaaacggagggagttttatctgaaattagaggagaaacatcgagctcttgaagaagaaaaaaaccagtatgaggcaaggaaaaaggaagaggaagatgcagcaattaaacagttgagaaagaacctggtcgttaaggcaaaaccagtaccaagcttctattatgaggggccaccccccaagactgaactcaagaagctgccactgactcgccccaagtcaccaaaactgtcccggagaaggagctgtggtgatgctgccggcatatccccagaaatttctactcgaggacgtcacagtgttggcaataacccaaaacatggtagccttgtccctcccaaaaacaaggacctggtcactggacgtaacagcaatggctctagcaaaaccaaagaacgaccaaaactggataaggaaacaaaaacagctcctcctaaaatcactgagcagacaaatgcggacatatcagtccaatcatga

SEQ ID NO: 12241 - DNA, 417 bp, Glycine max
  Peptide Sequence Number=SeqID_103926
gataattggctaaattctgaaaacgatgaaaaggaatctctggaaaactgtgagaagttggataatgatattctaatgcaagaaactgtttgttctcctaaattaaattcagatgacatgggtgatgattcctcatccaaggaacctccagtttgcaagcaaaatggtgaacttggatacaatggacatagctcccctgcgctctgtaggaataatgatttatcttctactggtagtttggtttcagattttattggaaggttgcaagttcttgaggcagatttgagtttccttaagcatagtatcaacttatcgagcaatggagaagaaggacttaaattattgcaggagatagctgatcagctacaacaattacgccagattgggataagagaattagatcaacctgttgcttga

SEQ ID NO: 12242 - DNA, 966 bp, Glycine max
  Peptide Sequence Number=SeqID_103927
atggcggcggctcaacaacttccggcgagcctccgcgccgctctgacatactccatcggcgtcttggccttacggagacccttccttcacaagctcctcgacttcgaagacgaatccttcgccttactcatgctcgtcctcgaatcccacaccttacgaaccacagatgcttccttttccgaatctctctacggcctccgaagaagaccagccaatatcgccctcaagaatgacgacgccactaccagcaacaccgcattacggaggcgccagagagttctttccgttgtgttgccgtatttgaaatccaagctgcattcaatctacaacagagaaagggaagccaggcttcaagccactctatggggagatgaaaccgaacacgattattctccagtgtcagtgccaacctctgatgccggtgcccccgttacaacgcgtgtcgcgaagagagttcagagaattttagggttttgctacccgtggttacatgctagtgctgagggcttgcaatttgcttaccagctcttatacctgttggatgctactggatactactcgctagcactgcacgcacttgggattcatgtttgccgagctacaggccaggagctgatggatacctcttctagaatttcaaagatgcgtaaccgtgaacgtgagagacttcgtgggcctcaatggttgaagatgatggaatggtggtaccaatctgctgaggagagaatgtcagctcctacagtatatcctcctccccctcctccgcctccaccaaaggtagccaaagaagggataccactaccaccagacagaacaatttgccccttatgctcgcaaaagcgtgcaaatccatctgtagttactgtttcagggtttgtcttctgctatgcttgcatatttaagtatattactcaggagttacataatcccactgtgcttgtcagatgggatcactcaaacaactga

SEQ ID NO: 12243 - DNA, 330 bp, Glycine max
  Peptide Sequence Number=SeqID_103928
atgaagatagaagagttggggaagagtggggtgggatggagaaggcaagtgttatatctcacttcgaaatctatgtccccttataaatacaattattgttgtaatctccggattgtcaacaaatctaatcccctctttcctaattttcttcttcttctaagtgcttttgaagaagaccatgagactctcaaggttgaaaacaatatcagtttggtccaagatcaagaagtatttgtttgtggggatctcgctgcagttattggagccatggccaaatataagaccacaagaaaagaggtagcaagaaacctgaagaaatgtgcactctag

SEQ ID NO: 12244 - DNA, 345 bp, Glycine max
  Peptide Sequence Number=SeqID_103929
atgggttattgctacatgaagttgtgtgtgctcacaacaatgattctggtgttgagtttgcagaaaacaaggggagcaagaacattggagggagagcaatggttgcacaataatctggtactccattcattgcaaagaggccacgtacggtcttctcaaagaaacccatgttcgaccgtacctgggcgcagtcgagggcgctgcactttgggagaaattaatgtggctggtcatcaatatcatgttgcaattgctcatgcaccaccactcttccagaacgtgcttcccaagtttggagaagcaaaaccttccattcacaccccaaaagatcgactagacaattaa

SEQ ID NO: 12245 - DNA, 1125 bp, Glycine max
  Peptide Sequence Number=SeqID_103930
atgcaattagattctgccctgcatatggggaactctgatgttacttacgaggatgaggaacatggagcctttgatggtcaagaaaatggttctgcagcttcctgtgagacttctgaagccaatggtgtggttaaagaaaagaagagctggtttggttggaacaagaaaagtttgaagagtagcagtgatgatcctgaggattccaaagctgtgaagaaaaattccaggtttggctcagaaggtagcaatcagagatcagctgatcagcaaaagtcagcatctgactttctgagggaggatagtgtagactctaagaagggaaaagataaaaacattaaaaagaagaaaaaaggagcaaacaatgagagtgagtataaaaagggtttaagacctgtgttgtggttgacaccagacttccctctaaaaactgatgagctgctgcctctgcttgacatcttagcaaataaggttaaggctattagaagactcagagagcttttgacaactaagctacctcatggaacttttcctgtcaagcaccaaaacacagagagaacagagagaccagaacccaaggccaaaatgcagttgcagatggctgaaatcagcaaacagacaaggcagagacacagatggctgaagtcaaaatctaagaccagaaacgcagttctgttgcagcagcactggggtacgttagttttagctctgtttcagcagagagcccctccaaaacacgttgctatcccaatagttcctactatccgggtgcttgtcacttttacaaaatttgaggagcttcagccagtagaggagttttcaactccgctctccagcccagcacatttctatgatgccaaatccaaggaatcagaggggtctagttcatggatttcatggatgaaaggaagtcgtggggggcagtccagtgactcagatagtcacagatacaaggatgaagttgatcctttcagcatacctgcggactacaaatgggtggacgccaatgagaagaagcgcagaatgaaggcgaagaaagccagaagtaagaagcataagaagcaagcagcggcaaaaggtggagatggagtgcagcatcaaaggacggaggatgtagaagaacagtaa

SEQ ID NO: 12246 - DNA, 483 bp, Glycine max
  Peptide Sequence Number=SeqID_103931
atgggtgattcaaccttacaagccaacaagcactgcgcgcacgatgaccccctcgtggcatcgagcgaccatgtcattgtcggcatggagatccactaccgccagaacgacatctacgtgctcggtatcaccatagttgaccacgacagctccatgaacgtgttcgagtgcatccacatcgtcaaccagactgtgagtgtcgtggtcacggcgtgccgcagcgtcgatgccacgccaaagaagctcagtacgccgcgatctgcttgtggagacgaatatcgaggtatgcttgcacacggagctcgactcgggcaagttggggttggagtagaatcagaatcgcgaaaaagccatctaagccgacgatggtcgaggcgtgtgccgccgtgggacgtcgtcaacagccccctctttatcgtgcgccattaccaccatggccctaaccaccctaccccgtctcctccgtgtcgtggcgccgcctag

SEQ ID NO: 12247 - DNA, 96 bp, Glycine max
  Peptide Sequence Number=SeqID_103932
atgaggattctaaaagtaggggctggaaatggaatgattgatgagcagaaaagaagagggcactgtgccccaaaacaggacaaagtttggcagtga

SEQ ID NO: 12248 - DNA, 393 bp, Glycine max
  Peptide Sequence Number=SeqID_103933
atgagttgggaaatgccatggtcccactattgtcttgagatgcatatcaatccaggagcttctgaggcagttatattgtcattaggccagtcttctcagccatataagacttgccaattcattcttgaaaattcccaggtggcaactgcaaggtttcaagcggctgcagcaatccgagaagcagctattagagaatggggttttcttagtgctgatgacaagaaaggcttgataagtttttgtctatgctatgtcatgcaacatactagttctcctgatggctatgtccaagcaaaggtttcttctgtggctactcagttgatgaaaaggggttgcatgtgtgtgtcttattacttcaatgaagataatggaggagtgtcagtttctcattga

SEQ ID NO: 12249 - DNA, 456 bp, Glycine max
  Peptide Sequence Number=SeqID_103934
atggctctaatgatgatgcaaggtaatatttggatatcaactaactctctgggtttagcacaaggaatgacacttcttctcaagtttcagataggatcatctcatggaagattcattcttgctcccaaagagttttcaaactctcagtttagggggcttaaggttgttttggctgatgatgatgatgtaaacaggactgtgaccaagaagctgctcgagaaactggggtgtcaagtaactgctgtttcatcaggatttgaatgtcttggtgctataagtgcctctggtaactcattcaaaattattatgttggatcttcacatgccagaaatggatggttttgaagttgcaagaaggattcggaagttccaaagccataatttttttctttgttcattgcttttactgcaagtgcagaagaacacatcaaggagagatgtctacaggtgggaatga

SEQ ID NO: 12250 - DNA, 768 bp, Glycine max
  Peptide Sequence Number=SeqID_103935
atgaggttgggctgggccagacagcacacaagtgaagagaaagagccttccaaaatgttcaagctatctcgcatgctccctctcacttccacttccaggcataggctgttggaagtgctgtcctctaggaaagttgaagtcggagaccgtcttagccattcagctggcatttctactgctacaaataactatgctgccaaaggcattgctttatacaagtgtttatatttttgctacctgtttttggctgacattccactaggcattagctttacttctgttttcctgccattaaaaataacaggatatgcttccgatcgaatatttgctccttatactgtttacaagggcaaagctgcattctcgttgatcccttgtcttccaactttcactaagttgaattctgggactgttgtagttgatcgacgtggttcaatcatgatgactttcatgcattctattggagagcgcaaatatgactgggagaaaagacaaagatttgctctctcagcaactgaagttggttctttgataacaatgggcgctcaagattcctgtgatttctttcatgacccttcaatgttatcaagtaatgctggtcaagtaaggaagagcttatcaattaagcctcatgcaaatggctactttgtgtctttgactgttgtcaacaacctgttaaacaccaatgactacttcagtgttcctgtcacaactgctgagtttgctgtaatgaagacagcttgcagtgtatgccttttatctgcttag

SEQ ID NO: 12251 - DNA, 1056 bp, Glycine max
  Peptide Sequence Number=SeqID_103936
atggcggctgaatcattgcaatctctcgtctccctctccgaattggtttccacatcctccactaaccagcgtgttcgtatattccgtcgcgaaatccctgcgttcttgaattcctccacttcagaaatgtcaacggagctcgcttcgttactcatcgatataatattcagaacagtcgcgatttacgatgatcttagatcgaggaaagccgttgatgatgtgattgtgagagccttaggtggaacagtgttcatgaagacttttgcaggagctctcgttcagaatatggaaaagcaatccaagtttcaatctcacgttgggggctatagacttctcagctggtcgtgtttacttctgagcaagagccagttcgccgcagtttctaagaatgctctttgtagagtggctgcggcgcaagcttctttacttagcttagttttgcgaaggtcttttcgggagcgaaaggcttgcaggaaaaagtttctccatttattttctcagtcgccggatatttataaagtctacatggaagagcttagaaatggccgaattcctttcaaggatagtccggaattattaatgctgttgctggagttctcaagtcgatctccgtctttatttggggaattcaagccagcatttcttgatatatatgttaatgcaatactgagtgcaaaagaaaagccaggaaagagtcttactgaagcatttcatccactttatttgcaaatgtcacatggagattttcaaagtcttgtgataccatcctctgttaaaatgctaaaacgcaacccagaaattgtgttggagtctgtgaggattctgttgaagtctgttaaccttgatctgagtaagtacgctgcggaaattctttcggtagtattagcacaggctcggcatgctgatgaagggagaagggatggggcattagctatagtccatagtctgagccaaaaatctagcaatccggatgcattagacacaatgttcaatgctatcaaatctgttattaaaggtataaaatgtccctatgcttgtgttgttggctttttatga

SEQ ID NO: 12252 - DNA, 960 bp, Glycine max
  Peptide Sequence Number=SeqID_103937
atggctagatacattaatattgtacttttgggaatagtgttggtagtggtgagattgaaaggtgcagaggcacagcgggcgttctttgtgtttggggattctcttgtggataatgggaacaacaactttttggcaactacagctcgagcagatgctcctccttatggcattgattacccaaccggaagacccactggccggttctctaatggctacaacattcctgacttcattagtcaatcacttggggccgaatccacattgccttatttagatcccgagctcgacggggaaagattgcttgttggtgccaactttgcttctgctggtaaacataatcagatatacagacagttggagtactgggaagaataccaacaaaggatcacgccaatacaattaccagattacgtcaagtatattatctctgagtacaagaaagttctaaggaggctatacgaaattggagcacgtagggtgctggtgacgggaactggtccattgggttgtgttccagcggaattggcccagcgaagcaccaacggtgactgctcagctgagctgcagcgagccgcagccttgttcaaccctcaacttgttcagattatccaacaactcaacagcgaaattggttccaatgtcttcgttggagtcaacacgcaacagatgcacatcgacttcatcagtaatcctcaacgatatgtaaagctcgtggttgaacatgcaggatttgttacatcaaaagtagcatgttgcggtcaaggaccctacaatggtcttggactgtgcactccggcatccaacttgtgccctaaccgtgatatttatgccttttgggatccttttcatccatcagaaagggctaataggttaatcgttcaacagattttgtcaggcacctcagagtatatgtatccaatgaatcttagcaccattatggctttggattccaagaactag

SEQ ID NO: 12253 - DNA, 783 bp, Glycine max
  Peptide Sequence Number=SeqID_103938
atgccgtcggcggcgaggactcatcaagtattggagatcaacttgatctccgcgcagggcctgaagccgccttcatctccacggcggaggcttcaaacctacgccgtcacgtggatcgaccccgccaccaagctccgaacacgcgtcgacaagctcggcggccacaaccctacctggaacgataagttcctcttccgagttacgccggattttctcgccggcgacacctccagtgtctgcgtcgccatctacgctgtcggcaccttccgcgaccacctcgtcggcaccgtacgcttcctcatcagcaatatgttctcccccgacgccgactacgcaacgccgtgcttcagcgctttccagatccggcgcccgtcggggaggttccacggcgtcatgaatatcggcgccatggtgatggacagctccggcttccccgcgctggagaagatctcggcgatcgggtaccgcgacctcatgggagagaagatacaccagcgccggagaaagacgccggaggagaaatcgaaggaaacgaaggaggaggaagttctgtcgagcgaatcttgggagaattcttgcacggaggagggggaaggggagtcttcgacggcgtcatcttcgtcgtcgccgagaacgacggcgttgaaggattggaacggagtgaaggaattggcgggaaataaagggttggcaatgtcggcttcgggattcttgtgctgtttggtgactcaaagaagtgttcaccaacaactcactccaaccaatcacactgtagaaaggtaa

SEQ ID NO: 12254 - DNA, 1809 bp, Glycine max
  Peptide Sequence Number=SeqID_103939
atggcatccaccgtgcttctgcctaatacttctttgtttgtcactggcatcagtcctttttcccttggtatccaactcaaccaaatgaagcaattcaaaatcgaagttgaggaagaagttgaacaagttgttgcagttgttgcagttgcagaggatttcaattcggatctatttgacccgggaatggtgatggattcttcctcctccgattactctcgcagtgcttcctcttccgacgccgatttcgggttcgctttcaatgacagtaatttctccgacaggatcctccgaatcgagatcatgggggaccccgtcgaggcccgacccgactccgagggttgcaccaccatcgccgactgggctcgccaccgcaagaggagacgcgaggatatcaagaaggataacgttgttgatcttactttattgcccgacgagcaaattttgaatgaaaatcagcctgatatggacgattttgtaccctctgagaatcaagatgaagatgcggttgcaatggttgaagaacccccttcaggtgatgaggcggcaaatagcaatgattcaaattggaatatggattgctctgcagttgtgagagttagaacactacacatcagttctcctattttggctgctaaaagtcctttcttctacaagcttttctcaaatggaatgagggagtcagagcagaggcatgtcaccctaagaattaatgcttctgaggaagctgctcttatggagcttctgaattttatgtatagtaataccttgagcattacttcaccacctgctttattggatgtgttgatggctgctgacaaattcgaagttgcttcctgtatgagatactgtagccgattattgcggaatatacctatgacacctgagtctgcattgctttaccttgagcttccttctagtgtcttaatggctgatgcagttcaaccattgactgacgcagcaaagcagtatcttgccagtcgatacaaagatataacaaagttccaggaagaggttatgggcttgcctctagctggaatagaagcaatattgtctagtgatgaactccaggttgcatcagaggatgctgtatatgactttgtgttgaagtgggtccgaacacagtatccaaaactagaagagcggagagaagtcctgggtacacgacttgcccgtttaattcgcttcccttacatgacctgtcgaaaacttaagaaggtcttaacctgcaatgactttgaccatgatgttgcatccaagcttgtactcgaagccctctttttcaaggctgaggctccacaccgccagcggatactagctgctgagtctgcttccttcaatcgactttttgtggagcgggcatacaagtatcgccctgttaaggtggtggaatttgaacttccgcggcagcagtgtgtggtttacttggatctgaagcgggaggagtgcaccaatttgttcccatctggccgagtatattcacaggcattccatttaggtggacaagggtttttcttatcagcacattgcaacatggaccaacagagctctttccattgctttggcctgtttttaggaatgcaggaaaagggctcagttagctttgccgttgactatgagtttgctgctaggtcaaggccaacagaggaatttgttagcaagtacaaaggcaattatgtattcactgggggaaaggccgtcggatatagaaacttgtttgcaattccatggacaacgttcatggctgaagatagtctttactttatcaatggtgtacttcaccttagagctgagctcaccatccgacactga

SEQ ID NO: 12255 - DNA, 1011 bp, Glycine max
  Peptide Sequence Number=SeqID_103940
atgtcaccaacacattccgatacgcaattgagaattgaagaacgagctctttccgcatccggtgccgcctttgtgtctgctatcatcgttaatcccctcgatgtcgccaagacaagacttcaagcacaagctgctggtgttccctaccaaggtgtttgtcaattggccaacacgactctacacgatgttagatgttttgcaatttctagttctgagccaccgcggccttgtccttccgggtgtaaccgctacaaagggacattagatgttctttacaaagttacacgtcaggaaggctttatgagattatggagaggcacaagtgcaagtttagcattggctgtgccaactgttggaatctacatgccttgttatgatattttgcgcaacaagatggaggggtttacaactcagaatgctccaaatttaacaccttatgttccattagttgcgggatcagctgcacgttcattggcttgtatttcttgttatcccgtggaacttgcaaggactcgcatgcaggcatttagagcaacccaaagtggcaagcctccaggagtgtggaagacattgcttggagtcattcaccctgtcaagggcacaatacataggtatcgtttctggtggactggtcttggagcacaactttctcgtgatgttccattctctgcaatttgctggtcaacccttgagcccggtttatgccttgactttggagctgctttgcagattaggaaaaacattgttggcctagctggtgatggagcaagtgccgtcactgtccttggagcaaatttttctgctggttttgttgccggaactttagcatcagctgtcacatgtccactggatgtggcaaaaactcgacggcaaatagaggttgtttctcaaatccatgattttagcactactataacttcccattcacttaatcatcctgtccttgccaagaaaaggcagaaatttggaccttgcatcatcaggaaaagtagtcaacgtattttcttgtaa

SEQ ID NO: 12256 - DNA, 1323 bp, Glycine max
  Peptide Sequence Number=SeqID_103941
atgaggctttttcttgccttgctgagagtctacaaaagaagaaaatgcatgaagagaaggagagaagatcacaaaaaggaatacgcttcccaggattacacagcgtcttatgattcagatattattttcgtccctgaccggagttacaggaaatcagatgctttattttgtggggctgaaatattcatccgctacaattgcatgtgcactgacaaatttgctcccagctttcactttcatccttgcagttctcttcagacaagagaatttgggaatcaagaagagggctggtctagcaaaggccaatcaagtattcactggagatatgctgagaaaatggaaggaactagctcttctggcaaaggaaacatgttcctaggccctttggtcgtaattcttagcacccttgtttgggcagcatggttcataattcaaaaagacataagcaagacatttccagctccttacacgagcactggcttaatgtgtttcatggcaagctttcaatgcgtgatcattgccgtgtgtgtcgaccacagggcctcagcttggtcactccacaatgctatgagactttcctctgccctttatgcgggaatattttgcactggattagcctattgcctcatgtcgtggaccattgagagaaaaggtcctctttatgtctctgtatttacccctttgcagcttgtcctcactgccattttgagctgggctttgcttcgggagaaattatatgttggaactgccgtagggtctctcttgatagttttgggactctattctgttctctggggaaagagtgaagaggtgaataagggagacggtattgaagaagatgcagttaaagaagcagtcaaggattcgaagaatgacatggaattgcaatcatatgtgccatccaatggtaataatggtcgggttgtctttgatgccaattttattcctcctcttgttcaaattcttcaacattctgagtttgacgtcaagaaggcggctgccagggccatcttctacgtgacttctgaaggatctcaagaccatatcaggtacctggcatatgaagaaggttgcattaagggactatgtgatctgttgagctgtccagacccaatggtagtgtcaacttgtcttgaggggctggagaacattttgagggtcggagacgctgacaaggaaatgggtgtcaatgtttttgttcaaagggttcataaatatgaaggatgggataagattgaaatttttatgaatcattggaacaatgagatttctctgagagctgtgaggattgtggaagaaatgaagaatgatgctagtccctaa

SEQ ID NO: 12257 - DNA, 1587 bp, Glycine max
  Peptide Sequence Number=SeqID_103942
atgaaaccatcccctaagattctcattggttacaagaattcaactttgcttgcaagatgtcaccattctcttgccatgtctatgtctaactactctaacccttgtagcatcaatcttgatcacaacaccatgcagtgcccttttcatacgcgcgaatttggacgcataatgcatggtaaccaacaagtttttgggttaccctcttcgagttttggccaatcaaggtcccttagtttaagtgcaacaagaaccgcaaaacggggtgcctctgccattgcccgagttgacttcaacttcaaggctcgtgacttctcgggctcggtcgggacacgcgccagtggcaacaatggtgaaatggcttacgttaagggcggcatgaatgtgaagccaatagtggtggaaagtgttgataatgttgaggaagagtctcggttagaagttggtgaggaagacgagaacacagagaatttgggtggtgtaaagaatgcagatgacgaggctgagaacgtagaagaggaaacagaagtggagaaagaggcatggaggttactgcaggaagcacttgtgacatattttgactcccccgtggggacagtggcagcaaatgattcagatagtgagcaatctttgaattatgatcaggttttcattcgggattttatcccttcggctcttgctttcttgctcaagggagaaaaggagattgtcaagaactttctccttcacaccttgcaactccagggcttgatgcctgctagtttcaaagttaaaacagtggaacttgatcaaggaaaaacagaagaagttttagatcccgattttggggaatcagctattggtcgtgttgctcctgtagattcaggattgtggtggataacgctgctgcgggcttatggaaagattactggggactacagcttgcaagaaaggttggatgttcaaacaggcttaagaatgatcattaacttgtgtttaacggatggcttcgacatgtttccttccctgttagttactgacgggtcttgcatgatagacaggaggatgggtattcatggtcaccctcttgagattcaagctttattttactcagctcttcgctcggcccgtgagatggttactgaagatgaaaaatccaataatctggttggagaaattaacaacagactcagtgcactattattccacatcagagaatactattggttggatatgcgaaagttaaatgagatatacaggtacaaaacagaagagtactcattggatgccacaaacaagttcaacatctatccagatcaaatccctaagtggctaatggattggatcccagaggaaggaggatatctgctagggaatctgcaaccagctcacatggatttcaggtttttcatgctaggaaatctttggtctgttgtttcctctttgggcaccccaagacagaataatgctattttgaatctgatagaaacaaaatggggtgatctcgttggggaaatgcctcttaagatatgttatcctgctttggagcatcatgaatggcgaataattacgggcagcgacccaaagaatacgtataaactcttcccttga

SEQ ID NO: 12258 - DNA, 537 bp, Glycine max
  Peptide Sequence Number=SeqID_103943
atgggagttgaagttgaagaagaagagaagaagaagatgcagtggtacttcgtcgcttcgctcctcaccgtcctcaccagttctcagggaatactaacaaccctctcgcaaagtaacggagagtacaagtatgattacgccacggtcccatttctcgccgaggttttcaagtggtgggtggtttcaccttttcagcttgcggtgtcaagtttgttactgtggagggaatgcaaaaagtcacctttgccaaagatgacaacggagtggaaaacggtgtctctgttccccattccctcagttatatatctgatccacaacaatgttcagtttgctacactcacttatgtggacacatccacttatcagataatgggcaatttgaagattgtcaccactggaattctatttaggttgttcttagggaggaggctttctaacttgcagtggatggctattgtgctgttggctgttgggacaaccacaagtcaggtgccaacaacttacgggagtctcggaaatttggttttgtggctttaa

SEQ ID NO: 12259 - DNA, 150 bp, Glycine max
  Peptide Sequence Number=SeqID_103944
atgacattttttgaggtttttaccattgtagaagtgagacctctgaagaggttgggaaggattagtcaagtaaattcgatcgaggatgtttcatgggatcactgtcatcatgacaataggagaatggggatgaagcctacatggatatag

SEQ ID NO: 12260 - DNA, 582 bp, Glycine max
  Peptide Sequence Number=SeqID_103945
atgacttatgattacccttccatagtcaggatctacgactcaccagttaatccggaacagactatggctatgctgttcttagttcttactctctctttaactatctacgtggaactgcagggaagttcttatgaagagaaaaattcaggaatgttgaaagggaaatccgtgtcaaaatcccctttatcaagcaagatatccaaatccaggattggggacttggtgactgaagttggggctgaaactatctcagtgatatcagattctgaggtttgtatgttttggcataatagtccagtgctgtccaagtggtacgctgacaaacagaaagggtttgattctgaagtcgctggtgataagaatactggagagaagctttccatgaaatggttttcaaacatagtctcgggtaacatgttgtcctcgttttctgatccaattgatggagaaggaaaggaaaaccatgggaagatatcctccttggtttccaattcctctgttttgactttaagctctgtttcaaaggtgaaaatcacctcaggggtcacctcaattgttgttgggtcttcatctgacctttga

SEQ ID NO: 12261 - DNA, 444 bp, Glycine max
  Peptide Sequence Number=SeqID_103946
atgacatatgacttctctaatcctcataatcctggtcctaatgcacctatgaaatggattcaaattgttctacagctgcttcttggtacctctgccaatagaacccaaagccttgcccccaagatacttctcggcatcgacttctatggaaatgatttctccctttcaagggagaaagttgagagtgcagatgcaggtggtggagctattattgggagagattacctggcacttttggagaagcacaggcctgaactgcagtgggataagaatagtggggagcattttttcttttacactgacaacaaggatatcaggcatgcggtattctatccatcttcgaagtcaatttctttgcggtcagaggaagctcgttcacgggggtgtggcatctcgatctgggaaattggccaaggcttggattattttttttaccttctttga

SEQ ID NO: 12262 - DNA, 1320 bp, Glycine max
  Peptide Sequence Number=SeqID_103947
atggtgaaggaaaccaagtctgatttgaatccattgttcgcgcagaagcacagccatcatcatgttcatgtgttccttaagttggcagtgtcgtgtctcttggtgggtctcgccattcgcctcctcttcttcaccgattcattcagcttgtcatctgtggtgcataatcctcctcctcttgcagctaacgcaatagtacagttacccattctttcttttccctctccgccccctccttctccttctcttcattttccgccaaaccagacccaaacctctccccgagagaagtgtgatctttttgtgggagattgggtgccggacccaaatggtccaatgtacactaatgagagctgccgtgtgattgaagatcatcaaaactgcatgaggaatggacgtcctgattcggggtacctttattggaggtggaacccaaggggttgtcaattacccaagttcagtccaaagaaattccttgacatgatgagggataaatcatgggcctttattggtgattccatctctcgcaaccatgtgcaatctttactttgcattctttcccaggtggaagcagctgatgaggtgtaccatgatgaggaatatagatcaaagatatggaagttcccttcccacaacttcacactctcagtgatatgggctcctttccttatcaaagcagatatctttgaggacatgaatggagtttcctcttcagaaatacagctttatctggacactctggacgacaaatggaccaaccaatacaagaattttgactatgttgtaatcgcaggtggcaaatggtttctcaagacagcaatataccatgaaaacaacactttaacaggctgccacaactgccatggaaagaatttaaccgaggtgggattcgaacacgcgtaccgcaaagcattgcagcaggtttttgacttcatgacacactcagaacacaaagcggttgtcttcttcagaaccaccacaccagaccactttgagaatggggaatggttcagcggagggtactgcaataggacagtgcccttcaaagaggaccaggttgaagtgagttatgttgattccatcatcagaggcattgaacttgaagagtttcacaagactaagaattcaagtgccaacaacttgaaacttttggacacaactgggctctcactgttgaggcccgatgggcatccaggtccatatcgccagttccatccaaagcccaatgcgaagaaggtccagaatgattgcctgcactggtgtctgccaggcccaattgattcctggaacgacatagttttgcaaatgctgacaatgtga

SEQ ID NO: 12263 - DNA, 708 bp, Glycine max
  Peptide Sequence Number=SeqID_103948
atggaaacggaaacccgacggaaagtggaggagatggtgttggatatattgaagaaatccaacattgaagaagccactgagttcaccatccgagtcgctgcctcggagcgtctcggcatcgacctctccgactctcccagtaggcacttcgtcagaaccgtcgttgagtcttatcttctctccgttgcggccaatgaaatctccaaagacgcagagaagaaggagaacgaagatattgccgccaaaaacgacgacgatgtgaagaagggagatgtcgttgcggtgcccaaactgaagagggatgatcccgaacgcgttatttgtcaactgtccagcaggaggaacttggcggtgaaacatttcaaagggacaaccctagtctcaattagggaattctatatgaaagacggaaaactacttcctggttctaaagaattggaaatttccgaactcggtagaaccgtagaaggttgcgctagtggaattgtgtgcttctatttggcagaccctatctatgccttctcaacttcgcacaagccctcccctaaactctgctgtccaaaccactgcaaccagagcccccctctgatgtgtcagagctcttctgccccacgagtgaggtcgcctcttgttcctttgcggctttgtttgtgcggttctctctccctattttctgtgagctactgctctgtttctggcgttaagtag

SEQ ID NO: 12264 - DNA, 1860 bp, Glycine max
  Peptide Sequence Number=SeqID_103949
atgaagcttgacgcgggcgtggtgtgggacgatgaggacaaggccatgcttggggctgttctgggtggtcgagctttggagtttctaatggcaaactggttgtcgaatgagagtgttttaatggcggttgggagtgaggaggggctgcagaacaagctctcggatctggtggagcgtcccaatgtctccaatttcagttggaactactccattttctggcagctctcgcattccaaatccggtgactgggttctgggttggggagacgggtgctgcagggaacccagcgaggaagaagagggttctttgggaagaggaacactgaggcttcttcgcgtggacgaggagatgcagcagaggatgcggaagagggtgctgcagaagctgcacaccacgttcgggggcgaggatgaggacaattacgcttttggcctcgaccacgtcaccgacaccgagatgttctttcttgcttccatgtacttttctttccctcgcggccatggtggcccaggtaagtgcttcgcgtccgggaagcatttgtggctcaaatctgtgtctgattactgcgtgcgttcttccttggctagctctgcgggaattcagactattgttttggtccctactgatatgggagtggtggagttgggttctgtcagaatgttacccgagagttttgaactcttgcaggctgttaaatctgtgttctccacgcagtctccttcataccaaggggtgagtgtgagcaccggtgggaatgctgttttccctggtttggcaattggggatgctaataaggtagatggaggagtttcgattcccaaggtttttgtcaacacaattggaaatcggacgcatttcagagagaaacttgcagttagaaaaatggaggataataggccttggccaggccatggccaccccgaccccaatgggaacaatctccacaacaacgttagttttccgaatgtgcggggtaatagtcttcatgtttcgagttgggcagtgaattcggatctgaggcagcctggtccccttgagatttttgctcctagggcccccacgagtagtgtcctcgcagagctggctaatgttgggaaacaggatttcagacctcaaaggcaggtgcaaatgcaaattgactttaccggagccacttccaggccttcttcagcgagaccggtcgtcggtgaattggagctttctgatgttgaggcctcttgcagggaggagcaacaacccagttttgccgatgaaaggaagcccaggaagcggggaaggaagcctgccaatggaagggaagcgcccctcaatcatgtggaggcggagaggcaaagacgcgagaagctcaaccaacgcttctatgcgttgagatctgtggtgcctaacatctccaagatggataaggcttcattgctgggagatgccattgcttatatcaacgagcttcaggctaaagtcaggatcatggaagctgaaaaagagagatttggaagcacttcaaatgatggatcagtcttggaagctaagttgagattggaaaatcaggagaaaaaagctcctgatgtggatattcaagcttttcaagatgaggtcattgtaaaggtgagctgccctcttgacagtcaccctgtttcaaaagtaatccaaacatttaacgaagcacagatcagtgttgtagagtctaaacttgctgctgcaaatgataccatttttcacacatttgtaattaagtcccaaggacctgaacagctcacaaaggacaagttgattgctgttttttctccaacagaatccaactcattgcagccattgtcacagttggatagcaagggaattgcagtcagcatagtccatacgtag

SEQ ID NO: 12265 - DNA, 576 bp, Glycine max
  Peptide Sequence Number=SeqID_103950
atggcagacccattccgctgggacccattctcgcactccatagcctctcgatgtccatcatcttcgccaccatattcgccggcctcttggtctccgccgccgtcaaaatcagagagatgtggtggctctggcggcgctacaagatcccgctccagtggctgctatgtttccctcttgggacgcatccctctgattgtgttttcttctgaacagtcatcgtcgtcctacgacgtcgtaagctcgttttctttcaactcttctaccacacgatttccgccttcatgtctttcctatggctcgagttctcgcaatctttccaagttctcgcaatcctcttcaccacgctcacattctccgttatgtacggctatcgcttttggacatcagcggcggcctctgatggatcttgtaacgatgcttgacgttggcaacagtatgagcagcgcgaaacttcacatgctaaagtgcgcgatgtggttggttatatcttctctcggcgcggctaacgagctcgccgtcgtggcttccgtggctaattccaaatggttgttattgctgcgaagaatgacgaactag

SEQ ID NO: 12266 - DNA, 279 bp, Glycine max
  Peptide Sequence Number=SeqID_103951
atggttgaaatgatggttgctaagtttgaaaaatattgggagaagtatagtgttgtacttgctctaggagctattcttgacccacacataaagctttctttattggaatattgttactccaaagttgatgcatctacaagtgagagaactacagtcaacaacttacttgtaagattggaaaatgatgatgatgacatcagtgacatcgaagataagaaatgggagtcatcttccaaggaagcacccaatgttttggatttggaagatgatgaaacttaa

SEQ ID NO: 12267 - DNA, 1356 bp, Glycine max
  Peptide Sequence Number=SeqID_103952
atggcaggagcagaagcaagggctctgtggcagagaactgctaatcgttgctttgtccaagaagatgcaaaaagagctcccaagttggcttgttgccaatcttcatgtgcaacatcaaaatcagttgatactggacctgccagtacagcagatgaatctgatcataatacagttaatgttacccattttaacaggaaatcgtcaatttctaatctatcatcagactgtaggtggtggttgcattcacaacctaattatgggtatcaaaagggtttaacatatgaacagttaaatgcattagaggatgaggtagaaactttgttagctagtgatttaagtaagaattctgaagaatttcatgaattaatggatgtgatggaaaaacatgagacaatggaaattgattgtgttggctgctctggatcctccaagaaagcagatgatttttccttggaatcagattattcttggattgaaagtgataaggctgagccatggtggcggactacagatagagatgaattagcttcatttgtttcacagaaatctctcaatcatattgaaaattgtgatcttcccccaccacagaagaagcatcttagagggcacccatgtgctcatgttaataatgacaaaataaagacagcatcttatgactgggaagccaaatccagaagcttttccaatttgacaggtcatacaccaggaagtttagattcaagattgatgcataagaatcatggtcattctaccaatgaaggacttctatattttgcttctgacaaatgttcaagtcatacccccaagcatgaggatgtcaaaaagagtcaacaaaattttgatggagaccccagtaaagctcaactaatggaagcattgtgtcactctcaaacacgtgcaagggaagcagaggaagcagcaaaaaaagcctacgcagagaaagaggatattgttactctcattttcaaacaggcttcacaactttttgcctataagcaatggttacaatttctgcagctggaaactctttgcattcagattaagagcaaggatcagccaatctctactctctttccagtggctcttccatggatgtcatatgaaggtagaagctcacggaagaggaagcagaaaatatccaattccaaacaaggagaaaggaaagccaattcaaaatgtgatattacaacatatgctgttgcctttgctttaggattgagtctagttggtgctggcttgcttttgggatggacagtggtgactaactactctaataaaaatgtttgggatgactctttgttgaggagcaagggcaacatcttgaaggacataacctgtggctgtggtgaaatgtga

SEQ ID NO: 12268 - DNA, 2271 bp, Glycine max
  Peptide Sequence Number=SeqID_103953
atggaaatgagtttatatgaagatctggttgctgcctgggtacctgcaaagcatgagtggctgagaaagcgtcctttgggtgaagaactggtcaataaattgggaaagaggaagatgttcagctactgtgcctatgatctgttgttcttgcattttggcacctcgaatgaagttttagagcaacttagtggtgttggttcagaactggttggtagaagacatctatgttctattccagcaaccactgcatctgatattacagcatctgctattattctttctagtaaaattgctcctggtgtctcaattggggaagattctctcatatatgattcatccatttgtggtggaatacatattggctccttatgtatagtggttggtgtgaatatctctctagacaaccttttaagtgttgaaaattcaatcaagttcatgcttccagatcgccattgtctttgggaggttcccttgattggaaatagggagctggtcctagtatattgtggccttcatgataaccccaaaagttcactttctaaagatggtacattttgtgggaaaccttggaagaaaattttacatgatttaggtattcaagaaagtgacttatggggctcctcaggccctgaaaagtatttatggaattcaaaaattttccccatacttccttatgcccaaatggtcgaggtagcaatgtggttgatgggcttagccaatgaaaaaagtgaatccatgcttcctttatggaaatattcccggcgcatcagtttggaggaattgcatagatcaattgatttttcaagaatatgtatagattctagtaatcatcaagctgatcttgtggcgggaattgcaaaagcttgcatcagctatggaatgctggggcgcaatttgtcgcagttatgcgaagaaattcttcaaaaggagggttctggagttgaaatatgtaaggaattcttagctatgtgtccaatagttcaggagcaaaactctaatatacttccccaaagccgggcatatcaggtgcaagttgatcttcttcgtgcttgcaatgatgaagggatggcatgcgagttggagcacaaagtttgggctgctgtggctgatgaaactgcgtcagcagtaagatatggattcaaagaacatttatcagagtctcctggtagcatttcctgtcaggagttccagaataatcatcatgataactgcactcatcttcctttccatcctagaagggtaaaagtagaattaccagttcgcgtagattttgttgggggttggagtgatacccctccatggagcattgaacgtgctggatgtgttttgaatatggcaataagcttggaaggttctcctccaattggcaccatcatagagacaactaaagcagaaggaatattatttactgatgatgcagagaaccagttatttgttggagattataagtctatttgcgcaccatttgatggagatgacccatttcggctggtcaaatctgcattacttgtgactggaattattcatgacaacattcttgtagatatgggcatgcacatcaaaacatgggccaatgtcccccggggcagtggattgggtacttctagtatcttagctgctgcagtggttaaagggcttctccaaataattgatggggatgacagcacggagaatgttgctagacttgttttagtgttagaacaacttatgggtactggaggtggctggcaggaccaaatagggggtttgtacccagggattaaatgtacttcgagctttcctggaattccactgcggcttcaagttgtccctcttttggcttcacctcagttgatttccgagttgcagcaacggcttcttgtggtatttactggtcaagttcgacttgcacataaggtgctgcagaaggtggttgttagatatcttcgccgggataaccttcttgtgtcgagcatcaagcgccttgctgaactggcgaagattgggagagaagctttgatgaactgtgacgtagatgaacttggtgagatcattctggaggcttggagattgcatcaggaacttgacccttactgcagcaacgagtttattgacagactattttcttttgccactccttactgctgtggctacaagctggttggagctggtggtgggggctttgccctgttacttgcaaaagatgcacagcttgccaaggaactgaggcggagactagaagatgagaaacattttgaagtcaaagtatatgattggcagatattcctatag

SEQ ID NO: 12269 - DNA, 213 bp, Glycine max
  Peptide Sequence Number=SeqID_103954
atggaaagtttcttgcagaaacaacacatgttatcatcacatcgcaaaatatctgaagttcaagcctatgagattcagatagagaaggactcaggaatgaagcaaaaggcttcatttccgcttatgagtgcacacgttgcaggagatagagctaatcttggttatacacgcttggatgccaagaattatctccaagcaagaagacaagcgtag

SEQ ID NO: 12270 - DNA, 225 bp, Glycine max
  Peptide Sequence Number=SeqID_103955
atgatgatcatgtgtcttaaaagcttggtcttcttggattctggctgtagcaagacagaggtcgggaaggattacggagaggcagataatgagaggggtaaggaagagaaggaagccaaaggccaccatccaagcatggaagctcctgctatgcttatcaacaaggacgagaataatataagcaaacatgatgatggctttgttatccacctacttttcttgtag

SEQ ID NO: 12271 - DNA, 1137 bp, Glycine max
  Peptide Sequence Number=SeqID_103956
atgtcagaaggtgcagaaattgatgagcgtgtggaccttgatgaggaaaattatatggaagagatggatgatgatgttgaagaacaaatagacgatgatggagtggatggagttgaagaagaaaatgctgaaggtagttttgaagaagatgaatatgaggactcagctgctgaggctggtgggaaagaccagttgcctgaagcagaaaaaagtgacattgctactgaatttggggatgatgagcaaaaattgtctttcattgatgaagatgagaaagagaagcatgatgaacttcttgcccttccacctcatggttctgaagtctttattggtggacttcctcgggatgtatgtgaagatgatttaagggaattgtgcgagcccatgggtgatattcttgaggtgcgattaatgaaagacagggacactggagaaaacaagggttatgcctttgtggcttttaaaacaaaagaggtagcgcaaaaggctattgaggagatacacagcaaggaatttaaggggaaaactttgaggtgttcactttctgaaaccaaacacagattattcattggtaatgttccaaaaacttggactgaagatgattttaggaaagttgttgaaggtgttggtcctggggttgaaaccattgagctcataaaggcctacctttttattcccactccattttgtttatatcaggaccctcaaaatcctagtaggaaccgtgggtttgcgtttgttttgtattacaataatgcatgtgctgattattcgcggcaaaagatggcaagttctagctttaagctggatggcaacaccccgactgtcacatgggcagatccaaagaactcacctgaccattctgcttcttcacaggaaaataaaaagcccatcaaaacaaaactgagaaactcagatacacccttcccatacataactgaagaaattcatttagccaaagtatcgcactatattggacgaccagtagttaaaggagtcattaaagtgcctgtctctgggaatcttccatcacttttggaggatcgaaactcttgccttggaagaccaaagaattcctatgctgccatattgtggaagttaaagcaatccaccaacaacgccggcgagtttggttaa

SEQ ID NO: 12272 - DNA, 2409 bp, Glycine max
  Peptide Sequence Number=SeqID_103957
atgggggctactccagaggcgaacggaaatgtcgcggacgaagaaaacgggagcaacgtctgtggctcaatcgatttcggcacggcggaggccgtcgaatacgttcgctccctcaccgacgttggcgccatgacgcgcctccttcacgaatgcatcgctcaccagagagcggtggacgttgaactcgacgagcttctgtcgcagcgcaccgacctcgaccgccacctcctccagctccagcgctcctccgacgtcctcgacatcgtcaactccgacgccgactacatgctctccaacgtcgcctccacctccgacctcgccgaccaggtcagccgcaaggtccgcgagcttgatctagcccagtcgcgcgtccgcaacacgctcctccgcatcgacgccatcgtcgaacgcgccaactccctcgaaggcgtccaccgcgccctcgaggccgaggactacgagtccgccgccctctacgtccagactttcctccagatcgacgcccagtacaaggattccggctccgatcagcttcagagggatcgcttgttggctgccaagaagcagttggaaggaattgtaaggaagaagctctccgccgccgtcgatcagcgcgaccaccccgccattctcagattcattcggctcttcacaccactgggtgtggaggaggagggtttgcaggtgtatgttgggtacttgaagaaggtggttgcaatgaggtcgagaatggagtttgagcagttggtagagatgatggatcagcagaatgtgaattttgttaggtgtttgaccaatttgtttaaggacattgtgttggcaattgaggagaatagtgagatcttgagtggtctttgtggggaggatggtattgtgtatgccatctgtgagcttcaggaggagtgtgattctcgcggttcggtgattttgaacaagtacatggagtataggcagttggctaagttgtcctctgagataaatgcacacaacaccaatttgcttgctgttggaggaggtcctgagggtcctgacccacgggaggttgagttgtatttggaagagattctctcccttatgcagcttggtgaggattacactgagttcatgatttccaagatcaaagcacttacttctgttgaccccgaattgcttcctcgcgccaccaaggctttccgaagtggcagtttcagcaaggtggcacaggatttaaccggcttttacgtcattttggagggatttttcatggtggagaatgttaggaaggcgataaagatcgatgaacacatgcctgacagccttacttcttctatggtggatgatgtgttttatgtattgcagagttgcctgcggagggcaatatccacttccaatatcagttctgttgtcgcagttttgagtggtgctagtagtttgctcggtaatgaatatcatgaagctttgcagcacaaaactagagagccaaaccttggtgcaaagttgttctttggtggtgttggcgtgcaaaaaacagggaccgaaattgcaacagctttgaataatatggatgttagcagtgaatatgttctgaagctaaaacatgaaattgaagaacagtgtgctgaggtgagtgcagtaagtatggttggtgcaccgttgccctatcatgttgtgcctggggtcccattagaaggtttttttccattttacactagatgtttattcagaggcgcaagtttgctaattaaatatgtggcatgtttgtcttttgcttcatcaactgctcccccttcacttttaaatgtatttcctgcaccagctgatcgagaaaaggtaaaatcttgtttgactgagttggcagatagtagcaatgctttcaagcaagctttgaatgctggcatagaacaacttgtggcaaccattacacctcgcattagaccgttattagacagtgtaggaacaatcagctatgagctttcagaggctgagtatgcagataatgaggtgaatgacccatgggttcagagacttctctatgccgttgagtcaaatgtggcatggctgcagccactaatgactgctaacaattatgacacgtttgttcatttgattattgacttcattgtgaaaaggctagaagtcattatgatgcagaaaagatttagtcagctaggtggtcttcagcttgaccgagatgctagagctttggtaagccgtttcagtgtcatgacacagagaactgttagagacaagtttgcacgtcttactcaaatggcaacaattctaaatttagaaaaggtttctgagattctagatttctggggtgagaactctggacctatgacctggagattaactccagcagaggttaggcgtgtattgggtctgcgagttgattttaaatcagaagcaatagttgctctgaagttgtaa

SEQ ID NO: 12273 - DNA, 468 bp, Glycine max
  Peptide Sequence Number=SeqID_103958
atgagtgacaatggtgaagaagctggagaaaatcgtccagttccccgtttgaatgaaaggattctttcatcattgtcaaggagatcagtagctgctcatccttggcatgatctagaaattggacctgaggctccccagattttcaattgtgttgtggagatcactaaaggaagcaaggtcaagtatgaacttgacaagaagactggattgattaaggttgatcgggttttgtattcatcagttgtttatccacataactatggttttatccctcgcacactgtgtgaagacaatgatccaattgatgttttggttctcatgcaggagccagttcttcctggatgtttcctgcgagcaagggccattggactgatgcccatgattgacgggggatctctacgcagagtatattctgcacaccttgaggcgatagacaaaaatgctattctaccatctccatcagaataa

SEQ ID NO: 12274 - DNA, 324 bp, Glycine max
  Peptide Sequence Number=SeqID_103959
atgacttcatggatattgacactaccaaaggatctgagatactcttaccatttgtacggaaagcaccacgttcaagggaaagaaatcccctcatatgcacatctatttatccaaaaccacgtgttcgtgagcagtgctgatccagacaagaaggcgactgctgaattggagagaagacaagaaagttcaaagggcagggaagaagtactgtacaactttctgctccttatctgcaaagcgaaaatgcgaattaagcagcagcagaagcatcagtgttgtgaacggcatcaacccaacaaggctaacagaaacattagaggatag

SEQ ID NO: 12275 - DNA, 267 bp, Glycine max
  Peptide Sequence Number=SeqID_103960
atgaaaggtgagaagagaaccacatggggttggggagtgggaggggcgtcttcttcggcaagagcggttttcgctgcggaaacagagatactaaagcgtgtgagggttggagaaggcacgtgcaagcgtgagtttgagaaggagagtgtgggtgagggttttagtttgatggatggaaagaaatacccttatgggtattggtcatggtgtttggtgcagcgtgataaaagagtggcgtgttgttttggtgggggtcgatggcgttaa

SEQ ID NO: 12276 - DNA, 228 bp, Glycine max
  Peptide Sequence Number=SeqID_103961
atggcttccgcttgtgcttcctctgccattgcagctattgccatctctacgccgaggcaagcttgggaagagcaaaaggttgttttgttagtgggaggaagagagcagttggaggacgatggatgggcactagagtgtgtgcagttgctgagcctgacaggcctctctggtcctccatggctggagagctggaatacttcacagacaccactagcctctttttcatag

SEQ ID NO: 12277 - DNA, 2709 bp, Glycine max
  Peptide Sequence Number=SeqID_103962
atgagtaaagaaattgatcaatccctaggttctggtgcaccatttctgagcacccaaaacttcaagaaaaacccaaaaaaagaaaaacacaaaagtaagaaaaatgctcagactagtggagatgatgataactctaacaggaagaagaaaaggtctaacaaggaaaaggttgaaagtgggtttgatattgctgctactgcagcaaccaagaagacattgaagaaacgacgaagagatggtgacctttccgaggcttctctgaagaaactgcgtataacggaaaggctggaaactgttaatagtaagtgttacttgttctgtgtgggatttgatttgcttggagatgaagtcttgcttgatggccaagagttcacttgtattgatgggagaacctcagctttggccctggtagaccaggttaatgatagcagtgacagtgtaagagcaagagtagtcagtgctatggaccagctcttcatggtagtgaaggatcttggttcttatggtcgcgatgcttgttgcatagtgagtcaagtaaagctaaagatagtgaattctgaattatatattagtgttgattcatttcttattagttattactgtctgaaatgccaaggatgttgggatccgatgccattttgggttcatgtgggatcatgtgctcaacttttgactgctgcatcttgcattgtctggactttggatttggtgaaaatggagacagaaatctcagagagagaaactgtgcaacaaatcaatgagagtttgtttgtgattgttgctgaggagagtgatattgttcctgcaaagagggcaggtaatggtatttgtggtgacatcttggtagcgaccttagctttcctccttcagagatttggcatagacacactgcacaacaatctccttcaccatcaccacgactatgcaacaacctttggattgtgtatttttgaacaactacgtacaatggctgtgagggtggtgatcatgttggctcttgtgcttcatgtaacaatcgatgaaaacaatacattatcctatttggttcggctttgtggtgtgcgtgcttcttcttccaatgcacttctgaattgcactgacccgagctcccatgcctttgttagccttagaattagaaacttgaatgtcattaaggctgttgccaccttggatgctaaacctcgcttggatttggatgcacctcacccgcctggctttttgctcgaattctccgacccacctgatgatagggagaagttgagaagattgagaatttccaaagctaataaaggaaacaccccctggaacaaaggacgaaagcacactcctgagactttgcagaaaatcaaagaaagaacaaggctcgcaatgcagaatcctaaggtcaaaatgaagctcattaatcttgggcatgcacaaactacagaaacaagaaagaagattggtgttggagtgagaaggcgatgggaaaagaggcgtggaaagaaaatggtgcaggaatcttgctgcactgagtggcagaatttaattgcagaagcttctaggcaaggctatgttggtcaggaagagctgcagtggaattcttatgaaactgtgaatgaacagctgaagcaggactggttgatgagtgttgaacagaggaaacaaatggcaaggacaccatctagcaaaagagcacccaagtcccctgaacagagaaggaaaattgcagaagccattgctgccaaatgggctgatccttcttacatgtgttcaaagttcaagcaacttgttacaccaaatgtggaataccgcgaaagagtttgttctgcattggccaagtatcatggcagtgaagttagagctgaaaggaaacctagaagaaggccaagtgatggtacccaacctaccaagaagaaacctgcaaaaaaaagagatattgatactagcgctcatgttaagaatgactccaagacccgtaagcctatcctgttgaaaaaaagcaaatccccagcctataaggatcctttggtgaattctaagcttgaaatgattaagaatattagagcacagagagttgccgcagaaaccacacaaactcaggccattgaacaagcaagttattggcctctttgtttctatggtcatggtggatacactaaacattggtcaattgagtttggtttgttttggagattaggtcatagaaatacagctgagaaggctgccaaggcactcgaggttgctgcgacaaagagtcctattgcacagtcttctttgatagaaaccagaaagctaatagctgaagctattcaatcacttgaatccattgatacacaagctataactgaggaaaaaggatcagcatttgaagttctaaaccaatctcaaatggcccaagtaaatggacacacaatgttatcatcaagtgactacaagttctctgaagattttggcaaattttccttggagaagccagttaatggtgatgctgaacttctgctaaccaatggttgcacatccttaccttttagtttgaatagtcagatgaatgaatctagtccatcaaatcaacaaagggaagcagaacaggatcagagaagtgaatacgaaacagatccttctccaacagtgatgggaattcactcccttgaaaatcagacaatgtctgtagtaactaaaaagtgggttcgtggaaggctcgttgaagtggctgaagagaaacaataa

SEQ ID NO: 12278 - DNA, 576 bp, Glycine max
  Peptide Sequence Number=SeqID_103963
atggcagacgacgaactctcctcagagtgcttggaccgtctcgaagctgtcattgtcgacctcgttgccgctcaactccattccatcgtgattctcgattccatagtctccaaacttaatgtcattcttctgaaactacatatcccgatcccatcttcttcatcgatcaccagccaccacgccgacgaggaagtttccagcgacgccgtggaggaacttgtccttttggatacactggagttgtcatcagaggtgccccctctgccgatggcacaaggtgcggcgcaagtggtgtggttgtcgtcacgaccagtatcagcgccggagttctcgtccatgctgccccctctggtgacgaaacacgttgcggtgcaagtggttttgtcaaaggtgtttcgcactgtccaccaacactaccgccacaaccactgcaacatggtccaccacgacagcgtcatcttgtacagcgatgccgctaactggttctgcctccgtgccattaatagacattcactcattcctacacccattctaatttgggatccaagttcaatctttctacagccaacaccttaa

SEQ ID NO: 12279 - DNA, 2469 bp, Glycine max
  Peptide Sequence Number=SeqID_103964
atggagcttaggccttacatcgaggaacccatttcaaatgatgcagcatctttaaattttatatctcttgatcttcgaccaagagtcaggcatgattttattctatctaatagagatgcagttgatgaatattggcgaacattggagaattgctatgctactgctgatcgaaaagctgcttcatatgcatttcctggatctgtggtccatgagcttttccgtttccgttcatgggcatctactcgtcttatgacagctgaacaacgtgctgaacttttaaagcatgtaaccaaggataatcttagtgaaaatatttcatatagggactgtgagaagattgcaaaagatctgaatcttaccacagagcagttcaaagatgaagagatagaggataattcacctgaatgcaagggtaattcatctcgtcgtaagagaaaaaaatccactgagctcaggcctgcaaagcatgccagaattgatgatgcagtaactgatgttgtggacatgcacgtagaaggatcacaaaatttggatgttcattcgggagagtgtgccacacatatgcaagaatttgaggagagtatgcctcaagactgtatcccccttattagccagcgtgtcttaaccaaaatgaagccaacacgccaaaggagattcatttggtcagacaaaactgataggcagttggtgatccaatatgttaaacaccgtgctgttcttggtgccaaatatcatcgcatagattggacatccatttctgatcttccagctactccaatcgcttgtacgagaagaatgaatttgttgaatagtaacatgagatttaggaaagccgtgaataaactctgtaacatgctcagtgaacgatatgcaaagcaactggaaaagtcccagcactcgtcattaaacaatgattgcaaacagtttgtgcgatcccagtcctgtgaaggtatcctcaataattctagtcctgatgctgaaattcaaattacaagtctaaacaaagaagcttgggatgactttgagaacaaaaatatcaagatggcccttgatgagattcttcgctgcaagatgatggctaagctgggtgcctcctcccaaaaaggtcaattgcaatatgatgggtggtcagatgcaaatgcgaatgctgatggatttgttgggggcactggcaatgaacgtttcgaactatcacaacagttcttgcagagtgtttccaagtcaccatttccatttaatactggaaagcaagctgttaaattttctgcatggttggaggaaagaggcaaagacctcacagaagtgggcactaatcttgctgaagatctacaatgtggggacatttttcatttgtttgctttagtctcttcaggtgaactttcaatttctccattcctaccagataatggtgttggagaggctgaggacttgagaagtgcaaagcgtaaatctgatactaccgagtcttcatatagtgataaagccaaaaagtcaaaatccttctttggagtagaaggtgaaattatttctcgtcgggaaaaaggttttcctggtatcatcatttctgcacaccgaacaacaatttcaagagctgatattttaaatttgttcaaggataatgataactatggccaaccttttgagggagatttccaattaaacattggccaaagcagtaattattcacttcctgaccatatcttggaaatcactaaatcttctgaccctgtacctctagaagaaaatcatagtgaatcaccctgggaagctatggcaggctatgcacgacatttgttgtctgaatattccaataaaaaacatgcatatgccatttgtgctgaggtcttcagggttgtttatgctgccatccaaaaggctggtgaccaaggattaagcatgggagaaatttcccaggttataaacttgccaggagcagaggtagatgtcttgattgttgatgctcttcaagcatttgggcaagccttaaaggtcaatgcttatgatactgtccgtgttgttgatgtcttataccgtcacaagtactttttgacacctatgtctgattttcatcttcgtgttgtacaaccttcctcaacaaaaaacatcgagaaaagtgatcatacatgtgagctttatgaatcggaggaaagggatactacttctgttgatacttcgagggaaagaaacaccgctattgatagcgtgcacaaattgacaattctcaatcttccacatggggatgtggatcctgaaaatcaagcttgtgataggaatgaaggctgtaagcaaaacagacttgggttatccagagtcaatcataagaaagaaactctcgaattttcttctggtgaatcatgtgtgccaatattgccatgggtcaatggagatgggaccatcaacagcattgtttacaggggactcagacgtcgtgttcttggaatagtgatgcaaaaccctgggatattggag

SEQ ID NO: 12280 - DNA, 381 bp, Glycine max
  Peptide Sequence Number=SeqID_103965
atggcagcagcagaaccccccactggattccaggggattatttcatggctcttcccaccagccattgctcttggggtgtacttcaatgttccgggggagtacttatacataggagcaggcatatttacaatcatattttgcattattgagatggataaacctgataaggcccaccactttgaacctcacatatacaatatggaaatgggagctcgagacaagttaataaatgactataatactatgagcatatgggaattcaatgaaaaatatggggacctatgggatactactaatcttagttataagttggaagatgacctctacaaccagtctgagtctgatccaactaccattgggagctggaacctaaaaacttga

SEQ ID NO: 12281 - DNA, 1623 bp, Glycine max
  Peptide Sequence Number=SeqID_103966
atgtccctggattcggagacgtcgggttccgccagagattggttcttcccgtcgccatccttcttgcggtcctcttcttcgcaatatggccgtcgattctattcaaactcaaagccgcactctcctccgagcagctccactcgcattcgtcatcgccgcagagttaaattcccccggactcctactaacgacaaatctcagctttccgacactgaaaatgttaagtcatcagcgactgcgaggaataatcttatctgcctttcgcaatttcgtttccagtttgccctcgtggatttagcacattgcctctggttatcttggacctacgttgctgattctggcaatcatgccagctcccaaggtattggtccaaggttagttgcggtttccattagctttggtgggatgcttatatttgcaatgatgcttggacttgtgtccgatgcaatatctgagaaatttgactcactgaggaaaggaaaaagcgaggtggttgagcaaaatcatactttaattcttggttggagtgataaattgggttcattactaaatcagcttgccatagccaatgagagtctgggtggaggaactgttgcagtgatggctgagcgagacaaggaagaaatggagcttgacattgcaaaaatggagtttgatttcaaaggaacatctgtcatatgcagaagtggcagccctctgattctggctgatctgaaaaagctccctaactatagtagtggaggtagaagtcaggaggacgccggagggagtgccctaaggctcagtggctccgctttgctccccctagcttgccctaaccatgaacttgagacatgtcaaagacacgatgtaccacctggtttgttgccaagcttggtcatgactcggtcaaccattagaaaccagtcggtatttggagatgagtcggacttggagatgggtcagacatgtctctggcgtaaatgcttaagcgtgagtcggcctccaagggagaagtcggccaagatgatgtataaccctccatgcattaagccttgtggtggagagttggctaggatggtgtacaaccctccaagcaataatccttgtggtgtttctgtttcaaaagcacgtgcaataatagtccttgctgaagatgggaatgctgatcagagtgatgcccgtgctttgagaacagtcttaagtctgactggagtaaaagaaggattacgagggcacatagtggttgaattgagtgatttagacaatgaggtccttgttaaacttgtgggtggtgatcttgttgaaactgttgtagctcatgatgtcattggtcgcttgatgattcaatgtgctcgacagcctggacttgcacagatttgggaagatatacttggatttgaaaattgtgaattctacatcaaaagatggccacagttggaaggcatgcaatttgaggatgtactaatcagctttcctgctgcaattccttgtggaatcaaagttgcatcatatggcggtaaaattattttgaatccagatgactcctatgttctgcaagaaggtgacgagattctggttattgcagaggatgatgatacctatgccccagcatccttgcctacggtgctttgtctcacataa

SEQ ID NO: 12282 - DNA, 810 bp, Glycine max
  Peptide Sequence Number=SeqID_103967
atgaccttctttgttcgaatctcactggaagtacgtaaccccactattagaacatatagatatcaccggcttgtttgttttgttttgctctccatatctatcaccattgagcacatcttccatgccataggaaagtggtttaagcagaagcacaaaagagctctgtacgagtcacttgaaaagatcaaatcagagcttatgttgttggggttcatatcattgctcctaacggtaggagaaggtgtaatatcgaggatatgcatatcagaaaaggttgcgggaaaatttcacccctgcagtatcaaaagagtcaagcctccattagatgatcatcatcatgacgataccaatggccggagattactagctgcgtttctcgattccgataaccaaaacaaccgccgcattttagcactgggcgcaagggacaagtgtgcagcccaaggtaaagtcccatttgtctcatccgaggccattcatcaactccatatatttatcttcgtgctggctgtgtttcatgtcctttactgcatactcactctggctctaggtagagccaagatgagaaggtggaaacggtgggaagtggaaaccaagacagcagagtaccaattttcacacgatcctgaacgatttcgatttgcgagagaaacgtcatttggaagaagacatttgagtttttggacccaaaataccgtcctcgtttggattgtttgtttcttcagacagtttgtacggtcagttcctaaagtagattacttgaccttgagacatggatttatgatggtaatcgcattgcatccttattaa

SEQ ID NO: 12283 - DNA, 489 bp, Glycine max
  Peptide Sequence Number=SeqID_103968
atgatgggctgctgtggttgcttcggatttgtccaaaaaccaagacgacggcgtcgggataaacgtggcatcagtaatcttctctcccaggggctattattggatggagaaactgaaggcgatgagacatatagtggtgacgttactagtaactgcaccagtgtagatgacaatgaggtgcaagctgtacgcaaccgttcagaggatattttaaactttagagctaagaatggcatggtttgcaggccgtttcctgttaaggagacttgcaaacttgatcgctcagaggatgaaaatgggaacaagatgataaatggatatgttcgagagtataaaattggttctggaagctatggcaaagtggctctttatcgaagtagtgttgatggaaagcattacgcaattaaggcagattacttcataatagcatatttttgtaacagggcagtaatcactgctcctgacagtagggaattgcgacattggtag

SEQ ID NO: 12284 - DNA, 588 bp, Glycine max
  Peptide Sequence Number=SeqID_103969
atggtggaggctaaacaacaaaaaccaccatcagatatcaaaaccaccaccggaaaccaaaaccaaaatcaccgtcagaaggtctttgttgaagggttgctctttgttgtcggaatcgacgtcggcggcacaccgaaaaagggttgtggaaagatagggttgggagggcaagaggatccgccccgtgctctgcatcaccacatgcgagctcgtcaacggcaccatggcgctcatccacgacaacctgccctatatggacaacgacgacctctaccacggaaagccgaccaaccacaagggcgtgtcggcgtcacgcgtggtttgcgcgattggggagttagcaaaatcgattggtacagaagggcttgtggcgggacaagtggtggatatagattcggagggggtggcgaatgtgggattggagacgctagaattcattcacgtgcacaaaacaacgacgttgtgttgggggcaataatcggaggtgggatccacgaggaggttgaaggtgttgaaaggggtggagggggttcatttggtcaaagtgccgtgggaaaatatgaactaatcatgatcaacctaaactaa

SEQ ID NO: 12285 - DNA, 147 bp, Glycine max
  Peptide Sequence Number=SeqID_103970
atggaaacacttgagtacctctgtggaaccagtcttgtatattttaaaaatagtttacgtgttatccttcatcatagcctcttagacttgaaaacggataagaacaaaaattcctcaagtactgttgtgttcactgttgaggcctaa

SEQ ID NO: 12286 - DNA, 255 bp, Glycine max
  Peptide Sequence Number=SeqID_103971
atgagagaaaaagtgtttgaaaagttgaagatatggaaaaccggtagtggatctgagtctgtctgcaagaagttaaaaagcgagggaagacctcgatatgcgacacgtggcaatgtagaaaaggaaatacggcgcgattcgttgttgcactggattgatagcctgaaggaaggaaatgcaagcaatggaaagaaactagactttagaagcgtgagacttgacgtgatgcaaaatcacgttgatgcttacctatga

SEQ ID NO: 12287 - DNA, 1764 bp, Glycine max
  Peptide Sequence Number=SeqID_103972
atgtcaatggtatcagagggaagccaagattggaggtgcatgaagcagttacccagattgagtgagatgagttcagcggatcatgactccgaccctcccatccgactcgacttgcctccgctctcaccgagcctcttcgattccgaaccatcatcggagctccaacaacaatccaacggatccgccgcccgaccctcctcctacccctccagccccactagtagcggttacgccgccgaaaggggcagtagcagcaccgcctcaagcatctcccaggtcgatgacgtcctccaccacgaaattcaagagatcaccatccacgattcccaacctcaacctccctctcactcctcctggcttcccggaaaacgacacgccgatgaggatgatgcttccatttcatggaggaaaaggaagaagcatttttttgttctgagtaattctggcaaaccaatatattctaggtatggagacgaacacaagcttgctggtttttcagcaactttgcaagcaatcatttcctttgtggagaatgggggtgaccatgtcaaattagtgagggctggaaagcatcaggtggtttttcttgtaaaaggaccaatttacttggtctgcatcagctgcacagaagagccttatgagtcactaagggggcagttggagcttatttatggccagatgattgttatactaacaaagtcagtaaacagatgttttgagaagaatccaaagtttgatatgacacccttgcttggtggaacagacattgtcttctcttcactaatccactcttttagttggaatccagctacatttcttcatgcctatacttgtctacctcttgcatatgcaaccaggcaagctgccggtgctatcttgcaggacgttgctgattctggtgttctgtttgctattctgatgtgcagacacaaggttatcagtctagttggtgctcagaaagcctctcttcatccagatgatatgctgctcctggccaactttgttatgtcatcagaatcctttaggcaagcagaactgacactattttatctttcagatagcttctcagagatggacttcagaagcattttctcccgtgtgcttgccaagatacaatggtttggcatttttgatgacacatacttgatgttgctgaccactagttctgatgcattttaccatcttaaggattgcaggattcgtattgaaacggtacttttgaagtcaaatgtccttagtgaagttcagagatccttgctagatggtgggatgcatgttgaggatgtaccgcccttacctagttctggatcatctcctcatttgagccagcataggcttccatcagattctcctgaaagggaacctaattgtcacattggtggtgttgctgggttgtggcatttcatatatcgcagcatttatctggatcaatatatatcttcagagttctcatcaccgattaacactcctaagcagcagaaaagcaatataacctgtctccgttgttacagactgtatagagcttaccagaaactttttgcatccatgcatgataaaggaattgggccacacaaaacccagtttagaagggatgaaaactacgttctgctctgttgggtaacacaggattttgagctttatgctgcatttgatccccttgcagacaaggccttggcaataaagacgtgcaatcgggtgtgtcagtgggtaaaagatgtggaaaatgaaatatttttgctgggagctagccccttttcatggtga

SEQ ID NO: 12288 - DNA, 828 bp, Glycine max
  Peptide Sequence Number=SeqID_103973
atgtcccctacgcatgctttacatgtccatatttgccagagatgtgcacttttctcaattgtgtatttatgcagctcttattcatgcatgagaccattgcatgatctgaagaaaaagccgaagtatttagttacattcactgttggttatgaacagaggcataatatcaatgctgcagtgaaaaagttttctgatgattttgcaattttgctctttcattatgatggtcggactagtgaatgggatcaatttgagtggtcaaggagtgcaatccatgtcagcgcaaggaaacaaactaaatggtggtatgctaaaagatttttgcaccctgatatagtatcagcttatgaatatatttttatttgggatgaagatcttggagtagaacacttcaatgcagacaagtatattcatttagtgaaaaaatatggtttggagatctctcaacctggtcttgagcctaataatggattgacatgggagatgacaaaaaggaggggtgacaaagaagttcacatggtgacagaagagaaaccaggctggtgtagtgatccacatttgcctccttgtgctgcgtatgctctctctcttccaccctggttcaaagttgaattgatatttgtggaaattatggcacctgtcttttctcgtgaggcttggcgttgtgtgtggcacatgattcagaacgatctagtgcatggatggggattggactttgctctcagaagatgtgtagagccagcacatgaaaaaattggtgtaattgattcacaatggattgttcatcaagtaattccttctcttgggaaccaggttagacatcactag

SEQ ID NO: 12289 - DNA, 336 bp, Glycine max
  Peptide Sequence Number=SeqID_103974
atggatttgtgcgtgaggattgctgttacggttaaaaagatggtgattccattattattgttaaagggttttgggggtgactgcgatggtggttgggaaagaagaaagtgtggggcctgtaacaacagctgctatccatgctgtgataagtgtccctgggctccattgtttccacccggcccaaagggaactgcagactttcaagttgtaagagacattttcggaggcccaaaaaatacttactccttaattgcaaaggtgaaggaaaaacaatttcgacctgaagttgtatattatgtgaaaagggagcaatccagagggagatgctataagtga

SEQ ID NO: 12290 - DNA, 2100 bp, Glycine max
  Peptide Sequence Number=SeqID_103975
atggcaagtagtggtgctgctgctacatcggcgtcgcagagtgatggaattagtagtagaatggaaggctggttgtaccttataagattcaaccgtattggacttcagttctcgcggaagcgttacttcgttctcgacggtaaccttcttcgcagcttcaaatccgttcctgatcctgttagaagcgcgattgtagattcctgcattcgagtcatggataatggaagagagagcgttaacagaaaagtgttcttcatattcactctctataatactttgaatcacaatgatcagttaaagtttggagcaagccgtcctgaggaagcagcgaggtggattcagtcctttcatgaagcatcgttaaagggtgcgcctgatggaggagatgatactgtaggttgttctaagaggagatggcaatcctttagactcagtggatcttccagtagtagaagtcacccaaattctgtagactggactctttcttctgctgatgttattgccccttcaccatggacaatctttggctgccaaaatggtttacgactattcaaggaagcaaaagacagggattctagtgggaagaaatgggatgatcaccctgcaataatggctgttggtgtggttgatggaacttcagaagccatcttccagactcttatgtcgcttggtccttcaagatcagagggaatgaaacgaagagatctcttgttgcggcgttattggaggagagaagatgatggaacttatgttattctttaccattccatgtttcacaagaagtgccctccccagaaaggctatgtgcgtgcttgccttaaaaggtatgttatatcaccagtgaacaaaggaaagcaatcagttgtaaagcatatgcttgctattgattggaaatgctggagattatatcttaaatcttcatcagcacattccataaccattcaaatgcttgggagagttgctgcattacgggaattatttaaagctaaactaggaaattgttcttcatctgattattcatctggagagttgacgagaaacagagagcttcatataaaggaagaacacatcataaattctgatactgaaattcaagcagatgagaacaatcatgatatttcagttggagaagtagatcaaacgcaatcagaacatgcaagccttgttactctaaatgatgctgatgatgagttctatgatgttccggagccatcagactgtgacgtgtcagaaaatggatggatgactgaatgtagccaccagaagtctcaggagattcgtcatcagaagttatcaactgctgccaactttgtgaaaagattgcatgatcttgcagttcagaagaggggttatgttgacttgcaagaaatggtcagggaggacagtatcacatgctcgtatggatccactcttccacaagattctacttgtacattaccatgtagtttgacagaaacagatccttctactttcctgatacgtggagaaaattatcttgaagaccgcctgaaggttaaagcaaagggaaccttgatgaaaatggttgctgcagattgggtgagatctgacaaaagggaagatgaccttggtggccgtcctgggagcattgtgcagaaatatgcagcacagggagggcctgagttctttttcattgtaaacattcaggttccaggttctactacatatagcctagcactatactatatgatgaatactcccgtggaagatgctcctttgctagagagttttatcaagggtgatgatgccttcagaaattccagatttaaacttataccatacatatctaagggttcatggatagtaaagcagagtgtgggaaagaaggcatgcctagttggtcaagcactggaaatcaattatttccagggaagtaactatttggagcttggagttgatattggatcatcaactgtcgcaagaggtgttgtgagtcttgtccttgggtacctcaaccatctggttatagagatggcatttttaatacagggaaacacacgtgaagagctccctgaatttctccttggaacttgccgccttaaccatctggatgcctctaaagctgtttgtctgatgccatga

SEQ ID NO: 12291 - DNA, 2148 bp, Glycine max
  Peptide Sequence Number=SeqID_103976
atgtggaacccgccaaaattggtgatttgcaataaatttcaatcaatcaaagaaagagtgttagagagagtgtcactagccactcctcttgcattcagaaattatcatgataccggttctccaaaagcatctggaccatcaaacagggcatattcctgtacaggagttgcacgagaggttgaattgttcaaaaaagatatgtccaaaagtattaaagaaattcagaagaagtgtgaaaagaagctgaagaagctacatattttgcaagaagaagagaagcaaaggttgagagcagctattgaggaagaaaaggctaaatttgaggaaaggtacaaaatagagtctgctgttattcgatcctgctctcccaatgatgttacaagaatggaaaagctcagagttttgaatactgaatatgaaaaaggaattgaagaactaaaatttcaccatgattcatgtctcaaggatcttgaggacaagcaattagctgaaatacagaagtttcaagataaggaggccgcttgggtagaagatgtgaaatcttgggccgacaatgaatatctaagcataattgcttcaaaggaacttggaactggggttgaatccttgcagacttgtgatcaagtactgcctgacagtggtctaaaaaatcatttggctggtactgctgcgaatcctccttcatccatggaacaaaaatctgatggaggtgctgtaaatgaactttcagatagagaattaagactgagtaatggtccagataacaatacccttttgagtccacagaaccaaaattctgggggcccattagatgtccaaggtttagatagagttttatcaccaagggcttgtcaagctgctagttcaagtgatggtccgaatacaatttccattccaaatccacttttggagcaacaaactaccaacggagtccctttgagtattccagcagcagttgattgtcatgatgatatagagcatttaacaaatgctgtgttgggggataaaagaaccacatcaaaccagcaggaaggagcacctaaaaccatgacagaattgtcccaggggactccagtatctagaacagttaatgtcatggatcctccagaacaagtgcagcatttatctgtggagtcctctcctcaccatgatatatctggggaaatgttgcattcttccagacaacctgaactgttatctagtgcagttgatgttgcacccgctgatcaatccaatcatgtttcactgatcgtgaagcctgtggagcaggtgcaacaagtatcatctgcagagctcccttcttcccatctggattcaactaatttacctttcacaaccgaacttgaacatcagccaactgtggttccaaatcaagacgtgcaacctgattcaaatttggaagttgattcacattctcattcacatgaagtttttgtgcaccctgcctcaaattcagaccctaatacagttacacctagtgaagtaagagtgcaatctgcagacacaacaaatttgtcgactcctttggagataaattatcaaaatatgcaagctgaaacccattcatcttccagaatggtgcatttaagctatgatccgctcaacaatgaattggatagaatacaaaaagtaacagaacaagcagtgaaaaactatgaagataggaaatcgcagttgaaaactgattttgaaaaggaattagaggaactccgtaggaagtacgatgttaaatttcaaggaattgaagttgaatttaaacaaagaaagacgactctggatacaaatcgtaatgtagttcatatgaataagttcttggcagctgcttttaggtctaaatgctcgactcttaaaccatcttgtacatcaggaatgctgccaggtttcgcacagcagcagttgcttcagccttcaaaacaacaaagtactagttggcgttccctgcttgctggttcttcttcctccaccacgactagctctcagcatatggtaacacctatacgggctggttacagtgcatcaggattttcccataatgtttctgcaagatcaccaattattgacaccatttctttgccagttggaaatcctcaagctggtgtaggtcagatacgagcacctgcaccacatctccagccttatagacaatga

SEQ ID NO: 12292 - DNA, 342 bp, Glycine max
  Peptide Sequence Number=SeqID_103977
atggtgcatgaaactccatcaggacaatctgctgtgattggaatgctctacaagattggaagtccagattctttcttgtcatcggccatttctgatacaacggaagcagaaagagtggtgggtgtagttgaccctaggcagataaaaatattctacaagcagtattacaggtatataggttcactgacaattcctccttgcaccgagaatgtttcttggaccatcattagaaagaagaagctgcaagaagatagtgaggcctgcaaccttgtgggtgatactccttatgatgtttatcgtatcaatgtgcttggccagagacaagaagaccttcacggatga

SEQ ID NO: 12293 - DNA, 1450 bp, Glycine max
  Peptide Sequence Number=SeqID_103978
gcctgaatctcacgtagcacaacaaattaggcgtgaaaaactgagaatccagaacagttatcagccttcacacgaattccctaacaatcttgaacagttatctttacacccggggtttaacaacttggaccttgttcaagttaggaatgttagaaatgctaacatgcttgatgaactagctgtttattcatcagaaatgccaaacttttctacctcttcgtctgctgcaaggaacgcgttggagtatcaccaagaacaaggtgctgcagctgaacccagtaataggctgctgctgatgaatcagtatggttcatttccccattccatgtctgcaattcattcttcccataaacaacagtgtgagcttcgtaatttgggaaattggaggaacagtaccccccatcaaggatctgattggtttgtaaactatgcaagcaatgccaattcttttttgtctgctgagctcaacaacaatgtgtctgcttacaatgaacttatggatgtacattgtagcaatgcatctggtgaaatcagtggtagagaaatgcataagcaaggtgtactgcatcataattctcctccttcatctccactttatcaaaatgctttgcaagatattgtgaagtctgcttctttcagtgctcacactaggcaagacatggcttcactgatgcaacaaaatgaacatagcatttgggtggggaatgctagtgaagctgagcttcaacaaccaagttatgaaagccagccaaatcatgagttgcgttttgggtggacaaatcgaacaattgcttgtgattcacttcctcagagcttgtccttgtcactttcatcaaatgcacaacctaagccttcagtttctcacctagaacaagggtctgcgtctgatgatcctcagtgtttgaagcatatgaaatctattgtttctagagattgtgggaaatcagttcaagatcaggtggaaataccttcaaagagtactactactattacttatcgaagtgtgggtccccttggccctttcactgggtatgctactattctcaagagttcaaggttcttaaagtctgctcaacaattgttggatgagatttgctgtctatctgatgcaaaatttggaaaatcatacgatgtttcaaagagggtttctccagaagttagtgcttctacttctgctgatactgtcactggggttgctgcaaaaggtagtaattcaggttcttcatcaaccacgttgtataatgtttcaaaggaaaatagggccgatccgggagttggaagtagctttggtctttcctcgcggtcagattatcaacataagaaagcaaagctactgtacatgcaagaggagactttatgtgtctccttagaacttgctttgcataatggcattgattcttcatctcactggtacatccaagttgttggtttctccacacagttagagtag

SEQ ID NO: 12294 - DNA, 387 bp, Glycine max
  Peptide Sequence Number=SeqID_103979
atggaaaggtgggatttggtgctctatctttgtagttgcaacattgatgatcaagttggcatcctaagcaacaactacgtctggtcaagtggaggcaacaattgccgaggtgttcttggtcactgtgaagttgttagaaagcgtaagattgatgcaaatcggaggtgtttgatcacggtggcggtgagaatgcacaacggcatggacgaaggtgcaaggccaaagggttgtgcggtgttgcagcggcgtggcgatcaggagcagcgcatgtggcagttgggatgctgttgcagcaacattggagtcgctggttcatatctggattgggttgaatggggcgagaagaagctgaagggtctcacatttgtagggataaaaaacaaatag

SEQ ID NO: 12295 - DNA, 354 bp, Glycine max
  Peptide Sequence Number=SeqID_103980
atgttggagcttttgtccggggaagagccgttgaagttcaagtgtgacgagaaaacgcgcgaatttgtgaggatgtcggtgattgatgcggcgagggccgccgtggacggcgacgagggtagcgtggaggggaagctgaggaggtgggtggatcggagactgaaagattcttttcctgtcgacgttgctgagaagttgacacgtgtcgcgctggagtgcgtacacgtggatccagataagagaccgaacatgggacgcgtggctggaaagatctcaaagttttatttgacgtcgaggatctggtcagatagtattaagatgcctgatattactgttacgttgggacctcgatga

SEQ ID NO: 12296 - DNA, 435 bp, Glycine max
  Peptide Sequence Number=SeqID_103981
atggccaacttcagtgtcagaaacagcagcagcagcagcagcaaaaagaagagcgtagtaggaggcattgtgaagttcaaattcgtcgttgagaagctccaaaagagactcctaatggggagaaacaaagaagggtgtgattcttctttaaactcaagctatgtgccagaggacgtgaaggaaggacacttcgcagtgattgcggagggtggagaggaacaaaagaggttcgtgctgccactaagctgtttaaccaacccaacgattttgaagctattggagcaagctgaagaagagtatggctttgatcatggaggtgcagtaaccattccttgcaggccttgtgaacttgagagtatacttgctcaccaatggcatacccaaactactactactggaccaaggtggacttgtagaaaatccatggtattttga

SEQ ID NO: 12297 - DNA, 2667 bp, Glycine max
  Peptide Sequence Number=SeqID_103982
atggaagaaatacagtctcaatcagataattatagatcttcgtcatcgtcggcaagcagcccggcaagtagggtgccatcaagtaactttttctacctgcgtaaacctggttcacttaggcagcccatctcttttgaggattcacctgagtgggaggatactgatattgatgttagagttgaggaaggaggtgactctattaatgtcgcaacaacaccagcttctccctctctttcaaagctcaacagtgggtccctgccgtctccacgtctaccggagggtgcagttattccgcggaaaattgctggggcttcagttgcctggaaagatttgaccataacgataaagggaaaaaggaagtactctgataaggttattaagagttcaactggttatgcgttacctgggaccatgaccgtaattatggggcctgctaaatcagggaaatctaccttattacgagccattgcaggaagattgcatccttctgccaggatgtatggtgaagtatttgtgaacggagcaaaatcacaaatgccctatgggtcatattgctattgcattgtggaattccttggaactgcaatcgcaactccatccgctattgtggctgatatgggtgttgtgggttatgtggagagagaaactactctgattggatccctcactgtgcgggagtttctgtattattcagctcttcttcagcttcctggtttcttttgtcagaaaaagagtgtggtagaggatgctatacatgcaatgtctttaggtgatcatgcaaataaacttataggtggacattgttatatgaaaggacttcctagtggggagagaaggcttgttagcattgccagggagcttgtgatgagaccgcatattttatttatagatgaacctctttatcatttggacagtgtctcggcacttttaatgatggttacattgaagagacttgcaagtactggttacactctcatagtgaccatctatcagagtagcacagaagtctttggcctttttgaccgcatatgtctactttcaaatggaaataccctcttctttggagaaacattagcttgcttgcagcacttctcaaatgctggatttccttgcccaatcatgcaaagtccttctgatcactttctacgtgcaattaatactgattttgacaggattattgcaatgtgtaaaaactggcaggatgacaatggagatttttcttctgtgaacatggacactgctgttgctatacgcactctcgaagcaacttataagtcatcagcggatgcagctgctgttgaaactatgattctgaaacttactgagaaggaaggtccagttctcaaaagcaaaggtaaagctagcaatgccactcggatagcagttttgacatggagatctttattagttgtgtcaagggaatggaattattactggctgcatcttactctttacatgcttctcacgctgtgtattggtactgtattttctggtctggggcattctctgtcttctgttgtggtggccatgatgcttccagcaggctattttagagttcgaaatgctttgcctggacccatgtgggtgtatccaatgtcatatatagcctttcatacttactctattcaggggctattggagaatgagtacctaggaacctcctttgcagtggggcaggaattgagaatccgtgtgtgttgcattgttgtcatgcattgcatgcgtgatctcatcctcttcccgcgtaaaacccgattctggtggcgtccttccatgacgacgtcgtttctcaacggcgagagagcggtggtgctgttcttcatctgcagaatcctctattctctccctttctctctcctcttccatggcctcgctctctctctcctctcgctctcctccttcttccttgagatctccttcgattcttccaattccccttctcttttccgcaccaggccaggtgcttcttccggaattctgctcggcgctgtcactctcccttctctttttctctccaaattggtacaattgtcgcggggattctcactcgctcaacttcaacttgaagagattcaatatctgacattgcaatactgggccacatctgccagcgcctgcagcgttattttcctcctcgcctttgctcgacgtcgtgctcctttatccccttttcattggggtgtgaggtttagtttatgctccattttctttcaagctcttgtttctgttgctgccctttctaccacgtctcaaattgggttgcacccagcactgaagctaatgtgggccttttgtcatggcttggcatctgtgaagctaattcagcttttcctcagaacttttccctcttgtgcttccattggggaaacatttttggtgacttccggtattgttctctattttggtgacatgttgttgcttactattaaaaaggggcttgtgcttggtcttctgctatatccaatagctttgaaatatattctccaaatatgggagtggtctataaatacaacttctgctgaagcaagaagatactatgagattgggaaatctcttatgtttgttgcttctcttggaattgtcctgatcatgattgtaccatcatggatgcagtttgtgcatgagtttcaaatgcatccttttttctggtatctcatcaatatctga

SEQ ID NO: 12298 - DNA, 705 bp, Glycine max
  misc_feature (106)..(106): n is a, c, g, or t
  Peptide Sequence Number=SeqID_103983
atgcagctcccggagacggtcacagctttgtctgtaagcggatgccgggagcagacaagcccgtcagggcgcgtcagcgggtgttggcgggtgtcggggctggctnaactatgcggcatcagagcagattgtactgagagtgcaccatatgcggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctctcgcgaaacacggtttggttgataagtatgatctttcgtctctcaagcatattggttctggcgctgctcctcttgggaaagagttgatgaaggagtgtgctaaacgttttcctcatgccattgtttctcagggatatggtatgactgaaacttgtggaattgtttctgtggagaatgcaaggatgggaattcggaatagtggctctacgggaatgcttgtcgccggaatggaggctcaagtagttagtgtggatactctgaagcctctccctcctggacagttgggggagatatgggtacggggccctaatatgatgcaagggagaggttgtggtaacccttcattgaatgaaaattcagaggccagagtgattcagcttgactag

SEQ ID NO: 12299 - DNA, 355 bp, Glycine max
  Peptide Sequence Number=SeqID_103984
atgacgtgtgatggtaatctggggttgttgaatcacaacatcgattttatgatcgtctttgaaggccgacttttctacatcggttgtctagctacaatcgatgtagaatgggtagctttctacaacggttctaaggctgaaatcgatgttgaatgggtaggtctctacatcggttatcagtcaaccgatgtagaaaatgaaaggtctacatctgagttcaatgatatggaaactgcagaaaacaatggtggtatatcaactgtaacaagagaaaacatcaagatacaaggaaaaagagttcagggtgcgcgagctttagggaaagagtttcagggtgcgtttgacagtgcaagag

SEQ ID NO: 12300 - DNA, 1242 bp, Glycine max
  Peptide Sequence Number=SeqID_103985
atggaaaagctccatgcttctgtgctcgcccttgtattccttcttgtcatactatttcaggaaggattggtaacatgtatgaagaatgaagacggatcagaagaatggggatatgtgcaagttagaccaacccacttgttctggtggctttacagaagtccatacagagtggagaatccctccaagccttggccaatcattctctggcttcagggaggaccaggctcttcaggagttgggtttggaaattttggagaggttggtcctttggatgctaatttgaagccacgaaatttcacatggttgagaaaagcagatctcttgtttgtggacaacccagttggaaccgggtacagttacgtggaggattccaatctctatgccaaaacagacgaagaggcaaccacagacttgacaacattgttagttgaattattcaacaatgatgcaagtctccaaaagagtcctctgttcattgtggcagagtcttatggtggcaaatttgctgttgctcttgcattatcggctctcaaagctattcaacacggaacattgaagcttacacttggaggtgtggtattaggagacacctggatctccccagaagattttgtgttttcatggggtcctctgcttaaagacctatctagaattgacgacaatggactgcaaaaagcaaacagtatagctgagaggatcaagcagcaacttgaggcaggtcaatttgttgatgcaacttactcatgggctgatcttgagaatgagattgtcgctagcagcaacaatgtgatgcttagatctccaaatttcatgttggagatgtatagttctcagcttcagagggatgctggaaatcctacatggactattgatttctataattttctacaagattcaaaaagtgattcggacaccttaaacgcaatggagctgggattattcaaagaagtatcaatgatgcgatactccaagtatcttagttcaaagacttcatatcttggcagtgaggatgatgatcttgaaagattactaaatggtgtcataaggaagaagttgaagatcattcctgagaatgttacgtatgcagtgcagtccttggatgctttcgaaagtctagtacctgattttatgaagccaagaattagtgaggttgatgagctgctggctcttggggtcaacgtgactgtgtacagtgggcaagtaagtgtccctttccccaacattgatggcaggagactctaa

SEQ ID NO: 12301 - DNA, 1236 bp, Glycine max
  Peptide Sequence Number=SeqID_103986
atgatttcaagggccacatctagcttcccaagtgtccaccaccaagggcttcagatgttccctgacccggaaggttttgtgtcaccctctgaggaatcaggatcatcaggtactacttcacactctagttccctcctctttaatctctctattctgaaggacaagcttagtgaggtgcagaccctggtaggtgttattctctcgccaaatcaaagccttcccgagccaacttccatggccatatccagcatgaactccattatccaagaaatcatagtcactgccacatcaatgatgttcacctgccaacagatggctctcactacccctccaggtactactaacaaattgcaccagcagaacaagtcgttgttgcctcactcaaataataattctggcacaaatacaagtgtactaattggtaacaacataggctcagataatattagtgaccatcagggtttgttttctagtactgagtcagagacacttgactggtttagtactgaaagctataacaataacattgataatagcaatagcaatattagtaaggttgcaaatatcagtagtgaaaacaatattattagtagaggaagggatgaacatgaacctaatgaagaagaagggtactatagaggggtttcaccgaagatgaatagtgatataattgaattggatgctgcgaatttgttggctaagtacactcactattgccaagtttgtggcaaagggttcgagcgtgatgcgaatttgaggatgcacatgagggctcatggggatgagtacaagaccaatgctgctttgagtaacccaattaagaacaaagggaacttattggaagggggaagagagtgtttgatgagtactgtgaagccaaagtattcgtgtcctcaagaagggtgcaggtggaaccagagacatgtcaagtttcagcctttgaagtcaatgatttgtgccaagaaccattacaagagaagccattgccccaaaatgtacgtgtgcaagaggtgcaaccagaagcaattctcggtgctctctgatctgaggacacatgagaagcactgtggggatctcaagtggcagtgcacgtgtggaacctcgttttctagaaaagacaagcttatgggtcatgtggctttgttcgtggggcaccaaccagcagcagctatcaacaatagtaatgctctctctttctcggccaaattagagcagcagcacacattgcaaatgtag

SEQ ID NO: 12302 - DNA, 831 bp, Glycine max
  Peptide Sequence Number=SeqID_103987
atggacaaccaacgtagccctcttctaagttgggcttactacttccagggaaagtcaatggaggagctgaggcagtccctgatatacacaactctggagctagaacaaacaagggttgcagtgcaagaagagcttaaaaagagggatgaacaactactcaacctaaaggacctcctgagcaaaaccataagagagagagatgaggcacaagagaaatgccagagacttctcttggagaagctagttttccaacagcagctacaacatgcagctcctgtgtctggaatttcaagcattgaggatgagccgagaagaggaattgactccaacaatggtcattcatcatcagattgtgaagaaagcatcgtttcctctccagtcattgaccatttacctcaacctcaaccacaatcaatgattgaactaacaccagacaaaccattaccagaaaagggtaagcttttgcaagcagtgatgaaagctggtcctctccttcagacccttctccttgcaggacctcttcctcaatggagacaccctcctccaccacttgagtcctttgagattccacctgtcaccattccctcaccaccaccaccaccactacaactactccaccaagacactttttttaacaaaaccaacggtagcagcagtaccacaaccaactgtggaagactcagtagaaaaagggtcttctgtgatggctctgattctcctaccgagaccaagtaccaaaggcttatcgcatcaacaattaagagaatgggtgtggagtgggtggattgggagatgatgagtgtgaccaacgaccaaagggaaggtctttga

SEQ ID NO: 12303 - DNA, 849 bp, Glycine max
  Peptide Sequence Number=SeqID_103988
atgagaggtagcaaccacttgatcggtttgttaaacttcttgacttttttgctgtcagttccaatccttgtgtgtgggatatggctgagcaccagagctaacaacacagaatgcctcaagttccttcagtggccgttaatcgtcataggaatcagcgtcatggttacatccttagccggtttggtcggagcctgttaccggaacagcttcctcatgagcctctacctcgttgtcatgctcttcatactcttggtcctcgttggcttcatcgtctttgcatatgctgtcacagccaagggttccgggagggagacactgaaccgcgcttacttggagtattacctgcaggactacgatggttggttgaagaaacgcgtggaaagtgatggctattggagaaagataaggtcttgtgttagggactctagggtttgtgggaagattgggagaaccgttgatggggtgcctgaaactgctgatatgttctacctcaggaagctctctcctattcagtctggatgctgcaagccccagagagagtgtgggtatgtgtatgagaacgagacggtgtggaggccaagagaaggagtggtggtgggaagcaacccagactgcactaggtggagcaatgaccaacacttgctttgctatgactgtgactcatgcaaggctggtgtgttggctactctaaagaaaagttggaggaaggtttccgtcattaatattcctgtcttggtaacccttgtggttctttacatcattgcttatgctgcgtataagaacaaccgcaggataaataactgcgaaccatgtggtcaaacaaggatgacaacattacaacctaagtag

SEQ ID NO: 12304 - DNA, 2649 bp, Glycine max
  Peptide Sequence Number=SeqID_103989
atggaaaagctttgtgaatttttggccactcttgtgttccttggtatattgtttcatggagaaatggtatctgctttgaggactaaagatggatcagaagaatggggctatgtacaagtcagacccaaagctcacatgttttggtggctatacagaagcccctacagagtggacagtccatccaagccatggccaattattctctggttgcagggaggacctggatcttcaggagttgggtttggaaactttaaagagattggtcctttggatgctaatttgaagccaaggaatttcacatggttgaggaaagcagatctgctatttgtggacaatccagttggaactggctacagttttgtggaggattctaggctcttagttaaaacagataaggaagcagccactgacttgactacattgataactaagttgttcaacagtgatcatagcctccaaaagagtcctctcttcattgtggcagagtcttacggtggaaaatttgctgtcactcttggattatctgttaccaaagctattcaaaaaagaaaattaaagcttaaactcggaggtgtggtgttaggagacagctggatctcccctgaagattttgtggcaaacctctcaagacttgacgacaaggggctgcaaatatcaaacagtatcgctgagaggatcaagcaacaacttaaggctggtcaatttgttaatgcaaccaattcatggagtgaacttgaatatgtaattagcattaacagcaactctgtggatttctataattttctgctggattctggaagtgattcagcaaccgtatccagaatgaagctgaaattattcaaagaaatatcaatgaggcgatactccaagcatcttacttcaactagatattctcctggtgttagtggtgatctttacagcttattaaatggtgtcataacgaagaagttgaagatcattcctgaaaaaattagatggtttgagcaatcagataatgttttcacaaatcttgaaggcgattttatgaagccaagaattgctgaggttgataagctcctagctcttggggtcaatgtgactgtgtacaatggacaagaggaagaatttgttatgcagttgaacaagcgggtgacggaagtaaagggtctttttgttcaagaggcaagcgttttgcaaaaactagagttggctgattggatccaaaagctaggccttgccaactactttcaaaaggatatcaacgagtttctcgaatctatacttgtctatgtcaaaaacagcaacattaatcctagcatagaacatagtttacatgtatctgcactatgcttcaggcttttaagacaacatggatatccagttttgcctgatactttaagcaactttttagatgaaaaaggtaaagtgataaggaaaagctcatatgtttgctatggtaaagatgttgtggagcttcttgaggcctcacatttgagcttagaaggagaaaagatcttggatgaggccaaaaattgtgccataaattctctcaagtttggtttctctcccagttccatcaacatcaaccgacactccaatctggttgttgaaaaaatggtccatgccttggagcttccatcccattggagagtacagtggtttgaggtcaaatggcacgtggagcaatacaaacagcagaaaaatgtggatccaattttacttgaattgactaaattaaatttcaatatgattcaggccaaacttcaaatcgaggtcaaggatttatccaggtggtgggagaatcttggcataaaaaaagagttgagctttgcaaggaataggttggttgaaagcttcatgtgtgcagcaggagttgcttttgagccaaagtataaagccgtcagaaaatggctcactaaagttattatttttgtactaataatcgatgatgtttatgacatacacgcctcatttgaagagttgaagccgttcacattggcatttgagagatgggacgacaaagaacttgaagaacttccacaatacatgaaaatttgcgtccacgcacttaaagatgtcacaaatgaaattgcttatgaaattggtggagaaaataactttcactcggtgttaccttatctaaagaaagcgtggatagacttttgcaaagcattatacgtggaagcaaagtggtacaacaagggatacattccatcgttggaagagtatttaagcaatgcttggatttcatcttcgggaccagtgattcttctcctttcatattttgctacaatgaatcaagcaatggatatagacgattttctacacacatatgaagatttggtctacaatgtatctctcataattagattgtgcaatgatttagggaccacagcggctgaaagagaaaagggtgatgttgcttcgtcgatcctatgctacatgaatcaaaaggatgcttcagaggaaaaagcaagaaagcacatccaagacatgatacacaaagcatggaaaaagataaatggacattattgctccaatagagttgcttcagtggagccatttcttactcaagctataaatgcagctcgtgtggcccataccctttatcaaaatggcgatggctttggtatccaagaccgagatatcaagaaacatatcttatcactg

SEQ ID NO: 12305 - DNA, 1641 bp, Glycine max
  Peptide Sequence Number=SeqID_103990
atggcggaggaccggagtgaggcgagtgattacagttcggaggacgaaggaaccgaagattacaggcgtggagggtaccatgcggttcggattggtgacactttcaagaatgggagctatgtggtgcagagcaagcttggttggggtcatttttccactgtttggctcgcttgggacactcacaaatcgcgatttgttgccttaaaaattcaaaagagtgctcagcattacactgaagcggcaatggatgaaataaagattcttaaacaaattgctgacggggatccagatgacaagaaatgtgttgtaaagcttttggatcactttaagcattcaggacctaatggccaacatgtttgtatggtttttgaattccttggggataatcttctcacacttatcaagtatagtgattatcgaggggttccccttcccatggtcaaggaaatttgtttccatattttggtgggtttggattacttgcatcgtgagctttctgtaatacacactgatttgaagcctgagaatgtcttgcttttgtctccaatcgatccatctaaggatcctagaaaattaggcattccacttatccttccaaacacgaaggataagactgtgaccaagaatggggcaacaatagcaaataaaagtttgaatggagatctgaccaagaatcagaaaaagaaattgcggaaaaaggctaaaaaggctgctcaaagctgtgctgggagggaaaatgctgaggaagctgaggaggattccaaagcatctgatgagcaagatgattgtagtaatgatgtgaaacctagtgtagaatctggtgaagttaaacctaatagtcctgtgaggaaagatgaatcaacaaagacttctgaaaataaagatattccacaaggaagtcatggtaataggagaggtagccgctctacaagaaagaagttgcttgcagctgttgatcttaagtgcaagctggttgattttggtaatgcttgttggacctataaacaattcacaaatgatattcagacaaggcagtataggtgtcctgaggtacttcttggatctaaatattcaactccagcagatctgtggtcctttgcttgcatttgctttgagcttgcatctggtgatgttctttttgatcctcatagtggtgacaactatgatagggatgaggatcatctggcattgatgatggagcttcttgggatgatgcctcgcaagattgcacttggtggacgctattcccgagatttttttaatagatatggcgatttgaggcacattcgtcggttgcgtttctggcctcttaataaggtgctgacggagaagtatgatttcagtgaacaagaagcaaataacatgaccgacttccttcttccattacttgattttgtccctgaaaagaggccaactgctgctcaatgccttcagcatccttggttcagtgcaggtcccttcactctcgagccctcattgactgctgtgaagcaagatgatgctattgaaggggaaatatttgaaaaaatgcagagggaaaaggctgagcaggaggctgtggaagttggcatggggaatatggccatagatggaaatccaaagccactcaaagagttccaatctatgaagccatcagaatag

SEQ ID NO: 12306 - DNA, 2766 bp, Glycine max
  Peptide Sequence Number=SeqID_103991
atggaagctgtttctcttatatctgccccaaagtatcctgaaaaacaggttgggtacattgtaacatcaagtttgcttaatgaaaatcatgactttctcaggttggctataaatacagtgcgcaatgatatcattggtcgtaatgaaaccttccagtgtctagcattgactatggttggaaatattggtgggagagaatttgctgagtccttagcacctgatgtacagaagttgttgatatcgagcagctgcagaccacttgttagaaaaaaagccgcattgtgtttgctgcgactgtacaggaaaaatcctgatgttgtcaatgtagatggatgggcggatcggatggcacaacttctggatgaacgagaccttggtgttttgacatcttctatgagtcttcttgttgcattagtatcaaacaaccatgaggcatattggagttgtcttcctaagtgtatcaaaattttagaacggcttgctaggaaccaggatatcccacaagaatacacttactacggtatcccatctccctggcttcaggtcaaaacaatgagggctcttcaatattttcctaccattgaagatcctaatgcaagaaggtcattgtttgaggtcttacaaaggatactgatggggactgatgttgtaaaaaatgtgaacaaaaataatgcatcccatgccgttctttttgaagctcttgctctggtgatgcatcttgatgctgaaaaagagatgatgtctcaatgtgtggctcttcttggaaaatttattgctgtccgtgaaccaaacattcgatatcttggcttggagaatatgacaagaatgttgatggttactgatgtacaagatatcattaaaagacatcaagctcagattattacctcattgaaggatcctgacatcagtattcggaggcgtgctctagatttgctttatggcatgtgtgatgtttcaaatgcaaaggatatagttgaagaactactgcagtatctcagcacagcggagtttgcaatgcgtgaggaattgtcacttaaagcagctattcttgctgagaagtttgcaccagacctttcatggtatgttgacgtgattcttcaattaattgacaaggccggagattttgttagcgatgacatatggtttcgggtggttcagtttgttacaaacaatgaagacttacagccttatgctgcagcaaaagctcgagaatatcttgacaaacctgctatacatgagacaatggttaaggtcagtgcatatatacttggagagtttggacaccttctagcaagacgacctggatgcagtccgaaggaactatttagcattatacatgagaagcttcctactgttcttctaatccatttgctcatctttagatatgaaagctcaattgaagtcgaaatacagcaaagatctgttgaatattttgcattgagtagaaaaggtgcagctctaatggatatattggccgaaatgcctaaattccctgaacgacagtctgcattgatcaaaaaggctgaagacactgaagtcgatacagcggaactaagtgctataaagttacgagctcagcagcaatcccaaacatcaaatgctttggttgtaacaggccaaagtcatgctaatggaactccacctgttggccaacttagccttgtaaaggtgcccagcatgagtagcaatgcggatgaggcagatcaaagattatcccaggaaaatgggactttgagtaaagtagattctcaacctccctctgcagatctccttggtgatctcttgggtccacttgctattgaaggccctcccggtatcagtgtccaccctcagccaagctccaattcaggattggaaggaactgtagttgaagccacggccatagtacctgctggagaacaggccaattctgtgcagccaattggaaatattgctgaaagatttcatgctttgtgcatgaaggatagtggtgttctatatgaggatccttatattcagattggcattaaagcagaatggagagctcatcaagggcatcttgttcttttcttgggaaacaagaatacttctcctcttgtctctgttcaagctttaatattgcatcccacgcatttgaagatggagctgtctctagtaccagaaactatacctccccgggcacaagtgcaatgcccacttgaggtcattaatctccacccaagcagggatgttgccgttcttgacttctcctacaagtttggtaacaatatggtcaatgtcaagcttcgcctacctgctgtcctaaataaatttcttcagcctataactatatctgctgaagagtttttccctcaatggagatcacttcctggaccacctttgaaacttcaagaagtggttagaggtgttagaccacttccactgctcgaaatggcaaacttattcaacagtttccatttgacagtttgcccagggcttgatcccaatccaaacaatcttgttgcaagtacaacattttattcagaaagtacaagggcaatgctttgtttagcaagaattgaaacagacccagcagaccgaacccagctgcgaatgacggttgcttcaggggacccaacactaacatttgagctgaaggagttcatcaaggaccaattagtcagcattcccaccgcagcaacccatgtaccaacacaaccagctccaacatctccaccagtggcccaaccaggcagtgctcccacagcattgacggatcctggggcaatgctggctgctcttttatga

SEQ ID NO: 12307 - DNA, 897 bp, Glycine max
  Peptide Sequence Number=SeqID_103992
atgattttgcgacttttgtcgtgtcctggccttggatgtctacaattgacaagatcaattaagccactcgaaggcctcgtcaaaatcgcagatctggtcaagtactgttccgaaaacaacaagcgtctcattcatttctctacgtctgaagtctatgggaaaaccattggaagcttcctccccaaagatagtcctcttcgtcaggatcctgcatactacgtacttaaggaggatgaatctccttgtatttttggttcaattgaaaagcagagatggtcctatgcatgtgctaagcagttgattgagaggcttgtttatgctgagggtgctgaaaatggcttggaattcacaattgtgagaccttttaattggattggaccacgaatggatttcattcccggcattgatggtccaagtgagggtgttcctcgggttctggcatgctttagcaataatctcctccgcggagagcccctcaagcttgtggatggtggtcaatcccagaggacttttgtgtatattaaggatgctattgaagccgtcttattgatgattgaaaatcctgccagggccaatggacatatttttaatgttggaaacccaaacaatgaggttacagttaggcagcttgctgaaatgatgacacaggtttattcaaaggttagcggagaagcacctctggaaaaacctactattgatgtgagttccaaagaattttatggtgagggatatgatgatagtgacaagagaattcctgacatgaccataattaataggcagcttggctggaatcctaaaacctcactttgggacctgcttgaatccactctcacctatcagcacaggacttatgctgaagccattaagaaagtcattgcaaagccagtggcaagttaa

SEQ ID NO: 12308 - DNA, 846 bp, Glycine max
  Peptide Sequence Number=SeqID_103993
atgatcacagttgtaaccatcatcaggatgttgtcatcaactgccaccattgtcgctgtcggcagttgtggtggcaacaacgatggtcatgacagcaaaggaaacacatcaaaagggccagaaaaggattattctttaaaaggtgatacaacaaatcgcttatttggaatctttaatgccattgccatcattgccacaacttatggcaatggaatagttccagaaattcaggcaacattagcacctccggtaaaagggaagatgttcaagggactatgtgtttgttatgctgtacttatcttcactttctttagcgtagccatctctggctattgggcgtttggaaatcaagctgcgggactcattttaagcaacttcgtggataatgggaagcctttggttcccaagtggtttatttatatgaccaacattttcacaataacccaactatcagctgttggtgtggtgtacttgcagcctacaaatgtagtactagagcaaacatttggagacccagaaagccctgagttttctcctcgcaatgtaattccaagactgatttctcggtcattagctataattaccgcagctactatagcagcaatgctgcccttttttggggacataaactcgcttataggagcatttggctttatgccacttgacttcattttgccagtggttttcttcaacgtgacatttaagccatccaagcgaagtctcatttactggttgaatgtaactattgctgttgctttctctgcattgggagctatatcagcagttgcagcagttaggcagatagttcttgatgccaaaacttatcgattgttcgctaatgtataa

SEQ ID NO: 12309 - DNA, 900 bp, Glycine max
  Peptide Sequence Number=SeqID_103994
atgaagctttatgagtttgtagtgatatttgggtgcttcatgctgatgttggctcaaatgccatctttccactcattgagacatattaatctggtgtcttcggtcatgtgcttatcttatagtgcctgtgctactgcagcttccatatatattggaaactcatcaaatgcgccagaaaaggattattctctgaaaggcgatacgacaaatcgcttatttggaatctttaatgccattcccatcattgccacaacttatggtagcggaataattccagaaattcaggcaacattagcacccccagtaaaagggaagatgctcaaaagtctctgtgtttgttttgttgtagttctcttcagtttttttactgtagccatttctggctattgggcatttggaaatcaagctgaaggcctcatttttagcagctttgtagataataacaagcctttggctcctaagtggcttatttatatgcccaacatttgcacaatagcccaactaacagctaatggtgtggagtacttgcagcctacaaatgtaatactagagcaaatatttggagacccagaaatccctgagttttctcctcgcaatgtaattccaagattgatttctcggtcattagctgttattacagcaactattatagcagcaatgcttcctttttttggggacatgaactcgcttataggagcatttggttatatgccacttgacttcattttgccaatgattttcttcaatatgacatttaagccatccaagcgaagctccattttctggttgaatgttattattgtcattgctttctccgcactggcagctatggcaacaatttcaacagttaggcaaatagttcttgatgccaaaacttatcaattattcgcagatttataa

SEQ ID NO: 12310 - DNA, 335 bp, Glycine max
  Peptide Sequence Number=SeqID_103995
tacgacccaactgggtcgcgcttgggtacccaacacgacccgacgcgcctgctgcagcagcgttacccgtcgcgcctgtacgcagggcgcgtcccaagtgctgccacgtgtcgcctttatggcgaacgcgcctttcggagaggcgctttgtagtacaaaaacagatccataaagctctgcaaagcaacacgacaaacctttggattcaaatcttccatgttttcctccacaccatcgaccaacactacctttggcttgagcaaaacgatgtaccgctcgtcgtcatagaattagaagagaacagcacgacggcgtgcagagagctcggagagtag

SEQ ID NO: 12311 - DNA, 870 bp, Glycine max
  Peptide Sequence Number=SeqID_103996
atggagtatttactttgggccttgttattgggtcgggaatgcccgttctcggttggttttcctcttctgaatccaccgccaccgcagcgtggacggaatcagagtgcagccatagcagcagcagcagcagttatgaattggttctattcgaagctaattgttcacttattaatagttgctattgcatatgatagggatttaatacatgttgattctgttgtattcttcgaatccttaggttatttaactgatgagatttctgcttgcggtggcacaatgagattggagaaatgctggttttgctcttcaaccgtataccccggacatggaatccagtttgttcgtaatgatgcaaagatttttcggttttgtagatcaaaatgccacaagaactttaaaatgaagagaaatcctcgtaaggtaaagtggaccaaggcatatcgtcgagtgcatggaaaggatatgactcaggactcaacctttgagtttgagagaaaacgaaacaggcctgaaagatatgacaggaatcttgcggagaatgtcctgaaggccattcctaagattgataaaatcagagtcaccagggaggagagacaccataagaacaggatgaaaggaaaaaaggaaaagctgctgaaggaggcagtgaaggagttggagcagggcatcagtttggtcaaagctccttctgtgcttcaacaggatccatctctcacattaccaaagatcaaagtcaaggtttcccaacagcaatcagaggagaatcatgccatggaagatggcgaagaggatgcacttaccagtgatggagatggattgagtctccagatcacgggagagaaaagagatgaaaaagctacagtcttctag

SEQ ID NO: 12312 - DNA, 162 bp, Glycine max
  Peptide Sequence Number=SeqID_103997
atgtcagaaccaccgtttagaccacgagagaaacttattcagaagcaaaagtatttccataatatccataaacacacatacttgaaagggccatatgacaagatcacatctgttgcaataccacttgcattggcagcatcttccgttgtatctgactattga

SEQ ID NO: 12313 - DNA, 126 bp, Glycine max
  Peptide Sequence Number=SeqID_103998
atgactaagggtattgctattggtactactcacgggtgctttttcatgggagacaagagaaaagagaagaggtggagaagtgatggagaaatgagaggaagggagaagggattgggtgtattgtga

SEQ ID NO: 12314 - DNA, 1083 bp, Glycine max
  Peptide Sequence Number=SeqID_103999
atggtagtttctgagacaaaagctgttgcttatggcaggttgttccaagaatttgcagctttatacaaacacatgtctctccaacaaccaaatcaagaggtgccattgcaagaaccagaagccacattttctcaactgagcaaacaaaactcaatactctcactcacccttgatgagttctattgcaagaatgggaagagcttaggttccatgaacatggatgaattcctttccagcatttggaactcagatgataacaaccaagttaacccaccactaccaacccttgatgaagctgcgaagggtaaaagtgtaatagcaacagaacccaccacaatttcccagccaggctcattatctgtccctcctccaatttgcaagaaaacagtggatgaagtttggtctcagatccacaaaagccaaccagaccacaatgatgctaacaatagccttgcaaggaatgagccactactcaaaaggcaacaaacacttggggaaatgactttagaggatttcctagtaaaagctggggtggtacaagaatcatcatcactattcaagtcttcattattacctcagaatcagattggtaacattgcaagtaatggaccattgggtgcaggttataggttgaggcctgtaatagggacaggatctagtgtgtcttgtaatggacttgaaacacaaaacatgttggcacagaataacaacttagttgtaaaggatctcactacaaatggtgctgtggagaaatgtccaagcttgggagaatcaaatgggaagggtaataggaagaggatcattgatggtcctcctgaagtggtagtagagagaaggcagcgcagaatgttgaagaatcgagaatcagctgcacgttctcgagcacgaagacaggcatatacggtggaactagaagcagagttgaatctgctaaaggaagagaacgaaaagctcaaacaaactctggctgaagctgaacgcaagagaaaacaagagatttctcagagaaagcacacaacaatggctcaaaagaggacagaaaatttgagggcaatgaggaggcctctaagcgcatcctggtga

SEQ ID NO: 12315 - DNA, 444 bp, Glycine max
  Peptide Sequence Number=SeqID_104000
atgaatatgatatcatcagatcctcttgttattgggagggtgatcggagatgtagtggatcatttcactccaactgtgaaaatcactgtctcctacaacaataagcaggtctataatggtcatgagtttttcctttcctcagtaaccactaagcctcaggttcagattcatggaggcgatatgagatcgttcttcactctggtcatgacagatccagacgttcctggccctagtgatccatatctgagggaacacttacactggatggtcacagatatcccaggcacaacggacgccacatttggaaatgaggtggtggagtacgaaattctaaggccaaacatagggatacataggagctttgcagaggagaatgagctggggcctcttgtggctgctgtgtttttcaatgctcaaagggaaaccgctgccagaagacattga

SEQ ID NO: 12316 - DNA, 1122 bp, Glycine max
  Peptide Sequence Number=SeqID_104001
atgccaatcccctctgagaggcacatgttccttcaagcaggaaatggttctggtgattctggacttgtgctttcaactgatgctaagcctagattgaaatggacaccagatcttcatgcaaggtttatagaagcagtcaaccagttagggggagctgacaaggcaactccaaaaacagtaatgaaactaatgggaattcctgggcttaccttgtatcatctaaagagccatcttcagaagtatagattgagcaagaatctgcatggacaaagcaacaacgtgacacacaaaatcacaacaagtgcaacaactggggagagactttctgaaaccaatggtactcacatgaacaaattaagccttggaccacaggctaacaaagatttgcatataagtgaggcactgcagatgcagattgaggtgcagagaaggctcaatgaacaacttgaggcccaaggaaaataccttcagtctgtgttggagaaagctcaggaaactcttggcagacaaaatttgggaatagtaggacttgaagctgcaaaagttcaactttcagagctggtatccaaagtctcatcacagtgcttcaactcagcattcacagagctgaaggatttgcaaggattttgccctcagcaaccacaaaccaacccgccaaacgactgctcaatggacagttgcatcacctcctgtgacagatcacaaaaggagcaagagattcaaaatggcttaagacacttcagcagccatatgttcatggagcaaaaggaagccaaagaagctcccaacaaccttaggaaccctgaaatcaagtggtatgatgatgggaaaaagaacaccttccttgccccattgagcaagaatgaagagagaagaaactatgctgctgaatgcagtcctagcaacttatccatgtccattggacttgaaagagaaacagaaaatggaagcagcatgtatcccgagagactaatcacagaaagcccatcagatggtagaatcaagccacaaacaatgaaaccagtggatgaaaaagtttctcaagattataggttgccaacttcttactttgcagcagcaagattggacctaaacactcatggagacaatgaagttttgtaa

SEQ ID NO: 12317 - DNA, 1020 bp, Glycine max
  Peptide Sequence Number=SeqID_104002
atggagaagggtagaaccgtggtggtgtccgctctgcagtttgcttgcaccgatgatgtctcaacaaatgtcgccaccgccgagaggctagttagagctgcacataaacagggtgcgaacatcattcttattcaggaactctttgaaggttattacttctgtcaggcacagagagaggagttcattcaaagagctaagccacataaggaccatcccacaatcctcagaatgcagaaacttgcaaaagagttaggtgtagttataccagttagcttcttcgaggaggcaaacaatgcacattataattcaacagccataattgatgctgatggaactgatcttgggatttatagaaagtctcatattccggatggaccaggttacgaggaaaagttctattttaatccaggtgacactggatttaaggttttccagactaaatttgcaaaagttggagttgctatttgctgggatcagtggtttcctgaggcagcccgagcaatggtgcttcaaggtgctgagattctattttatcctaccgctattgggtctgaacctcatgatggaagcattgactctcgtgaccattggaaacgagtaatgcaaggacatgctggggccaatttggtaccacttgtggcttcaaataggataggaaaggagattattgagactgagcatggaaaaagtgagataacattttatggaaactccttcatagcaggacctactggagaaattgtttcaattgctgatgataaagaggaagctgttcttattgctcaatttgatttggacaatatcaaatccatgaggcattgctggggtgtattccgtgataggcgtcctgatctatataagaattatacctggaatggtttaagcctttacaaacttccagagcgtttatcactcaccaagaaggcaagaacaagaattttggtaagattcaacttaacttcaaaagttagctcaccagttcatgagatgagaattacctatcaggattatgatatgtga

SEQ ID NO: 12318 - DNA, 1410 bp, Glycine max
  Peptide Sequence Number=SeqID_104003
atggaaatggaaccgaaccttagttacctcacctcagcacctcacacattcttcgccgactctctcaaaagctctaccaccacgccacaacctgcgccagcttgcgtgccacacgcaaccaagcaaagcacaaccacacttgaacctcataagcggagccacccctccctgcccccaaggaataactcttccgacagcaaccctgttcggtggtggatgatggaaggggtttcgagggaggctcagatgtcgattgctgcttcgtccatgtttcctggattcagattctgccctaccgatgaggagttgatttcttattacctgaggaagaagttggagggtcatgaggagagtgttcaagtcatttctgaggttgagctttgtaaatacgagccttgggatttaccagccaaatcattcattcagtcagacaacgaatggttcttcttctctccccgcggaagaaagtacccaaatggttcacaaagtaaaagagcaactgaatgtggatactggaaggcaactggcaaagagcgaaatgtaaagtcaggttccaacattataggaacgaagcggactttggtgttccacttagggcgtgcacctaaaggggaaaggactgaatggattatgcacgagtactgcattaatgacaaatctcaggaatctttggtcatttgtcgcctcaagaggaacacagagttccgtttgagcgatgcttcgaatagagcttcatcaagtcaaaggcatccggtgaattcacatgaaagtggttgtgctatctcaggaggtggtattgatcaaagggatgcttgtgagcaagacaaagaggttggatgtagctccaagagggacagtagcagttatggttctccttcaatggagcaaattgattctgtgtccgaatcgaatcagcgaccagttaacgaagctactttcactgaatcttcaggtcaaccaaaggggtatgaagaggattgttatgcagagatactaaaggatgatatcatcaaattagatgaatcatcagtcttggtagagagtcacacaagaccacaggatcctacacagatgcaacctgcaccacaaggcacagcacaacggagaataagattaagggttgggaattcaaagcattctcgtgcagtagttcgtttcccaagcacaatgcactcatcaaagaataccttctttgccagaacaaccaacagtttggtgttcgagtggaagcagcagcttgtggccgatgttgactctaaccccaacttgcctcagaagcagcatcagatttctaaggctgaagaaaccgttaaggagaagcttacagtgcacaaccatgttccttggtggcatgaaggacagtgtggtgttcacttttcgagaattgctttatgtactcttgttgactaa

SEQ ID NO: 12319 - DNA, 2052 bp, Glycine max
  Peptide Sequence Number=SeqID_104004
atgtttcccattagtcggagagtctccggggcgacatggcctgctaaagagttgagagaaatttgggccgggtatgaatttgggctatcgggtgggtcgggtggttgtatttggagcgggtcatggtttatgctgttgggtgggtccgaaacgggtataagggaaggggctggcaaagacccttctccctccgagaagcaatctcttccggggaaaggcgcttccatgccggaggtggggttcggggtggtaacggcggaggtaataaagggggaagagaggttggggatatcgagagaggtgggggttgcgtgggggatgaaagaggccggagaggtggggagggttaaggggtggttgtgggtcgcgggacgagggtcggaggaactggtgagggtcggagacgggagtgagttcgcatgtccgcgaacttctcctcctgtaatcttgcgagtccagcagcctgtacgagggtggccggccgatggtccgattagccaagtcttcaaaatcagccaagtactgggccacggtgccactttgcgtgagcttgcacaaagcccccgaggggttgaggatggggtaatggggttggggttggctgaggggatgaaactgtcgaagaaacgcgttgaagaactcaacgagagcaccaaattgataaaggtagctgctgataacctggacttcgagggccaggaacctcctaagcaagagtataaggaaggaagggcagggaatatatgcataacagaattggttatggatgcatccttgcagggaacattcgaatctagcaaatccttcattgtgccagcttggctcctctctgtttggactgcgatatcaagcatagtctctgagatatgcaggcctgccatgaccgaggtcctccactcctcatccccaccccattttgttgcttcttcatcaccgccaacaaagacaaggacaacaaccactacaacaacaacctcttcattctcttctcacaataatgcctttctcctccgacctctcttggctcttcttctgacccttctcaggaaatccttccagctttctcgcagaaacatctgctccattattatgaacattggttccccaactaacgtgcgccatgttgcgcatgtcacctttgataggttcaacggtttcttgggcttgcctgttgagtttgaacctgaagtcccaagaaggcctcctagtgctagtgcatctgtttttggagtttcaacagaatccatgcagttatcacatgactcaagagggaacagtgtgccaacaattctgctgttgatgcaaaagcatttgtatgttcaaggaggtttgcaggtagaggggattttcagaattaacgcggacaatggtcaagaggaacatgctagggatcaattgaatttgggagtggtcccagaaggcatcgatgtacattgtctggcagggctaattaaggcttggtttagggaacttcctacaggcattctggattcattatctccggagcaagtaatgcaatgccagactgaggatgaatgtgctgaactagtgagacatctacctcatactgaagcttcactcttggactgggccatcaatctgatggctgatgttgtccaacatgaaaatgtaaataagatgaatgcgcataacgttgccatggtttttgcaccaaacatgactcagatggcagaccctatatctgcattgatgtatgcagttcaagtaatgaacttcttgaagacacttatattaaggacagtacgggaaagaaaggattctgtgcaagatactccagcagaaaataaagaggctcaagaaaactttgttttagagaaaactgccttagatcgttcccctgaatcactccaaaacaactccactagagcagagcctggcagtttgacaaactcttctgagaatcttgtttccaatgaggatttgtattgtgagtttccacccgtaggaaacatggggaagagtaaaactggccaatcaagtaagtcaaatgctagaaaagagtccaaaaagacaagaggcagcaacctgtga

SEQ ID NO: 12320 - DNA, 96 bp, Glycine max
  Peptide Sequence Number=SeqID_104005
atggctaactctgttttagggaaggttaaagacttcctaggagtgatgtcagaagcaaataagcggctggaacttgacgcaaagcttaaagattga

SEQ ID NO: 12321 - DNA, 590 bp, Glycine max
  Peptide Sequence Number=SeqID_104006
gtagcagcatcttgtgctccaaaccgaccaatttccaacgagagaatatcccatttaacactccttctactcagtcagggatcatgagaaatgaagttggacggtcagacatcacaattccaaatgagcagaagctgcaggacaatatttctggtactgcttctttaggggcaaacatgaggattccaaaggatgacaatttcaaggggcaggttcacaagcaaggtagcttagttggaagagccattgatctctcaagattgagcagctacaatgacctgctgattgaactagagagactatttagcatggaaggccttctaatagatcctaataagggatggagaatcctctacactgacagtgaaaacgacattatggttgtgggagacgatccgtggcatgagttctgcgatgtggtatccaagattcatatacatacacaagatgaggtggaaaagatgacaattgggatgatgatcaatgatgatacccagagttgtttggaacaggcaccagtgacgatggaggcttcaaagtcttcctctgtgggtcagccagattcttctccaacagtggttagaatgtag

SEQ ID NO: 12322 - DNA, 416 bp, Glycine max
  Peptide Sequence Number=SeqID_104007
aattttatgctaccctctataaccctgaagacaaatcgcctaagcaggtgagggtgcaagggcacctaattaaatttaatgttgacaccttcaacaccttcttaaagacaccagtggtcatagaggaaggggaaagcttaccagcctactccagttgcccctgcccctgctccctctacatcaactctatctacttctactcttccttcaccaccaccagctccagttcttctaggtccctccgcttagagatcagagccttccttgtctatgccgcagagcctgcttcagggccatatcctgatcatgtagagtttgcaggatgtggtccagcagcggccatttataagtgtctaggagtttcttcagaaggtggcctggccaggagtccagccttctcctttggaagggggtga

SEQ ID NO: 12323 - DNA, 552 bp, Glycine max
  Peptide Sequence Number=SeqID_104008
atgaggttggtccttctactgctcgtgtcaacacaaaggaaagttgtgtcggtccctcagggtagaacccagaaatgggtgactcggacaaatgttcagttagtgaggcagacacttaacaccttccttgtttggccaacatatcttgtaaagcctttttcagaacaaaataaacagggagctaagggaccggcaaaatctgtagatatgccagatccggacattgatcccttgtgtatgactgagacaagtatgcaagcgaggaatgtcgatgtgtatggattcctcgagccacaatccatacaaaaatctgggcaatcacaatttgaatcagaagattatattaagaaatggatgcagaattcacaaagagatgtgtacctaggagcctacttgaatggtgcacattggcaaatgatcgttattttgcctaaggacaatgttctcagctggttttgttccttgcacaatagtcccaacaactacccgttgtatttttgctttgaagggactcaacgacagacaagtaaatccaaggctgctgctagatga

SEQ ID NO: 12324 - DNA, 282 bp, Glycine max
  Peptide Sequence Number=SeqID_104009
atgcatctccaactgccgcagtataattgcggcctcattttccaggtcatcaaacttgacaagatcaaggactttgctacatatatcatggaagaaaaagcacaggaccttgacccgacgaagacactaacaaatacttatcttatcctttctggacaaagtatgacaagctggaggcaaaccatctttcatcttgccttgaatgttaaggagcgtcccaatgacactgtgacatacatttttctctacatgcataacattgatacaatggctaacatctag

SEQ ID NO: 12325 - DNA, 252 bp, Glycine max
  Peptide Sequence Number=SeqID_104010
atgaataggtgtttggctgctggaaacttgagagagcaaagtgtagatgagaaacaagcatatgcggcttcacgatgcaaaaacaagggtgaagtagtggcaatatgctatagcagggggtggggtatgcaatttccttgtgtttatgacaagagtaggcttgaaattcctatggctcacaatagcatagcagtcattccagctatccaggatgtgatgctgcaatttagatgccaatttacccagccataa

SEQ ID NO: 12326 - DNA, 432 bp, Glycine max
  Peptide Sequence Number=SeqID_104011
atgatcggtgggcaggatgttgctgaggagcaacgtcatccatatctgggtcagggtggtcatattggtgcgcatgattcgcactcgcctccctgcagcagtccgggcaaaatcctgccccgaccggttcctcctctggccatactcgcattcctggccctcttccaacaccatcggatatcccaggagctggctgatagcgtcggcatcgaacgggatccactgacccctaacccaggatctcatgtcacgcacgccctcctctgttggccaagcattggcataaaattcaaggaccatttctggatcaaacttggccataggagtaaccagtggtgcccaccgccggcgccctatttcctcctgaaaatcagtatactcgtcgtccctgagctggacgcgtccgctcccggagaaacgaccatcccttga

SEQ ID NO: 12327 - DNA, 375 bp, Glycine max
  Peptide Sequence Number=SeqID_104012
gcatgggaaagcccgttaaggaaagataaagaacttaggggcattcgtaatgacatcattggtggttatcatgaatggctgaaagttcgtacacgagggttagattggctctccaagttaaagattatcgatgaagaaagcttcaaagctccggaagaggatgaagaaacgttcggaaagagtgtgccgggttacgagaagaaaatgcagctaccgcaagggcccttgaacaagaaaccaagagggctcgcaaggaagagcatggccgtgacaaatttcgtggagctttatggggtagcaacagtgagctcaagcttcgaagggaagagagagaccaatcacgagcacatagcatggtcttcaaagaggagttag

SEQ ID NO: 12328 - DNA, 264 bp, Glycine max
  Peptide Sequence Number=SeqID_104013
atgaccggccctctcgatgagtcgatctcttgctttctcataagggtggacccttgggtactagtacctatcaccttaagagggttggacaccctcgccttcagagggctgcacgtcctcacctttagagggctccatgtcctcgccttaagagggctgcacgccctcgcctattgcaggacattctcattcagatcatatcgaagaccacatcatggtggaagagccaagaaaagtcaccctggaagattattcaagttctaa

SEQ ID NO: 12329 - DNA, 932 bp, Glycine max
  Peptide Sequence Number=SeqID_104014
atggtgaaagttggaacctgttacgtgccgatcaacgtgtcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaagtagtggatcccccgggatccaggacctcgctcacctacgaaagaagttcttctgcaggaatgcacggaagaaggttcctctgtagttgtaacattaactatgaaagaaccttcttctgtgcattcctgcggaagaacttcttccatgagagtgcacggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12330 - DNA, 681 bp, Glycine max
  Peptide Sequence Number=SeqID_104015
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatgcgatgttcgatccgctcagcgcgcacctgcatccgctggcctatgcgcgtggcctggccgacgccgcgcgcgcagccggcgtggtgatccacgagcattcggcggtaacccgcgtgcagcgtgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 12331 - DNA, 339 bp, Glycine max
  Peptide Sequence Number=SeqID_104016
atgtccccagtggagtcgccaactgtcagaacctacccttcggcgggagggcgacgcgtgactcgcgggatacgtgttccacgaaaggaatacgggcggagtcgccaccaacatttatttgaggaaaacgtcggaaaaaccggaaaagacgcgatctacgaacttttaagtgaaaggctcgggagttgtatttacgcacgtggaagggtgtttccctttgctcctacgtattcctcaattgtgatgaggaaatcagacctacgtagttctttcttatgcgtcgaatcaagcgattctttttacttgaagggtgatcattttaaggcgtttggaccttaa

SEQ ID NO: 12332 - DNA, 318 bp, Glycine max
  Peptide Sequence Number=SeqID_104017
atgttagctattatcaccaagtaccaagaagaactaaatctagccacagcccacgagcataaagtggcggacgagtatgcccaagtgtacgcgaaaaaggaggctagaggaagggtgatcaactcgttacatcaagaggcaacaatatggatggaccgattttcccttaccctgaacgggagtcaagagcttccccgactactagccaaggccaaggcaatggcagacacctactccacccccgaggagatccacagacttctcagctattgtcagcatatgatagacttaatggcccatataattagaaaccgctag

SEQ ID NO: 12333 - DNA, 213 bp, Glycine max
  Peptide Sequence Number=SeqID_104018
atgctaggagaattgatgttactagaggtgtgcctacaagaaaaagactcactatggtacttggataatggctgctctaagcacatgatcgatgacaagtccaaacttagtggccttgtgttaaatgaaggtggatatgtcacttttggagacaacaataagggaagaattatgggagaaggaatattagaaatcagcacaagactcaaataa

SEQ ID NO: 12334 - DNA, 435 bp, Glycine max
  Peptide Sequence Number=SeqID_104019
atggcagcgcagctgattcgtgatcgcgtcgtgatggaatgcctagagggtgtttgggagaccctcaagggctacgagaggtgccaattctgtggcacagttcgactcactgctacatcgcttgtacatccagagcaacccgcatgcacacttcagcagcctgtggagtggatactacctgcgcctaccccatatcgactagttgagcccgttcaattgatagaggtgtcatcctccgaagaggatcctgaaggggacctagaggagttatctcctgaacctgctatggatgcccctgacttaccagaggatgatgaggacccacttcctgatgttgattctccagaggatattatgccaacacctaaggcagactctacaaaggagagtggtcctggagggatggcgaatagcgacgactcttcatcacagtag

SEQ ID NO: 12335 - DNA, 594 bp, Glycine max
  Peptide Sequence Number=SeqID_104020
atgaattcctcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataataataccaactgttgccactggtatggagtcctctgccacaaccttacttcccatcttcttcagcttcacctcaactcttcagattctattttcaatgatgattgggaagcttataggagatggagctttggtggagagataagtccttgtttggctgatttaaagcatttgaattacttggacttgagcgccaatgaataccttggagaaggtatgtcaattccttctttccttgggacaatgacttccttgactcacctcaacctctctcatactggattcatggggaagattcctcctcagattgggaatctctcaaatttggtgtatcttgacctgagagctgttgccgacggagcagtaccctctcagatcgggaatctctctaagcttcaatatcttgacttgagcggcaattatttcctggagaag

SEQ ID NO: 12336 - DNA, 764 bp, Glycine max
  Peptide Sequence Number=SeqID_104021
cgccttcataggactacatttccacgccttcagaggattacatgtcctcacaatcagaggactacacatcctcgccatcagagtgctgcatgacctcgcctttagagggctacatatcctccctatcggagggctacacgtcctcgccttcagaggactacacgtactcgccttcatagaactacacgtcctcgcctttagaggactacagatcctcgccttcagagggctacacgttctcaccttcataggactacacgtcctcacctttagagggctacacgccctcgccttcagagggctacatttccacgccttcagaggattacatgtcttcaccatcagaggactacacgtcctcgccatcagaaggctgcatgccctcgccgttagagggctacatatcctcaccatcagagggctacacgtcctcgccttcagaggactacacgtcctcgccttcaaaggactgcatgtcctcgtcttcatagaactacacgtcctcgccttcagaggaacacacatcctcgtcatcagaggactacacgtcctctccttcagaacgctacacatcccaaccttcataggactacacgtcctcatctttagaggttctacacgccctcgccttcagaggactacacgtccacgccatcaaagaactacacgtcctcgccatcagagggctgcatggcgtcgccttcagagggaaacatgtcctcaccatcataggactacacgtcctcgcattcacaggactacac

SEQ ID NO: 12337 - DNA, 421 bp, Glycine max
  Peptide Sequence Number=SeqID_104022
gaccttcaacaaagctcttcttgggaagtggagatgggatttatttcaccaaaacaaggagctgtgggccagaatattggcttctaagtatggtgggtggagatcaccggtggatgctaaaagggtcaacaatgagtcagtgtggtggcaggatttgatggcggtgatccatgaccaacaattcaataatgtacttcaagagggaacaatatggagggtggggcccctatttgacaatgaggtagcctcagctgtaggttttttggaagatatatctcatactgcactacaacaacacgcagcagacagctcggtatggaaacctgaacccaatggttactactcttctaggagtgcctacattctgctccaagggaactcagaggagggaaacatggatgatatattcaaggacttatga

SEQ ID NO: 12338 - DNA, 674 bp, Glycine max
  Peptide Sequence Number=SeqID_104023
ttggcccagggcttcccggtatcaacagggacaccaggatttattattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggccgagcatggcagctcaagccctgtgttgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12339 - DNA, 860 bp, Glycine max
  Peptide Sequence Number=SeqID_104024
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtcggtgtagctggtctccaggcccatgcgttcattgcgcttgatggcgcgcccgacgctgccttcgccccagttgtaggcggccagggccaggtgccagtcgccgaacatgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12340 - DNA, 585 bp, Glycine max
  Peptide Sequence Number=SeqID_104025
atgaagcacttcactgacaccctcatcagtgccaacataggaacaaaagctggtaccgggccccccctcgaggtcgacggtatcgataagcttgatgcatgttcggcgactggcacctggccctggccgcctacaactggggcgaaggcagcgtcgggcgcgccatcaagcgcaatgaacgcatgggcctggagaccagctacaccgacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12341 - DNA, 156 bp, Glycine max
  Peptide Sequence Number=SeqID_104026
atggaccttaagagaataaaggtcatttttgagtggcctactccatcaagtgttgaggaaagaatccatgagtttcaagaacctccagatttgaggtcaaatccttttcaagggggagggaatgatgcaatcctaccccccaagggcattggatag

SEQ ID NO: 12342 - DNA, 355 bp, Glycine max
  Peptide Sequence Number=SeqID_104027
atgactaggggtaatccaagtgatttacaaccctttgatcctgaaatagatagaccctttcatagattagttaggcatagtgtgtgtcctgatcattctgtgcattttgagcattgtgagcattttgagcattctgttgctggtgattcagaatattctgattttgagcattcaactactaattttcatactaagaacatggctcaacctccacgtcgtgagaggatttttagggagatggctgcacctgatttcacttatgaaagcttgtgcattcaatattctgatgagggtgttccatatgttctcaagactagactaatacatttgctgcccaagtttcatggtcttgcag

SEQ ID NO: 12343 - DNA, 840 bp, Glycine max
  Peptide Sequence Number=SeqID_104028
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggacttgactggattgggaaatgctgcacgaatctacaaggatgcgtttgatatttactatcaaatctctgtgtatcagcccaatgttacagtgaaactcagcatcgaaaaagagttgctcaaactggaaaaaaagctttatccatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12344 - DNA, 862 bp, Glycine max
  Peptide Sequence Number=SeqID_104029
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccgtctgacccgcaccaccgaccccctccaccgcaccacgagcgatcaccccccatccgcagcacggcgggccgcagcaggcccgccaccaccacgacaggagcaccacccccatgacgacgacgtcacccacccgcagcacgggacgctccgtgcgcaccggcgtgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12345 - DNA, 264 bp, Glycine max
  Peptide Sequence Number=SeqID_104030
atggagatgcccgaaattgaaccacggaagatctcgagaaattcaaatggtcataacttttcactcggatgtccgattcaggcgcgtaatatatcgagatgctcgaaattgaacaacggaagctctcgagaaattgaaatggcgcatcatatatcgagatgctcaaaattgaacaatggaagctctcgagaaattaaaattgtcaaaacttttcactcaattgtccgattcaggcacttcatatatcaagacgctcgaaattga

SEQ ID NO: 12346 - DNA, 270 bp, Glycine max
  Peptide Sequence Number=SeqID_104031
atgtgggaactagagagtcagatgcgaggagcctatccagccttgtttgagtcagaggttcctaagacatttctgcaaggtttgaccattgggattttcaaaataacaatttatagcctctctcttagcgtgagaagtgctctaagtgcaatttcaacccgaaagggaattgcgctaagcgagaattgtcacgctttgtgcaagaggaattgcactcagcgtaaattgtcacgctcagcgcaaatcccaaccgtgaaaattcatgcttag

SEQ ID NO: 12347 - DNA, 216 bp, Glycine max
  Peptide Sequence Number=SeqID_104032
atgttagagattggatcgacttctagtcatcctcttgttcttaattatctagttagtcctattgggattgatcgggttcttatcgaaaaagaccttcttgtcgatttgtattcggatcttgaggcttctattcttgatgaaaaagagtttctcctactaaagatgtcgtaccggatgtcacgacatcacgcttcagaacatgcagattatatttga

SEQ ID NO: 12348 - DNA, 156 bp, Glycine max
  Peptide Sequence Number=SeqID_104033
atggaccctaagagaataaaggtcattcttgagaggcctactccaccaagtgttgaggaaagaatccatgagtttcaagaacctctggatttgaggtcaaatccttttcaagggggagggaatggtgcaatcctaccccacaagggaattggatag

SEQ ID NO: 12349 - DNA, 472 bp, Glycine max
  Peptide Sequence Number=SeqID_104034
ttaccctcaccgttcgagaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacacgtcctcagcaccagagggctgcacgccctcacctccagaggactataagtcctcgccttgagagggctacacgccctcaccttggaggactacacgtcctcgccttcaaagggtcatgtaccttcaacttcagaggactacacgtcctcgccgtcaaagggtcatgtgccttcacctttgtagggctacacgccctcaccttcagaggactacacgtcctcacctttagaggactacacgtcctcgccatcagaagactacatgttccccattttcaaaggggggcatgccctcacctttag

SEQ ID NO: 12350 - DNA, 414 bp, Glycine max
  Peptide Sequence Number=SeqID_104035
atggcagcaataattctaagtgtcctaagagtatcaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12351 - DNA, 578 bp, Glycine max
  Peptide Sequence Number=SeqID_104036
caggcgagctcctggcagtcaacagataaaaggaacaaagaccacaaagcaaggaggcttgtggtggctggtcagctgtgaaactagattgatatgtgagatatggtctctggtaatcgattaccaagggcttgaaaacgaggtcaggaagctagggaagcctctggtaatcgattaccaaggggcctctggtaatcgattaccagcctgtgtaatcgattacacagaggaatgggtcactggtaatcgattaccaggcaacacgaggtgccgatttcggggcaccattcgattcacggctacttctttggtgcatccagatgaacctgcacggacgcttcagcgcactgtggagtggatactacccacgcctacaccatatcgtctagtggagtccgtccaagtgatcgaggtaacgtcatccgaggaagaccccgaggaggatctggaggagctacctcctgagcctgctgtggatgcccttgactttctagagggtgatgaggatccacttcttgaggtggattctcccgaggaagtcatgtcggcatctgaggcagactctacggaggatggtg

SEQ ID NO: 12352 - DNA, 794 bp, Glycine max
  Peptide Sequence Number=SeqID_104037
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgttgtaagattactgagagaatcagaggggttgtaattcaaagtgaaggaggtttgataggagtgatcttcttccttgtatcagtagggaaaggaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12353 - DNA, 371 bp, Glycine max
  Peptide Sequence Number=SeqID_104038
tcacgctgcgcagcctcactctcgttcttgtgcctccttcatccctaatcttcaaattctcatatcttcctcaattcttcaccaaaacacgtcccgtaaagcccaatcttccttattttcactcctctttcgattccactgatggaaattcactaaaacttcctcaaatggaagaatcatcaaagaagagaaagggatcatcctccaccaccgctgctgctggccatcgccgccacggaccatcagaagcacccacagcacctatccatcctcccttatcatctccaagatcatccactctgttttcttccgatgatcaatgtctacgatatctttctcaattctcttctaggatcatcttagaccttaaa

SEQ ID NO: 12354 - DNA, 183 bp, Glycine max
  Peptide Sequence Number=SeqID_104039
atggataaagttgatatctttgtccctcatcctctcacaaacgcatctttgcttattcaactttcaccggaatatgggtgcaagccattggtctgtttgctcaagcgacctgtgctcctgagtttggacttccaagaccgttcaatcagagattactcatcttgcacgattgtttggggcgcc

SEQ ID NO: 12355 - DNA, 186 bp, Glycine max
  Peptide Sequence Number=SeqID_104040
atggaggccgagaaagccgcggaaaaaagtcacagaggagcagagaggtttctactttttgatgcaatcctccctaggaagggaccaattaccagagccatgagcaagagactccaagaagattgggctagagctgctaaagaatggcctagggttcttatgaacctcaggggctccataatgtag

SEQ ID NO: 12356 - DNA, 315 bp, Glycine max
  Peptide Sequence Number=SeqID_104041
atgcctgaatgcagcgaatggcagacaggtttcgccgactggaatagcggcgcagttagagcgcaacggcgggaattaagtggtgagttagctgcagcgtcattaggcacccggctttacacttgccgcgctgatgcttccggctcgggaatcaataagctggtaccagggcccctccctcgaggcgcacggtattggcgaataagacctgtgatgttgatcagtttcgttgacacgatgaataagtttcctggtgttgtgatccgggaaccactgggccaacttttgccgaaacccatgaacgttgatcggcac

SEQ ID NO: 12357 - DNA, 231 bp, Glycine max
  Peptide Sequence Number=SeqID_104042
atggcttacactcacattctggattcacaagtgattctcctcaaatttcagccagcccgcatcaatttagactttgcaccttacgcttcagggtcatacaatgctcaatggaatgccccggggctcctccatgataagcacacattgtgttcgagtcgtatccttggaaaaatggaggttgaggaaacccagcagaggttatggctaccattgcagtatcaagcaagttag

SEQ ID NO: 12358 - DNA, 366 bp, Glycine max
  Peptide Sequence Number=SeqID_104043
atgtggagacacttcagaaggtctgcaaggcatgggaggtgttgccaaaaaaggacaaggaactcagaggcagtaacaatgggcccatcggtggctaccgtgagtgatgaggcaccagaggaagacgaagaggtgcaggaccttaggacagaactcaagcaagctcaaacagtcaaagaaaggttcaagtcagcagctcttaaaatccgaaaggagaatgccgaactgagagatgtaaatatggtgatgcaatcctatcccgtaagggcattgggtagaagactccaagtagattgggctagagatccaagggtaggccctagggttctcatgagccttagggtagatttcgagcccatgggttaa

SEQ ID NO: 12359 - DNA, 435 bp, Glycine max
  Peptide Sequence Number=SeqID_104044
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatagtcctaatagaagaacgactccaggttccagatccgtcgttcgccaaaccaacacctttgcctcttga

SEQ ID NO: 12360 - DNA, 375 bp, Glycine max
  Peptide Sequence Number=SeqID_104045
atgaagagagaatctcctctatccctgcattacaaactgtttgaggggacacatgtcccagacattgtctcgacatcagggaaagctgctgcttcaggtgctgtgtccaaggatgctctgattgctgaactcaaggacacatgcaaggtgctggaagcaaccatcaaagccaccacagagaagaagatggagctggaacggctgatcaaaaggctctcagaaagtggcattgatgatgaagaagcagctgagcaagaagatgaagcagctgaggaagaggtagaagcagccgaggaagaagaagaagctactgaggaagaggaagatgcagcagaggatacagaatcagatgatgattctgaagccaccccatga

SEQ ID NO: 12361 - DNA, 438 bp, Glycine max
  Peptide Sequence Number=SeqID_104046
atggcggccaatgatcatgccattctacgtgacctagcctacatgcctacaaagaaaagtcttcttgagatcacttctcaagatgctatgttggctcaaaacaagctcctggccaagaccttagagaccctcacaacaactctgagtaatcttcctcaacaatcgcatgcaatgcaccattctccatctttagtcatgcacattaggagatgcaacatttgtggtggcactcatgagtcaggctcatgcatggtccaagatgacgcaattaattacatgggcaatcagaatcatcaaggattccatcaaggaggaccaccagacttttatcagagagataatttttcgcatgatcaaggttggagatcccatctagggaataacttcaaccaagggagttcaccttatcagcctccaagccaagagcccagtctatag

SEQ ID NO: 12362 - DNA, 351 bp, Glycine max
  Peptide Sequence Number=SeqID_104047
atggctgaagagcccagaagagtcaccctggaagattattcacatacttcacatgcttctgttttgcaggttgcaagatgtaccatctgtgggggagctcatgatgttgtatccctattgaagaacaaaccactcatgaagtcaattacatggaaaatcagcccagaaacaattttaatgcaggaggatcttctggattccaacatggccagcaatacaatcaacagcaggggcaatggaggaaccaccctggaaatcaattcaatagagatcaaggtgtaccatccacaaggtcacaacaacaagggcctagtctctatgatcgcacaacgaagctggaagagactctag

SEQ ID NO: 12363 - DNA, 240 bp, Glycine max
  Peptide Sequence Number=SeqID_104048
ggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgttggccgattcattaa

SEQ ID NO: 12364 - DNA, 385 bp, Glycine max
  Peptide Sequence Number=SeqID_104049
tggatggcataagaaatcagttgagccacgtgaatacttacctatgttacgatggcatgaccttgctgggggggaatgggcacccggagggactgacaaaggcccacaaccagagctggaaactccagggcactgttggacttctccgggtccacttggtgttttgtgggcggggagatcggcattgtggtcgccgggcggaatgttgctaagtagcaacgtcatctatatctgtgtaagagtggtcatgttggtgcgcatgatccacactcgtctctttgcagcggcacaggtgaaatcttgccctggtatgcatagtagctacgcgatagcctcctcctctggttgtgcccgcacaattggcactccttcaaaggatcagagg

SEQ ID NO: 12365 - DNA, 749 bp, Glycine max
  Peptide Sequence Number=SeqID_104050
cgccacgcttcccgaagggagaaaggcggacaggtatccggtaagcggcagggtcggaacaggagagcgcacgagggagcttccagggggaaacgcctggagtcgaaaactgcgcagcaacgcgctttttacggttcctggcctttgctgcttttgctcacaacgtcgtgtggaaacttcctggcgttacccaactgatatcgtggataacgtatccccctttcgccagctgagcgtaataccgctcgaaggcccgcaccgaatcgcccttcccaaccgagttgcgcagcctgacagtgagcgaatggaagcgccgaagatgcggtattttcccttaccatctgtgcggatttcacaccgcaatgggcactctcagtacaatctgcgtctgatgccgcattcagttaatgccagctggcccgacaggtttcccgaccaacagcccggcatgacgcgcccgacgggcaattatgattttcagccgataacatcaccggaaacagcagccagattacgaattgagggcctcggtacgcctattttcgagagtaaggttaatgttgataataatggtttcttagacgtcaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcg

SEQ ID NO: 12366 - DNA, 702 bp, Glycine max
  Peptide Sequence Number=SeqID_104051
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccttccttgaagacttcttttactgcacgcaatcatcctgacaatcgcttcaaaggatcttccaagaattgccccctatgtgctcattgtggtatgctgggtcatactcaggattgttgcttcaagttgcatggttatcctccgaattataagaggactggtttttcctcagaagcaaggtaccgagctcgaattcgtaatcatggtcatagctgtttcctgtgtgaaattgttatccgctcacaattccacacaacatacgagccggaagcataa

SEQ ID NO: 12367 - DNA, 405 bp, Glycine max
  Peptide Sequence Number=SeqID_104052
atggacatgaacatcaacgctctcatttcaggacagatgacttccattgcccagtctaactcttgcagacttgggtttcctgctttgattaccaccttatttgctttccgggggactaggagggcgagggcgaggccagctgatattccatctacttctgcagcttcagtacctactccagcatctacttctgtagctcctttagtctcagctcatgttgacactcagcgctttaaagccatgcttcaaaggaaggtgaaggttgttgaagaaatgtcttccaaggttattttgatgatgccaaagaatcaaaagttaagcaaattccaaaagattcaagaatcaagtttcaagatcaagattcaagattcaagaacaatcaagttcaagattcaagaatcatga

SEQ ID NO: 12368 - DNA, 739 bp, Glycine max
  Peptide Sequence Number=SeqID_104053
atggcggtgcgcaatccggtttccggctccttcggcagctacgctcgccagtatctcgggccgctggccggatttattaccggctggacctacacctttgaaatggtgatcgtggcgctggccgacgtcaccgcgttcggtatctatatggggttgtggtaccccgatgtgccgcgctggatctggatcctcagcatcatcttctttattggcgcgatgaacctgtgcaacgtgcgggtgttcggcgagatggagttctggctgtcgctgattaaagtggtagcgataatcgccatgatggcggcgggcgcggggattattttctttggctttggccatagtttcccggccaccgggctggaaaatctgtggagccacggcggttttgcgccaaatggctggcaggggatcatcgcctcgctaggcatcgtgatgttcgcttttggcggtgtggaaattatcggcgtcaccgcggcggaagcgcagaacccgaagaaggttatcccacaggccatcaacaccattccgctgcgtattatcctgttttacgtctgcacccgggcggtgctgatggcgattttcccgtggaatagttttggcgagcagggcagtccgtttgtgctgatctttgatggcctcgggatcccggcggcggcgaccgtgctgaatatcatcgtgattagcgccagtatctcggcgattaacagcgatatttttggccccgggcgcatgatgtacg

SEQ ID NO: 12369 - DNA, 183 bp, Glycine max
  Peptide Sequence Number=SeqID_104054
atgttggaagagaggctaaaggctgttgaaggtagaagttatgacatcagagatgttgttgatctctgcttggttccagataaatataagtataacattgacatgaccctagataggtttgacttacatagcatgtcgaagagagataatcagatgtttaaagaatatgcacaaagatggtaa

SEQ ID NO: 12370 - DNA, 951 bp, Glycine max
  Peptide Sequence Number=SeqID_104055
atgacgacattggcgagtcaagtggagcacttggcttctctgatgagatttgcattgaggaatggaaagtttgtggtagattatgctgggatggattcccagcatcacgtcggtgatgcgctagtgctcatggatggtgaggtccctactgagccgcgtacactgcccgagtttaggcaaggctcgaattggagaccattcacctacactcatgacttgagtgtcttcagccactgtgggataaggcttggcaggctccctgcctctggtctctatcctctctcgtgcaaagccaaggagtggaccagcataaggatggacaatgtcgggggagacctcaagtctctggaaagttttccaatacatgatatcaatggaactgccctaatcaatgaggaccttggacaccatgaagtttgtaataatgatggagacaaccacggggtcgtcctggttgacagggttgatacccttgaggttgttgctcatgccattattgttggtgtctctgtctaccttggtcttccactctatcttttcttctgtctgcttcttggttcctatgctgctcctcttgttgtcctccagactagccaaggcagccaaggtcatgcgatgagatctgttagttgcatactgtgcattgaagcattcaacgagggtgtcgaagctgtctatggacctagtcaggaaggcatccaagtgctcatctggatttgtggtctcatcataccgctcaaagttgagtggtttctaccccaagggtatgtcagcctccataatgtggtggacgaagtgatgccgatgagtagtccgccctactggacaatgcatcctctagctgatcatggtcagccttttgctttctcatctcctccttgtggcatcactccatctaatacggtgggcaccaaatgtatttaccaaaatccagagctaggacacatcaag

SEQ ID NO: 12371 - DNA, 798 bp, Glycine max
  Peptide Sequence Number=SeqID_104056
atgcattcgcagggacttgcactgcctccagagccaaaggttggtccctcaggtgctcgtgtcagcacaaaggagagttgtgttgctccctcagggaacgatccagagacgagtgactcagacaaatacgggttatacattgaagaaaatccttcccgcctggttgccctaggaagactttatgagggatccacagcagttcacaacgtccctttgttgcatggccaagtcaaggttggtgttgaggaggttaaagatgcggaggctttcgttcctatacccactgacgaggcaactgtgtctccagaaaaacctccagaaagcccggatcatgaggtcgatgatcccctgtacctgatgacattgaccatcccgcaactgtttttgaagcctctccaggttatgtgggatgctaccatgttcggggtgtttaatcaaaatttcccgttatacataaagcacgaagatctctctgaaattgcacatggtggtcaatgtctcagcatatctgttatacaattgtggattttgcatctgactgagacaagtctgcgagcggggaattctgatgtgtatggattcctcgagccacagtccattcagagatttgggccaaacaactatcttaaggaaataattacaggaagcactaagtgcggctattacgtcatgcactggatgtccatgataatcttaggatctttcaggaataattgggaaacgtattttaatgaagttagaccattggaagcaggagactcaaggcacttcacatccagtgggcacaatattatctaa

SEQ ID NO: 12372 - DNA, 666 bp, Glycine max
  Peptide Sequence Number=SeqID_104057
atgcaactgttggatggctataactctgttgctttggacttagaccaatctagagcacgagtgaacccactagaggaactagtaagaaaaattgagtttggcctcattattaacaaatgcaacagttctttaagtcttgcagatgatggtaacatggagctgaaagctgaacaacatgctgttacatttgctattggcctgccctgtgaaggtggtgcatggtgtggatgtgcagcatctgcctgtaagatttgcaatagaatgaggggaaatggagttggtgttgaactaccaccagggaataaaggcattcctattgagttgaggctatccaacctccaagtttggttttgcaggcccaaagacatcacaagaaaattgttatctggagatcttgaccttggtattgttggactcgatagtttcactgaacatggccagattccccaatatggaatatttgaaaatgtaaattcagtggacgagcttgcaaaaatgcctcaatggacagaagaaaagcctctacgagttgctatcggtttcacctatatggggatggctgatgctatcttggacattgtaagtagtgtgaccacactgacagaaaacaacttgaaggaaatcaaaggtagagttgttttggaaagccaggctatcaattattaa

SEQ ID NO: 12373 - DNA, 375 bp, Glycine max
  Peptide Sequence Number=SeqID_104058
atgagtaacctagaggaagtgcaggaacatatgaaagtcgacatgtcggctttcaaagaacaaatgacttctatgatggaggccatgctagggatgaaacaactaatggagagtaacgcggccaccgccactgctactagcacggctgccgaggcagacccggctctcccgactgctgcgcaccatcccgttccaaacatggtgggacgagagagaagcacatcaggacatatcagcaacccccatccgggatacaaccgaggtgcttacccctacagtttaccacccaactacacaccaccagccatgcatgaagacatggatcatgtttcccccctcatcctcaaaggggagcctcctcggcatcctaacacg

SEQ ID NO: 12374 - DNA, 446 bp, Glycine max
  Peptide Sequence Number=SeqID_104059
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtatgtcttgaagccaaggagcttatgtggtatatgggtagtggttcttcaaggcatatgacgagagacaagaacaaatttgtctatttgaaagcgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 12375 - DNA, 162 bp, Glycine max
  Peptide Sequence Number=SeqID_104060
agaattgtgaacgtcatgaggaagaaaggagagaaggaaatggtggtggtccaaggataaaccgaattgaaggagtcaagttcaacattcctacctttaaaggcaaaagtgatccggagacatatttgaagtgggagctcaagatggagcatatcttctcat

SEQ ID NO: 12376 - DNA, 246 bp, Glycine max
  Peptide Sequence Number=SeqID_104061
atggaattgaagagattgaatcaacatgaggagaatgataagaagaaaaaaggaattgctcttaaagcttcatcttcaatgcaagaagaaagtgataaggaggattcaattgaaatagacgaagatgatgatcttagtatttttaaaagaatagagaaatctgaaaagaaagttgttaacgaaaagaaggaaaagaaggcctacattacatgggatgacaatgatatggactcatctgaagattaa

SEQ ID NO: 12377 - DNA, 210 bp, Glycine max
  Peptide Sequence Number=SeqID_104062
atgaaggacatcctcaccaagaaggggaagtacattgataatgagagcattgtggtgggaggcaattgcagtgcattgatacaaaggaagctgcccaagaaattgaaagaccccaggaatgtgacaatcccttgcaccatagggaatgaaattaatgaagcattgggcttgaatccagaattgggcttggacttgaagagggcagactaa

SEQ ID NO: 12378 - DNA, 348 bp, Glycine max
  Peptide Sequence Number=SeqID_104063
atgtcaaatcataaaagcactgagtcagcactgaaaaaccttgaggtccaagtgggacaactggccaagcagatagttgacaagtcatccaatagttttgtggcgaatacagaaaagaatcccaaggaggaatgcaaagctgtgatgacaaggagtaagagttttatggaggtggatgatgaggatagtgttgtgtccaagaagaaagctgttgaaaagaaaggtattgatgaaaagaaagatgatgtgagaggtgaaaacaaccaggaaaaagaaaaacaaataatggaaactggaaataaccatgcctttcggagaagctttatagcaaatgccactcaaggatga

SEQ ID NO: 12379 - DNA, 440 bp, Glycine max
  Peptide Sequence Number=SeqID_104064
cgaggaagcggaagagcgcccaatacgcaaaccgcctctccccgcgcgttggccgattcattaatgcagctggcacgacaggtttcccgactggaaagcgggcagtcccaggagctacagggaactttgtttttataaaagatgctgtctacgaaaaacctgatatatctctacttcctttcccaacttactttgtcccagaagatgaagatattgataatttgaaaccattggttgctgagctcggggatgtggatccatttatgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12380 - DNA, 494 bp, Glycine max
  Peptide Sequence Number=SeqID_104065
ggccctgggatttcccgccttgatcacaggactctgccagtcgttcggcgcccccgtcacacctagcaaggtgattcggccgcccatcacccgagcttttattgagaagtactgcacgcagagacagatccaaggtgatgcacgacaggccgcggacgcgccgccacctcatcaggctggtccagccggattgtttgatacggagcagtatttgcggcatttggttcgccagcaggcggccaaccaccgggcacatgtacaggcccatgattgtctttatcagatgagtctcagcctgcagagccagggctttacttcttttccgtgccctactccggaccagttcagggcagaggtcgcatggcctggagattggcctgaggcccaggcaggagaggcaccagcgggggcaccagcagaggctcccgccgaggcagatgaggcccgtgaggacgaagagatgaccgatttacttgatttcttaggagggagcg

SEQ ID NO: 12381 - DNA, 330 bp, Glycine max
  Peptide Sequence Number=SeqID_104066
atggaggacataaagaagatgaataaacctggcaagttgcttagaggaagcatgagattgttccctccaatctttggttctttcaggaaggctattactgatatggaatatgaaggattcattatacttagaggatggaaggtgctatggacaacatacgggacacattacaatgaagagtattttaaggatcctatgagtttcaacccaaataggtttgaggagggaataccccaatatgcatttgttccctttggaggaaggccaagagtgtgtgcagggtaccaactagctaagttaatatcctcatatttgtgcactatgttgtga

SEQ ID NO: 12382 - DNA, 373 bp, Glycine max
  Peptide Sequence Number=SeqID_104067
ttggctaattggctaagcgcgaggaagaatccaaaagaagaggagttgtcaagttcgctaagcgcaccgctccaagtcatcaagcgcaccgcttcaggtcatccgctaagcgagagaagcgcgctaagccaaaaatcactaacgtgcaataagcggttattccaagatcatgatgaagaccaagtcaatttgtgtctcatgacaaaatatgatgagaataacaaagaagattctataaggaagaaatggtacatagacagtggatgttctaagcacatgacgggtgatgtatccaaattcacaactatttcccccaagaaaagtggacatgttacatacagcgacaacaacaagggcaaaattattggagtag

SEQ ID NO: 12383 - DNA, 186 bp, Glycine max
  Peptide Sequence Number=SeqID_104068
atggtggacgttagaaatggctttggaagaaagaaagaagaagaaatggtgtttttcctaagctacgtgaaagcaaaggctgaaaacgctcaagtgagaaatggtctcggacacagaaacgtcgcgcacactccaaacatcttctctacgatcccaacggtcagaccgtggacaagtgtcttgtga

SEQ ID NO: 12384 - DNA, 324 bp, Glycine max
  Peptide Sequence Number=SeqID_104069
atggcttccatgatggaagccatgctaggtatgaaaagattaatagagagtaatgcaaccacagtggccaccgctagcatcgccgctgaatcaaactcggtccttccgtctacaacaaatctagcacatcaactcaccctagatatgggaaacctccccatcccacaggaggcgcccgcgaagaccctcggaagcgtgcccaaggggacatcgactcctgcctccttttcaccactgagggaccggcgcccaatgccttgcctcagcccaatatcgcgagagtctctcaaccccacccgatgcaaccactactcttctcagtag

SEQ ID NO: 12385 - DNA, 294 bp, Glycine max
  Peptide Sequence Number=SeqID_104070
atgtcttccgacagcgatagagacatctataacaagttcgaagcgattcctctggttgctctgatagggctacaatgcgaagggtattcctctaagcttagaaatgattttaaaattctcaacggtgagaatgctcggaattgggctgagaacatggttcttaaatttcacgatgatccaacggttaatgagtccgagatcattttttttctaagatatgtttggtggtctgtgggaaaagagaggttgagaagggagaacgaaattgagaggcggaggaggcggcagagttag

SEQ ID NO: 12386 - DNA, 522 bp, Glycine max
  Peptide Sequence Number=SeqID_104071
atgttgtatttcaatggaagggtgtatgaagagaatgatggtgtaatatttgaaggcagtaaaaaagcgattcagattaaacgtggaattagtttcaatgctttgaaaaaaaaattggagataagatttttagtttctggaaaatatgttgctttgcaaatttgtgatgacgaagatgttgaaaccatgctcgaaagttttcaacaacaaaatcaaatgtcaattttggaattgtacatagaaaaggatgtggctggtggttctatgtttcattctgcaaattctcttacatcatgcggaaataatttatctaataatgaggcgcaaccgccaacaaatgtgagcaacttacatggtgatgaagatgatgattatcttgtgtctaactcatacgttgaagagtctttagacgaagatgatagtgttgacggtatatctgatatagacgataaagtcgccgacatgattcaatcagtgtacaaggaattgaaaatccattttggaatgatgcttgcattataa

SEQ ID NO: 12387 - DNA, 246 bp, Glycine max
  Peptide Sequence Number=SeqID_104072
atgtcttcagtcatttacgtatctgtcgcaacctacccatcggcgggagggcaacgcgtgactcgcgggatgcgtgttccacgaaaggaatacgcgcgaagttgccaccaacgtttatttgaggaaaacgtcggaaaaatcggaaaagacgcgatctacgaacttataagtgaaaggttcgggagttgtatttacgcccgggaagggtgtttccctttgctcctacgtattcctcaattgcgatga

SEQ ID NO: 12388 - DNA, 252 bp, Glycine max
  Peptide Sequence Number=SeqID_104073
atggagtctgccataaagaatctggaagtccaagtaggacagctcgcaaaacaattggcagatcgaccgtcaagcagctttagtgctaacactgagaaaaatccaaaagaggagtgcaaagctgtcatgacaaggagcaaaatggaaacccatgttgatgaaggaaaagctgagaagaaggtggaggaacataaacaacagctggcagctgagccgacacttgaacccgtttctgacttagttgaactttag

SEQ ID NO: 12389 - DNA, 255 bp, Glycine max
  Peptide Sequence Number=SeqID_104074
atggccaatttaaaggatatgagccatcaaatgcatctagttgtagctcaggggggcatatggaagggggagattggccataaaagaagaaatgggtggggaatggctatgggtggtggtgaaaggcacataactagtgggaaatggctatggggaccaatcactagaaccatgagcaagaggctccaagaagattgggctagagctgctgaagaaggccctagggttctcatgaaccttagggtagatttctga

SEQ ID NO: 12390 - DNA, 305 bp, Glycine max
  Peptide Sequence Number=SeqID_104075
atgtcttccaaggttattttgatgatgccaaagaatcaagagttaagcaaagtttcaagcaaagattcaggaatcaagtttcaagtatcaagattcaagattcaacaaaaatcaagatcaagattcaagactcaagattcaagaatcaagagaagactcaatcaagataaagggtacatctacttggggattgttatactgagaacaagagagggtacatctcttgtggatcagttcaagtggagggtacatccacttgggttttcaaagagaacaagggaggggacttccattgtggatctgag

SEQ ID NO: 12391 - DNA, 198 bp, Glycine max
  Peptide Sequence Number=SeqID_104076
atggagatgacattctccactgggtttgcatatctggaggtgaaaactgtattccccgagcgtacaaacttgttatgctggtttcacatcgacaagaacgtcaaggccaaatgcaaatctttaatcggtcaaaaaaatatttgggagtatgtcatggataactggggtactctggttgattgtccttctgaacagtag

SEQ ID NO: 12392 - DNA, 551 bp, Glycine max
  Peptide Sequence Number=SeqID_104077
gctacatgccctccagcttcgcagacttggtattcgctagggaaaggatcaaggtgggcttgaagagacggaagttcaattatgtctactccacaagtgccaacggtaggaggattggagcaactggggcaaagaggaaggaaggagatacccatgccgtcacttcaacgcctgcatgggtcaagccgccgcagatctcccacgagggaggtcccccaagctctggtttcgaccatgactcgcccgaccaacaatgcccaccttggcgtcggttccaacgcagcaaggaactttcccccaaggccaactcaagaattcgccccgatcccgatgacgtacaaagacctcttgccatccctcatcgccaaccaaatggttgtgatatctcccggaaagatctattagcctcttttcccgaggtggtccaaacccttaagggacgtaatgacccccagaaggtttatctaggaggccctacaaaaggggggcgtgattccccacggtgggcacgagaaggattcttgtctgatgcatcccggcgtgccacatag

SEQ ID NO: 12393 - DNA, 291 bp, Glycine max
  Peptide Sequence Number=SeqID_104078
ggtagcaaaggatcattaaattgtaaacatcatgagccacatgatgagggaagcagtatcaaatcaatgctttacaagcttttggtcaatctgaggagtgcttttacaaaaataagcactgcagcttatttaaggcagaaattctgcagcatctgcagtatgtgggtggaaaaagggtgggagtggaactttaaatggagaagacacttgtttgacagagagcttgagatgacagattgtttccgtaatgatgttgctggcagcagtattcagattcacaaaaaaagatga

SEQ ID NO: 12394 - DNA, 294 bp, Glycine max
  Peptide Sequence Number=SeqID_104079
atgcttatgcatggctggttatggaaagggttgtacatattgggttctggacgttttctagcagatcccaacggtcaaaatgtagaggtgacgtcatctgaagaagaccctgaggaggacctagaggagctacctcctgagcctgctgtggatgctcttgactttctagagggtgatgaggacccactccctgaggtggattctcctgaggacgtcatgtcggcatctgaggcagactctacggaggagagcggtcctggagggatagcgactagtggtggttcttcatcatag

SEQ ID NO: 12395 - DNA, 697 bp, Glycine max
  Peptide Sequence Number=SeqID_104080
agggctccacgccatcatcttcagaggactacacgtccttgccatcagagggctgcacgccctcactttcagaggactagacatcctcgcctttagaggactacacgtcctcgccatgagagggttgcacgccctaacctttagtggaatacaggtccttgccagcagagggctggacgccctcaccttcagaggactacacatcttcaccatcaaagggttgcacgccctcatcttcagaggactccatgtccctgccatcagagggctgcacgccctcactttcagaggactacacatcctcgcctttagaggactacacgtcctcgccatgagagggctgcacaccctcacctttagtggaatacaggtccttgccagcagagggctggacgccctcaccttaagaggactacacgcccttgccatcagaggactagacattctagcctttagaagaccacatgacctcgcaatcagagggccacacgtcctagccatcagagggctgcacgccgtcaccttcagaggactacaggtcctcgggatcagagggctgcacatcctcaccttcagagaactacacggccacgccatcagaggactagacatccacgcctttagaggactagacgtcctcgcctttaggggactacacgtcctcaccatcagagggcagcacgtcctcaccatatga

SEQ ID NO: 12396 - DNA, 500 bp, Glycine max
  Peptide Sequence Number=SeqID_104081
ttgaggaggaaaaggcagttgaggttattgatccattgggagagttggtgaagaacttgttcgacatttaccaaaggcccgttgaggtgtcatgggatggtgctaaatttggaatcaataatgtccaagatggcttcttctcatacacgctgatgtttattcatgattggagtgcgagcattggttatggagcattgtatgggttccttgaacctcagtgtatccacaatgcaagcagtagacgtcaagagtgtgaaaattacattggaaggtggttgaaggaagcaggaaaacaaatttacatagcaccttatttaaaccaggcccattggcagcttgttgtattgtgcccaggcgacaatctagtggtttggttttgttctttgcgaaagaagccggatgttgccatcaagggtgcagtaaacagtgcaatgaaatcagtcaccaaaactgcagagggaaagccacctcagcatgggcctcagtggattgaagcaaag

SEQ ID NO: 12397 - DNA, 164 bp, Glycine max
  Peptide Sequence Number=SeqID_104082
atgggggtgcaaatagcacccaagcccacttgggccctccagaatattcctccagaaggctccgaggagcttccgaaacgtttccgtaacgttttccgtgaagaatttcgcaaaggtttcaaccgttcttcgacgttcttcattcgttcttcgatcttcaacgg

SEQ ID NO: 12398 - DNA, 345 bp, Glycine max
  Peptide Sequence Number=SeqID_104083
atgcatgctttgctagggtcattcaaccgtggaaactggtctgattctaaagtccttgatagtacggggctaagttgttgtactatcacgaggaatcggggcactttagttcctttggacttagaaattgaagctacactgagaaggaagaaggctgagaggagaaggaaactattgcaagatagaacagttgcatccattctggaggaagagacccatttttctgaatcattatcacctgattcaccatcatcaaaggaatgcactaatcaattgtctaaaactgctactatggcagatgagcacgaccagaggactacccttgaagactattcaagtagctcg

SEQ ID NO: 12399 - DNA, 237 bp, Glycine max
  Peptide Sequence Number=SeqID_104084
atgtgtcctccaccttcgagcctaggagccccgcgaatgtcattgcctagcgctgttcgccaattctccgttctccactttttttcggagccccatgaaggtcattgcctagcgttgttcatgtgtcctccaccaaaagagtttggagctatgcttcatgaatgcctaagtgtggaccctctagtgcaatcctccattctccacttttttcggagccccatgaaagtcattgcctag

SEQ ID NO: 12400 - DNA, 273 bp, Glycine max
  Peptide Sequence Number=SeqID_104085
atgattggccaaaaggttgtaatcgattaccagaagcccaaacgttacagagacggtgaagggattgaagcattcattttgtactgtctccgtgcgattcacttttcactctccatgaatattatctcacaaatcccaatgctggaggtttggtggtatgcgggaaaagagagggttttgggaggaagagaagggaaaacgaaattgagaggaagaggaggccgagaagctatcgtcagtctgaaaaatgacctaacatatatttgtttatag

SEQ ID NO: 12401 - DNA, 160 bp, Glycine max
  Peptide Sequence Number=SeqID_104086
agggcaggatcatcttaagctaccttctggggtggggacaaaacatggacagcagaaaccaatcaaggaacggatgcaagtggggatggagtcacgaccgactgatcgttgccctttctctgcgctaaacaagcagaggacgttgctgcaaggcagcccc

SEQ ID NO: 12402 - DNA, 711 bp, Glycine max
  Peptide Sequence Number=SeqID_104087
atggcgctcgaaccgtaccgtacggtacatcaatcgagccccctggagtggaaagacttggcttccgacccgatcacagcgcaggaattttcgccgcgccagaacgccgttctggaccaggcattgcgtctattggtcgaaggtggcgagaaagcgctgaccacatcgggactggcgcgcgccgccaactgttccaaggaaagcctttacaagtggttcggtgatcgcgatggcctgctggcggcgatgatcacattccagcagagcaaggtccgcaccttcgaaaaggcgggtgaccgcgtctccgcaccgcagcttgccgatcacctcgaggttttcgcccatgacctgctggatgtgctggcaggcgacgtgtcattggcgcttaaccgtttggcgatagggcaggcgagccgggatggctcgaagctcggtgatctgctgctggaacgtggtcgtcgccagatcgaccgccgcgcccgtgggctgatcgaggcaggtcgccgttccggttacctgcgtttcgatgatgccgaagaggcatatcgcagtttttacggccttatcgtctcggatctgcatgtgcgcatgctgctgggcgaggcgccggacaaggatttttctgcccgggcgaagaaggcggtcattgccttcctgaccctctacggcacggaaaaggtacattcggaactgggcggcaaggtcgcttaa

SEQ ID NO: 12403 - DNA, 49 bp, Glycine max
  Peptide Sequence Number=SeqID_104088
ggtgaatgctgtgaaaatttccccggacgcccaaaatggactcggatga

SEQ ID NO: 12404 - DNA, 112 bp, Glycine max
  Peptide Sequence Number=SeqID_104089
atgtctctgtcaattacgcgtgaaaatttcgatgaatggatgatgccggtttacgctccggcggcttttattccggttcgtggggaaggctcgcgcctgtgggatcagcagg

SEQ ID NO: 12405 - DNA, 774 bp, Glycine max
  Peptide Sequence Number=SeqID_104090
atggcgaatcaagaggagtgggtcccgtttataaatgtattagcattgctaatctttggggttgtcctctttccaaacgtggatggtttggtggacctagccgcaattgatgctttccttgcatatcaccatagcatagagagcccagtggcagctatcttggcggacgtatttgacacatttgaccgaaggggttgcattaactacaatcccgcacttgctataagacagttagggtaccccatgaggggagcaccgatagaagaaagcctgtctcctttccttgtgagagattttggtgcgcaaaatttcaaggatgaggaaatccaagctctgaaatcagagctaggaaaggcaagactcgccaaagaaatattcaagtcagccgctacaaacgtccggaaagagtgtgccaagttacgagaggaaaatgcggctaccgcaagagcccttgaacaagaaaccaagagggctcgcaaggaagagcatggccgagataaatgccgaggagctttgtggggcagcaacaatgagctcaagctccagagagaggaaagagaccagtcacgagtacatggcatggtcttaaaggaggagttagctgcttgctcaagatccaagaggagtttggcccaacacttagaagccacaaagcaaagcatgctaactataatagggcagtacaaagaagagttaaaccagtctttgacccatgaacaaaaactagtagaggacttcgcacaagtgtacgacgagaaggaagcaacagggagg

SEQ ID NO: 12406 - DNA, 864 bp, Glycine max
  Peptide Sequence Number=SeqID_104091
atgaggcttcaatccaagaagattcaagagtcattaagtggacattctgataatgaggagtcagatacatttatctctgaaaaatcatttcaaggcacaaaatcactcctagaagttaattttccagatactaattctcattctgagctaattaaggatgatggtttagaaaaagagatagaatcccatgaaaaactgtgtgctgacaagtcagatggtaaggatggaaatgagtttgggagcagtgtcatagatacttgtggaacaccaccaagtattgacaacaccaatgacaattcattgaccaaggtaaattgtaccaccgaggattccctaacctcacttcttgactcttccattgtggataatccacttaagtttgaccatgaggaaaattacaaggtactttatggagaaagtatattgagcaaaagtggatcaacaatggagaattcacatgattacaagctagatcaatgcatgaaagactcattgaaagaatggagaaagaaccaatggagaaagactcatgaaagacttgatcacatgattacaagtctggcatggtataccaatggagaaagaaaaatgttacctgattctaatgcctgcaagcttgccaccagtgatcaagtcgaagaacctaaagtcactgagaatggagtaccattctcagttgatgcttatgttaacaactccaacaaggcttcagaggaaagtggcgctgtttcagaccaaaaacattttgtggttcttgaggccaaaagggtttcttttattgcagggttaactgttgttgattccaggcataaggaagaggagagttacaagaataaaattgaaaacattatgttagcattttga

SEQ ID NO: 12407 - DNA, 524 bp, Glycine max
  Peptide Sequence Number=SeqID_104092
aggaggacccagaggagctacctcttgagcctgctgtggatgctcttgactttctagagggtgatgaggacccactccctgaggtggattctcccgaggacgtcatgtcggcatctgaggcagactctatggaggagagcggccctagagagatggcgactagtggaggctcttcattatatcattatttagtgacgccacagaagacaacgttcttccgctgcatcacacggaagatcctgcagaaccttctttcgttggatcatgcggaagatcctgtagaagctttttccgaaggaatccgcggaagaaccttccacacttcttccgtgggaccccgcggaagaacaccttcttccgctacagttcccagaagcctctttcatacgcgtgaaagaaggttcttctcgcggaagtaccttcgtcttcaacctccagtaccacaggtcactaatgtcgtctatcctaaggttcctacggccatttacgccattcaaacagatacgaggaggttagaagactaa

SEQ ID NO: 12408 - DNA, 204 bp, Glycine max
  Peptide Sequence Number=SeqID_104093
atgaaggtgaggactttgagtcctttgaaggtgaggacgttgagtcctccaaaggtgacgactttgagtcctctgaaggtgaggatgttgagttctctaaaggcgaggactttgagtcctctgaaggcttggactttgagtcctatgaatgcgaggactatgagtcctctgaaagatgccaatagatgcatgcaacctttgtag

SEQ ID NO: 12409 - DNA, 153 bp, Glycine max
  Peptide Sequence Number=SeqID_104094
atgacattcctggggctccgaaaaaggtggagaatggagaattggcgaacagcgctaggcaatgacattcgcggggctccagactcgaaggcaaccatgaagcatagccccaatctcgaaggtggaggacacatgaacagcgcttggcaatga

SEQ ID NO: 12410 - DNA, 201 bp, Glycine max
  Peptide Sequence Number=SeqID_104095
atgaacaaagacaagaaaaatctcaagattgctaaattttccatggtatctttgaagaagaaatggtacatagatagcggatgttcaaaacatatgacgggagatgcatcaaagttcacacatatctctcccaagaaaagcgagcatgtaacttatggttaccacaacaaaggtagaattcttggagttgggaaaaatagg

SEQ ID NO: 12411 - DNA, 162 bp, Glycine max
  Peptide Sequence Number=SeqID_104096
atggttcaactaagcacacatcgctgcgctaagcccaacaccttcactgtaagttgcaccttaagcagtgggcttagcgtggatgatgcgctaagtgccacttccttgcaaagacaatccaagatttctgatgatcgcgctaagcggaccatgtcgcgctaa

SEQ ID NO: 12412 - DNA, 99 bp, Glycine max
  Peptide Sequence Number=SeqID_104097
atggaggtgcaagtgggccaattaggtaagcaattggtggaaacgtctaggagtagttttgtggccaacatggagaagaatcccaaggaggagtgcaag

SEQ ID NO: 12413 - DNA, 582 bp, Glycine max
  Peptide Sequence Number=SeqID_104098
atggcccaggtgattgctgatgccatttatttgtttgcaggaatgacgcctactagacaccctctggacacagagaagtccaacagggccctggggttttcggctctgatcacgggtcttcgccagtcctacggagttcctgtcacccccagcaaggtaatccgaccgccgatcacccaggccttcatcgagaagtactgcatgcctaggcaggcgcagggtgacgcacatcaggccgcgggcgcaccgccaccacctcgacaggccgacccgactgggccactgggtgtggagcgttatctacaacatttggttcgccagcaggcggccaaccaccgtggacaggtgcagatacatgagtgtctctaccggttcagcctcagtcagcaggggcagggttctgctccttttgtatgccctaccccagagcagtttggggctgaggtctcatggcctggagactggcccgatgcccaggcaggggaggagcctacaggatcccccggtaaggcggatgagtcccatatggataaagatatgacggacctgctcggtttcttgggagggagtggagccacatga

SEQ ID NO: 12414 - DNA, 159 bp, Glycine max
  Peptide Sequence Number=SeqID_104099
atggtgcccatgtttcatacgttgtatgttgtgtatgtacatggggagtgcaatgaccttgttggatatccctgggggaggggggggggaaagaatgggggtgcagtgaccttgttggatatccctggtgggggaaatagagtggttaaagagttttaa

SEQ ID NO: 12415 - DNA, 1167 bp, Glycine max
  Peptide Sequence Number=SeqID_104100
gttaagggtctagatgtcaccagcctcaaggaattgggacggttgatgggacctctccaaaggcaagccttccgcaaagtgtacggaaagatactagatttgaccgcagcggaggtatttacggaagctgtcgtatccctcgcccaatactataatcagccgttgaggtgcttcacgtttggggacttccaaatggtaccgactgttgaagagtttgaggagatattagggtgccctcttgggggaagaaaaccgtacctattctccaggtttcttccctccttgagtaaggttgcagttgtggtcggagattcggcaaaagagttggatcgcatgaagcaaactcggaacgacgtagtgggcctgccgcggaaatacttggaaggcaaggcaagggatatggtgagccaagagaagtggggcccatttgcggatacactggctttgctaatttttggggttgtcctctttccgaacgtggacggtttggtggacttagccacaattgatgctttccttgcatatcaccatagcaaggaaagtccagtcgtggctatcttggcggatttatttgatacctttgatcgaaggtgcgagaaaaacagtgcacggattgcagcgcaatcaattggtttcctagatggaaggaaggcaaggagggagttcttttctcatgtggggactacccctaatgtttcgttgatagggacgaggggctcgcaaagtctcaaggtgatacaaagagtccacaaggcgtggaaaagtctgttgaggaaagacaaggagcgtagaggcatccgtaatggcgtcatcggtggttatcatggatggctaagagttcacacgcaagggttagattggttctctaaattgaaagttatcgatgaggagaacttcgaagctccggaggaagatgaggaagtccaagctctaaaattagagctagggaaggcaagactcgccaaagaaaaattcaagtcagccgctacacacatccggaaggagtgcaccgagttacgagaggaaaacgcggccactgcaagagcccttgaacaagaaaccaaaagggcctgcaaggaggaacatggccgagagaaattccgaggagctttgtggggtagcaaaaatgagctcaagctccgaagagaggaaagagactggtcacgg

SEQ ID NO: 12416 - DNA, 276 bp, Glycine max
  Peptide Sequence Number=SeqID_104101
atgagggttcactgtaatcaagcaagtcggagacctagcatgatcacagatttacctccactccttatgttcccgcgaacccggattaaatggcctaactctctaaaaatcatccccagcggagtcgccaactgtcacaacctacccttcggcgggagggcgacgcgtgactcgcgggtgcatcttccaagaaaggaatacgcgtggagtcaccaccaacgtttatttgaggaaaacgttggaaaaaccggaaaagacgtggtctacgaactttaa

SEQ ID NO: 12417 - DNA, 274 bp, Glycine max
  Peptide Sequence Number=SeqID_104102
atgtcattgcctagcgctgttcatgtgtcctccattatcaagcgcgaagcctctggtgactgggaaatacgttcttatgttgttttccggatcgaagaaaaagaaggagtagagacgagagtcgtcatcacggaaagggcaggacggacgaaatcagtgtcctatctttgctttcctcttatctccgatgagagtcccgagacctctcagaaatcaaaaggaagcaggcttgcacgatccgtgaaattccataaggtggcggaagtcaaaagag

SEQ ID NO: 12418 - DNA, 156 bp, Glycine max
  Peptide Sequence Number=SeqID_104103
atgaatgtctgtttcatctcggggaatcacacgacatggaaacctgccccgcggtggaagagctacttcaacggctcatggactaggggcagctcgaagtgtccgagagaggaatgtgaccggccccaggtccgagtaccccccgaaattgcctaa

SEQ ID NO: 12419 - DNA, 684 bp, Glycine max
  Peptide Sequence Number=SeqID_104104
atgaggtcctgggtgaggggtcagtggatcccgtttgatgcagatgctatcggccagctcctgggatatcctttagtgctggaagagggccaggagtgcgagtatggccagaggaggaaccggtccgatgggttcgatgaggaggtcatcgcccagttgctatgtataccggggcaagattttgcccggactgctgccgggagacgggtgcggatcatgcgcaccaacatgaccaccctgactcagatatggatgactttgctactcagcaacatcctgcccagcgatcataattccgacctccccctgccgaagtgtatggagcctactaggcaccctctggacccggataagtccaacagggccctgggatttcccgccttgatcacaggactctgtcattcgttcggcatccccgtcgcacctagcaaggtgattcggccgcccatcacccgagcttttattgagaagtactgcacgcagagacaggtccagggtgatgcaccacaggccgtggacgcgccgccaccacatcaggttggtccagccggatcgttggatacggagcaagtatttgcggcatttgatgagtctcagcctgcagagccagggctttacttcttttccgtgccctactccggaccagttcagggcagaggtcgcatggcctggagattagcctga

SEQ ID NO: 12420 - DNA, 137 bp, Glycine max
  Peptide Sequence Number=SeqID_104105
atggctccgaaaaagctttccgcgaaaagatcaaggagggatgccgcgactaaagggaccagtgccacccccgagtttgatagccaccgttttaggagcgccgagcaccagcagcgtttcgaggccatcaaacgatg

SEQ ID NO: 12421 - DNA, 776 bp, Glycine max
  Peptide Sequence Number=SeqID_104106
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggagggaatatcccagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12422 - DNA, 471 bp, Glycine max
  Peptide Sequence Number=SeqID_104107
atgaccatgattacgccaagctcgaaattaaccctcactaaagggaacaaaagctggtaccgggccccccctcgagagtctgctgtgattataacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12423 - DNA, 387 bp, Glycine max
  Peptide Sequence Number=SeqID_104108
atgcagtcccaatttcaattgcagatgcaatcacagggactcgcactacctcttaagcctgaggttggtccttcagctgctcgtgttagcacaaaggagagttgtgttgatccctcagggaacgatccagacatgtgtgactcggagaaatgttggttgtacattgaagaaaatccctcctgcttggttgccataggaagactttatgaggggtccataatcgttcacaacatccctttgcgccatgatcaagtcaaggttggtgttgaggaagttagagatgtagatgttcacattcctgtacccattgaagaggttcaattagtggggcaaacacttaacaccttcattgcttggccaacacatcttgtcaagcgtttatcataa

SEQ ID NO: 12424 - DNA, 240 bp, Glycine max
  Peptide Sequence Number=SeqID_104109
atggagaattgcactaagcaatcactacgaatggctccaaactcgaaggctccaaactcgtggagtggaggacacatgaacgaaaacgcaaattcatggatgctccgaaaaagattgagaatggagaattgcactaagcaatcactacagcatggctccaaactcgtgggtggaggacacatgaacgaaaacgcaattcatggggctccgaaaatgattgagaatggagaattgcactaa

SEQ ID NO: 12425 - DNA, 540 bp, Glycine max
  Peptide Sequence Number=SeqID_104110
atgaccatgattacgccaagctcgaaattaaccctcactaaagggaacaaaagctggtaccgggccccccctcgagctagttcaaccattgtggaagtcagtgtggcgattcctcagggactagaactagaaataccatttgacccagccattccattactgggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12426 - DNA, 210 bp, Glycine max
  Peptide Sequence Number=SeqID_104111
atgggtgaagtaaaggaggtgcaaaagcagatgaaggccaacatggaggccatgaaagagaaaatggccacaatgatggaggccatgataagcatgaagaagataatggaagccaatgtggttgtagttgccgctaccaacgcttttgctaaggtgaacccgatgcccccatctggcctcaaccaaatgaatcatccaacctcatctatg

SEQ ID NO: 12427 - DNA, 612 bp, Glycine max
  Peptide Sequence Number=SeqID_104112
atggtactggctgagggagagtacttgcccgtttactccagatactgtaggatgcccactgatatcagagagattgaggctgctttgtgtatacccggtcaagggtttgttttaaatgctgaaggccatcctaggaagatcatcaggaaagatctggcaactcttgctcgggtttggagtgttctctcatactccaacctggctccgacttcccacacctcggatttgacaatggatagagctaggttaatctttggcctagtctctcagctggacatgaatgtaggagctctcatatctggccagatcacatctatggcccagtctaactcctctagacttggattccctgctcttatcacagctctatgtaggtccagaggggttgcttctgacagcctagtcttcgaacgcttgatcccagtcattaacttagcctatatcaggaaaaactattggaaccctactgatctgacagttactattagaggggctaggagagcgagggcaaggccagtcgaggctccttccacatttgcagctcctcctccagcaccctggcccgagactcagcccccccttcatagggaagacgaaggtctcaccgctcag

SEQ ID NO: 12428 - DNA, 249 bp, Glycine max
  Peptide Sequence Number=SeqID_104113
atggggagtaggagtcgacgtctccttgagcatgctctcgaggattctcgtggaccctgtcaggatgtcgagaaggctcctcttcgaggacgaggggaggaatgtgacccacgtcgtcatgtatggctggtggtgtgtaattgggtggtaaaccgtagggataaggtggtgcgcagtagtcgggagagtcgggtctgcctcgacagccgaactaacagcggcggcggtggctgtgttactctccattag

SEQ ID NO: 12429 - DNA, 162 bp, Glycine max
  Peptide Sequence Number=SeqID_104114
atgaggttgaggcgcttccgaatcgctaccgtgattgatttctacatcgctcttcgttcggtgttcttcattcgtcatccaaactacataggtctgagtttctcattgtacttgaggatacgtaggagcaagggcaacgctcttgtcagccccaaaaagtaa

SEQ ID NO: 12430 - DNA, 150 bp, Glycine max
  Peptide Sequence Number=SeqID_104115
atggaatcaatgatgagaaatagagaactaagcgaaacaatgatgatgcaggctgctatggaaagagaagtggaattggagcacagagcaattgagtcatccattgcgcttgcatggatacaactaacgttagcactttgtgtggtttaa

SEQ ID NO: 12431 - DNA, 899 bp, Glycine max
  Peptide Sequence Number=SeqID_104116
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagttaatcaattgcgtcatgcgcagtacttgcgtgacgctgagggggtccgcaagctcatgcgtgcccatcgcgagatccttgccccgaagttcgctgtcgttaatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12432 - DNA, 327 bp, Glycine max
  Peptide Sequence Number=SeqID_104117
atggttacccgcacctttcgtcaactgggggcaaacgagcccgttgacgtgaagagactggcatcgtcttctacactatttgccatccagggacatcgagtcaggtggcaggcggagataccttatggtcatccgcgcctttcgtcaaccaaggggaaagacttcgacggtatcaggatgatgttttcactcttgtcgtccggaaacattaaagcccaacgacgcgcgagattcttctctgctgggcagggacgatcaggtgcgatggaaaagggaagtaacatggttgttcagccttgtcgttttcaagacgctgaagtttgttga

SEQ ID NO: 12433 - DNA, 789 bp, Glycine max
  Peptide Sequence Number=SeqID_104118
atggccaagttcgatccagaaatagtccttgagttttatgccaatgcttggccaacagaggagggcgtgcgtgacatgagatcctgggttaggggtcagtggatcccgtttgatgccgacgctatcatccagctcctgggatatccgatggtgttggaagagggccaggaatgccagtatggcctgaggaggaaccggtctgatgggttcgatgaggaggccatcccccagctgctatgtatactggggcaggattttgcccggactgttgcccggaggcgagtgcgaatcatgcacactaacatgaccactctgaccctcatatggatgacgttgctcctcatcaacatcctgcccagcgatcataattctgacctccccctgccgaagtgtcaacctggtatggtgcctaccaggcatcctctggaccctgataagtccaacagggccctgggatttcccgccttgatcacaggactttgccagtcgttcggcgtccccgtcacacctagcaaggtgattcggccgcccatcacccgagcttttattgagaagtactgcatgcagagacaggtccagggtgatgcaccacaggccgcggacgcgccgccacctcatcaggctggtccagccggattgtttgatacagagcagtatttgcggcatttggttcgccagcaggcggccaaccgccgggcacatcccgcagagccagggccttacttcttttccgtgccctactccggaccagttcagggcagaggtcgcatggcctggagattggcctga

SEQ ID NO: 12434 - DNA, 794 bp, Glycine max
  Peptide Sequence Number=SeqID_104119
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagacagcactgagtttgatgcctcacacttactgtgttctctctgccttcagtgcccaagagatgctctctgtatcatgctaccagctgctgggggtggtggagagggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12435 - DNA, 1133 bp, Glycine max
  Peptide Sequence Number=SeqID_104120
gtgcgtgcgcccatgatggcaccaaacagcagcgcgcggttcatgcgcagcacgccgctcagcagcatcagcgcgcccgcactgccgagaccgtgctgcagcccgctgccggcgctcagaccaaccccggccataaacaccatcaggccaaactctttcaccatggtcagtgcgccctgcgggatgtagccgaacgtcgggtggttggcgcgcaggaagccgagcatgatgccggcaaacagcagcccggcggcgttgcccaggccaaagctgaagttactgaactggaaggtgatcatgccgatcatcaggccgatgataaagaaggcgcagaacgccagcagatcggtcatctggctgtgaatagcaatgaagccgatgcgatcggccaggcttttcacccggcgcgcttcgccgctcacctgcagcacatcacctttgttgagcataatgctgtcgtcgatcggcatctcaatctggctgcgaatcacccggcgtttattcaccgcgttgtggtttttcaccacgatctcttcggtgacgatgcgcatgtcgagcagatcgcgatcgaacacctctttaccattacggaaactggcgtcgagacgcgcatgggcatccggatagcccaccagggaaatctcgtcgccgagctgcagcacggcatcaccgtccgggctggcaagaatgccgttacgccgcaggcgctcaatgtagcagccggtctgacggtgaatccccagctcgcgcaggtttttgccgccgctccactcaaccagctccggaccaacgcgataagcacgaattaccggcaggaacactttacgctggctgtccgcatccagaccgcgctcgcgcgcgatttgctgggcgcaggtcggcaaatcctgatgctgcaggcgcggcaggtagcgtgcgccgaaaatcaggctgaccagcccaatcagataggtaagggcgtaacccaggctaaggttatcctgcatgcgacccagcagctgcgtgtcgctgatgctttgccgcagcccggccagcatgccggcggtgaggccgatatcccagccaaacagtttgccgagcgtcagcgcaatcagcagggcgctgaccaccatgacgatcgccagaaagaaata

SEQ ID NO: 12436 - DNA, 453 bp, Glycine max
  Peptide Sequence Number=SeqID_104121
atgaccatgattacgccaagctcgaaattaaccctcactaaagggaacaaaagctgtccttgtacgtttgtgcctttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12437 - DNA, 695 bp, Glycine max
  Peptide Sequence Number=SeqID_104122
ggctttcccggtatcaacagggacaccaggatttattttttctgcgaagtgatcttccgtcacagtggcttctgttttctatcagctgtccctcctgttcagctactgacggggggggtgcgtaaacggcaaaaagcaccgccggacatcagcgctggcaagctgcgcaaactgttgggaagggcgatcggtgcgggcctcttcgctattacgccagctggcgaaagggggatgtgctgcaaggcgattaagttgggtaacgccagggttttcccagtcacgacgttagtgcagccactagatggaaaaaacagggccaggactaaggtgaggcttgcgaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12438 - DNA, 368 bp, Glycine max
  Peptide Sequence Number=SeqID_104123
atggtgaaagttggaacctcttacgtgccgatcaacgtctcattttcgccaaaagttggcccagggcttcccggtatcaacagggacaccaggatttttgtatttctgctgaaggtgatgtgctccagtggcgtatctggtttctatcagctgttccctcctgttcagctactgacgggggcgctaaagggcggagtgtgcatactggcttactatgttggcactgataacgcaggggcgaattggagctccaccgcttcccgctcagaactgactcctacctcggtcgtcactgcacggaattcgtgcttacaaggggcttggaatatttctggaagtatgcaccaaggaagatacttaacagggaa

SEQ ID NO: 12439 - DNA, 417 bp, Glycine max
  Peptide Sequence Number=SeqID_104124
atggtgaaagttggaacctcttacgtgccgatcaacgtctcatattcgccaaaacgttggcccagggcttcccggtatcaacagcccagcttgatttatttatgttgcgtttatagttgggttgtgggtttccgatcacaggatgaatcggccaactgttgcgcgaagggcgatcggtgcgggtcttcgcgtattacgccagctggcgctaaagggcggatgtgctgcatactggcgattaatgttggcactgataacgccagggtgtcagtcacgacagtgcttcatgtggcagaaaaaaaggctgcaccggtgcgtcagtcagaatatgtagatacaggactcactataggtccgcgaattcctcgctctgagctcgctaccgctcggtcgtcgatgcggcgacggaagctctag

SEQ ID NO: 12440 - DNA, 630 bp, Glycine max
  Peptide Sequence Number=SeqID_104125
atggtgaaagttggaacctcttacgtgccgatcaacgtctcatttcgccaaaagttggcccaggctgtcgttgcctggcaacatgacaccaggatttatttattcgatgttcgtcacagtggcgttctgtttctatcagctgttccctcctgttcagctactgaggaattgttccgctccaacggcaaaagcaccagccggacatcagcgctggcaagtgtaaagcgggggctgccccattccattcagggaaacctgtcggcaactgttaatgaggaacgcgcgggcgatgagtgcgggctttgcgtattacgcccggcgctaaagggggagtgtataggcttaatgttggcagatgcagggtgtcccagtgaacgtgcttcatgtggcaggaaaaaaaggctgcacggtgcgtcagcagaatatgtgatacgactcactattccagggcgaattgctgagctccaccgctggtgcatgcggcagcgctctagaactagtggcttaccccaacggggcaggaattcgaagatccagccaggaagaacccacagggaagtgagagtcgtgccgcggcacaagccgtttttccataggctccgcccccctgacaagcatcacgaaatctga

SEQ ID NO: 12441 - DNA, 339 bp, Glycine max
  Peptide Sequence Number=SeqID_104126
atggtcattctgtgtctcgccgcccaggctcgattgtgtccaacaaaatgcagagacaaattatggttctactggcaggaaggttcactggccgaatggtgtttcaatcgaacgaaattagtgtcttatctttacttcccttttatctccaataaaagacaagtaaagaggggcaattttcataccctaatttcgtccggagactatccgttgttgggatgcaaccctcgtttgaccacttcgaggtacttggcacccatcgttaggcaattcgtgaagttccgtgacatgccggaagtcaaaagaaagcattgtagcacaatccgtgaagttccgtga

SEQ ID NO: 12442 - DNA, 333 bp, Glycine max
  Peptide Sequence Number=SeqID_104127
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagttccctgtacggcataagcgcggcggggggtgtacgcgcaagcataagtgttaccgctcactctgcccccagcgcttgtccggcggtgctttatgccgttacgcaccaccccggtcagtatgtaacaggagggacagctga

SEQ ID NO: 12443 - DNA, 1070 bp, Glycine max
  Peptide Sequence Number=SeqID_104128
gtgctccagtggcttctgtttctatcagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatccttgtgagaaatttcggcacacaaagtttcaagattatacaaagagtccacaaggcgtgggaaagcccgttaaggaaagataaagaacttaggggcattcgtaaaggcatcatcggtggttatcatgaatggctgaaagttcgtacacgagggttagattggctctccaagttgaaaattatcaatgaggagaacttcgaagctccggaagaggatgaagaagtccgagctctaaaaaccgaactaggaaaagcaagacttgccaaagaaaaattcaagttggtcgctacagacgtccggaaagagtgtgctgagttacgagaagaaaatgcagctactgcaggagcccttgaacaagaaaccaagagggctcgcaaggaagagcatggccgagacaaattccgtggagctttgtggggcagcaacagtgagctcaagcttcgaagggaagagagagaccaatcacgagcacatagcatggtcttgaaagaggagttagctgcttggtcaaggtccaaaagaagcttgtctcagtgtttatgtgagacagagaccaacatgttagccattgtcaacaggtaccaagaagaactaaatctatccacggcccacgaccataaagtagtggacgagtatgcccgagtgtacgcaaaaaaggtggctagaggaagggtgatcgactcattacatcaagaggcaacaatctggatggaccgatttgctcttaccttgaacgggagtcaagaacttccccgaatgctagccaaggccaaagcaatggcggacacctactccgcccccgaggagatccacggacttctcagctattgtcagcatatgatagacttaatggcccatataattagaaaccgctag

SEQ ID NO: 12444 - DNA, 619 bp, Glycine max
  Peptide Sequence Number=SeqID_104129
tcaaggtgcaccttttgagggcaccattgttgatgactggaaatttgattattctagtcatgatgctcgccgaatggtctgcaatgaccaggctgaaatgaccgcacaagcctctgaggaggatttgattctgatgtgggcttttctcaccggtcgtcatatcgactgggcccatttagttcggtaccgaatgcataaggcattacgggccaatgcacctctaccttacccacagttgataactttgtttctgcgtcattttcaaattccgcttgatgatgagccatttgttcaagtcaagtgttcctttgcaattggtgctggtgctgtgacttcttttggttaccgtaaggatcggaatggtcaatggctgaagaaagacgcactccctcctcaagatgagcgtactccttcacctcctcctcagcgtgaagattcagcactcctgaatgaagtccttaccgaattacgaggtcttcgttcttatgttggtgaacgtttcgactcattggatacacgctttgccggcatggatattcgcctcacacaagttgaagaagatgtctccttcatccgtacttgctttgatccaccaccaccgcctccatcatccttttag

SEQ ID NO: 12445 - DNA, 558 bp, Glycine max
  Peptide Sequence Number=SeqID_104130
atgaagcacttcactgacaccctcatcagtgccaacatactggtaccgggccccccctcgaggtcgacggtatcgataagcttgattcccgagaattgcatctactcgtcgcgaaccgctttcatccggcacagtatcaaggtattttatgcgcgcacgaaaagcatcaggtctttccttcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12446 - DNA, 207 bp, Glycine max
  Peptide Sequence Number=SeqID_104131
atggagcaagttagcataggacaccagaactgggggatggcctttgtggataactgggtggtaggtaaggagaagggttgttattggctaagtaatgacattgttgggaaatttggctgtataggaatggcagtcactgcatgggtttctccctcatcctcaccctcttcatttgccccagttttctcattcgtccaagcaggatga

SEQ ID NO: 12447 - DNA, 805 bp, Glycine max
  Peptide Sequence Number=SeqID_104132
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaaggctttgggctaccgacctttgaggcttttgcgccacctagtgacaattgtgtgctattacaacacattgatgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12448 - DNA, 180 bp, Glycine max
  Peptide Sequence Number=SeqID_104133
atgggtggtggtgcatggccgttcttagttggtggagcgatttgtctggttaattccgttaacgaacgagacctcagcctgctaaatagctatgtggagggcacgccgcagcagattcgacacgatgcgaaggtgatcgccgcttatctcggcgcggaagaggagagcgagcatggctga

SEQ ID NO: 12449 - DNA, 869 bp, Glycine max
  Peptide Sequence Number=SeqID_104134
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctctagttgccaggttataaccttgcaactggagcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12450 - DNA, 737 bp, Glycine max
  Peptide Sequence Number=SeqID_104135
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccatcacacctcactcctgagggagctattatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12451 - DNA, 650 bp, Glycine max
  Peptide Sequence Number=SeqID_104136
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgagccctggtgcagcggtaaagttgtgccttggtgatttgttggtcatgggttcgaatccggaaacagcctccttgcatatgcaaggtttttctaagacccaggagcgggtgactgctgatgtttcagaggtgagtgaatgggaagatgatgacccaaccatttttgtgatgacaatagctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaagctgcaccg

SEQ ID NO: 12452 - DNA, 603 bp, Glycine max
  Peptide Sequence Number=SeqID_104137
atggttgggtcatcatcttcccattcactcacctctgaaacatcagcagtcacccgctcctgggtcttagaaaaactttgtaccccattgcccagaggctcttcgctatgcgaaggtatggaggagggatattgtacgcaaccttacccttgcatatgcaaggaggctgtttccggattcgaacccatgaccaacaaatcaccaaggcacaactttaccgctgcaccagggctcgccctctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12453 - DNA, 597 bp, Glycine max
  Peptide Sequence Number=SeqID_104138
atgggctcaaaaatctaccctaaggttcatgagaaccctagggccttctttagtagctttagcccaagcctcttggagtcttttatccaatacccttggggggtaggattgcatcattgtgcatctgtggaaacaagtccattgctaccttgtctctctaatgcggccctgatggtggcgcgggtaatgctcaggcacggttatgagcccggaatgggtatgggcaaggacagccacgggaattccgatgtggtcgacgttaggggtaacccacacaaatatgggttggggtatgagcccgggaaacctggaagaaggaatgcatcatcaagactccgggcagatagggcatggcccagtcatgttagccagtgtttcacaagtgtcgggataatgttcgaggaagaggtggtggcaataggagaagaggcttcacaagatccgtcgagtttcgtgcgaccgtgtcatcccaatttccaagtggggaactggcacgtgatgagccagtcggaagtctataccgctgattcaatatgtgaggatagatcctttgaggatcctaacaacgagggtttgataatcgattttgaccgagaa

SEQ ID NO: 12454 - DNA, 422 bp, Glycine max
  Peptide Sequence Number=SeqID_104139
atggtgggtcaccccctcggatacccggctaccatcatggatttgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12455 - DNA, 543 bp, Glycine max
  Peptide Sequence Number=SeqID_104140
atgagttctctaaaggcgcagatgtggagtcctatgaaggcgagggcatgcagccctacgaaggcaagggcgtgcaaccctctaaaaacgaggaagtgtagtcctctgaaggcgagggcgtgtagccctctgaaggaaaggacgtgtagtcctctaaaggcgaggacgtgtagtcctctgatggcgagggcatctagtcctctaaaggtgagggcgtatagccctacgaaggcgagggcatgtagccctctaaaggcgagggcgagtagccctcagaaggtgaagacgtgtagtcctctgaaggtgagggcgtgtagccctctgaagatgagaacgtgcagccctctgaaggcgagggcgtacaaccctctaaaggagagggtgtgcagccctctgaaggcgagggcgtgcaggccactgaaggtgaggacgtatagtcctctgaaggcgagggcgtgtagccctctgaaggtgagggcgtacagacctctaaaggcgaggacgcgtagtcctctgaaggtgatggcatgtagctctctaaag

SEQ ID NO: 12456 - DNA, 640 bp, Glycine max
  Peptide Sequence Number=SeqID_104141
tgtatgatggtgtttctgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggatgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12457 - DNA, 309 bp, Glycine max
  Peptide Sequence Number=SeqID_104142
atgcaaagaagatctactgcaggtgatttgatccccattgatttggagattaacgccacttgcagaaggcgaaatcaagagagaattagaaaatttttgcaggatttagaagcaacaacaattctagagaaagaacctcaatcttctgaggcatcttctagttttcctattgtaggacattctcatctggatcctatcaaagaccacatcatggctgaagagccaagaagagtcaccctcgaagattattcaagttctaatgtgccacaatttttcaccagcattgcgcaaccaaaagttctagcataa

SEQ ID NO: 12458 - DNA, 231 bp, Glycine max
  Peptide Sequence Number=SeqID_104143
atggagcctcaaatcctcccttcgcagtttcttcgagctccatgtggagcttgtaggccttggatcttcttcatcaatggagtcctttgcttcttgaagatcatggcagcagaatggagaaggaggaaaggggattggagattccacttcaaggagaagatgagtcaagaacaagttcacagttcgcttccggcaagtgcaccggatcgcacaagtagtataaaatggtaa

SEQ ID NO: 12459 - DNA, 228 bp, Glycine max
  Peptide Sequence Number=SeqID_104144
atgtggagggtttttcaacaatgggaagaggtggaggatgtgttcattcctttagagcgagagactggggagaaaattcagatttgtgaggatgaaaacgggagaggatgtggagggtttggatatactattggatcatatttggattgggagaaaaagattacaaaggagagggtgaaggagggaaagaagtatgggatcattagggaggccaaaagggatggatga

SEQ ID NO: 12460 - DNA, 186 bp, Glycine max
  Peptide Sequence Number=SeqID_104145
tgggctaagcgcgaatccatcgctaagcgcagcttcaacgcgcttagcgcgacagaagaatctggcagggcatcaatatcaaggccgcgcgctaagcacgagatcagtgcgctaagcgcgacagttgtcttcagccaagctcagcgcacgactggcgctaagcccaaacccacttactcgctctaa

SEQ ID NO: 12461 - DNA, 171 bp, Glycine max
  Peptide Sequence Number=SeqID_104146
atggatcctggaggtgccaccacatctgggacagaaggagctgctgatgtggatgttggagtaggagctgcagatgaggaaggaagctcagctggcctagccctcgccctcctagcccctcagatagaaactatcagatcatcaggattccaacagttcttcctgatgtag

SEQ ID NO: 12462 - DNA, 420 bp, Glycine max
  Peptide Sequence Number=SeqID_104147
atgaagcacttcactgacaccctcatcagtgccaacatagctgcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12463 - DNA, 723 bp, Glycine max
  Peptide Sequence Number=SeqID_104148
atgggggtccagagcctcgccgtctattccgatgccgatgcgggcagcctgcatgtggcccaggccgatgaggcttactgcctgggcgatggcgctgccaccaacacctaccttgcgacggacaagctactcgatgtggcgcgcgccgccggcgccgacgcggtccatcccggctacgggtttttgtcggagaacgccgccttcgcgcaggcctgcgaagcagctggcatcgcctttgtcggccccacggcagagcagctacgggtgttcggcctgaagcacaccgcacgggcgctggcccgcgaacagggggtgccgttgctcgatggtaccgacttgctggatgaccccacagccgccctcgcggcggctgaacaggtcggctacccggtgatgctcaagagcactgccggcggcggcggtatcggcatgcgcgtgtgccggtcgccgcatgaacttcaagatgccttcactgtcgtacagcgcctggggcggaacaacttcagcgacgcaggtgtgttcatcgagcgatacatcgagcgcgctcgccacctggaggtgcaggtgttcggcgacggccggggcgaggtgctggccttgggcgtgcgcgactgctcggtgcagcggcgccaccagaaagtcatcgaggagacccccgcgcccaacctgcccgacgccgtcgcctccgcgctctgtgaggctgccgtgaggctggcgcgcgcg

SEQ ID NO: 12464 - DNA, 476 bp, Glycine max
  Peptide Sequence Number=SeqID_104149
atggcaggcaaggaaaatcttactctaaacaagccattgaaaaagcgtgcatcgcctaatgatgcctccacgacgagttctttaagagtatctcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12465 - DNA, 192 bp, Glycine max
  Peptide Sequence Number=SeqID_104150
atggttattactagtactattagtattgctcaagttgatgttatggatgagtttatacaatttgaagatcaagatatgtcacaagtgggtaaatctcaactaaatatcatcccaatcttgatgttttgcaatattggaaggacaatgaagctcagcttccagatctttcactattggcttgtgatattttaa

SEQ ID NO: 12466 - DNA, 347 bp, Glycine max
  Peptide Sequence Number=SeqID_104151
cccaggcacctcaacagcatgggccagaactagaaaatgatcactcatctaaagcctccatctctggagctattaattgtaaaaaaagaagattagagacgagatccaataaggctactcatcatggaccagtgccagcgtcagctgatgcaccatttccaagagtggatccatcttcacctcagcacgcaacaaactcttccatccctgtcttagagatacatgagggccaaaccataccaattctgcctttggacacttctcctccagctactccagtatggcatctaatagatgagaagaatgttcagatacaggacaatcaagaccagtcacaggaattttaa

SEQ ID NO: 12467 - DNA, 576 bp, Glycine max
  Peptide Sequence Number=SeqID_104152
gtcataggttgtaccatatgtggtggtactcatgaatccggtctttgcattccttttgaagagcaaacgcaagaggttagctacatggggaatcaacaaaggaaaggatacaatcaaggtggattcttaggtttccagcagggtccttacaaccaacaaggacagtggacatcacaccctggtaatcaattcaacaaagaccatgggggaccttccaacaggccgtctcaacaagggcctaacatttttcagaggacaatcaagctggaggagactctgactcaattcatgcaggatgaggatagggtggctttggagaaacaaattgttgtaaaggatggcactgagaaaaagaaagaggaggagaaagaaataaacgaccaaagaaaagaaatagaggtagaaaaagaaaaagaaaatgaagaaaaagaaaagttgaaaaaaataaagaagggaaagaaaagagtagaaatgagaaagcaagagggaagaagaaagaaaaagcttcaaatgaggatacagaagtaccatatcctgtggtaccttccaagaaggacaaggaccatcatctggtga

SEQ ID NO: 12468 - DNA, 396 bp, Glycine max
  Peptide Sequence Number=SeqID_104153
atggtgaaagttggaacctcttacgtgccgagtcaacgtgctttttcgccaaatggcccaggctccgatatcaatttcagtgcaccatttatttgttcaagcttatcgatccgtcacctcgagggtgttcccagtgaagtgcttctgtggcaggagaaaaaaggcgacggtgctcagcatgaatatgtgaatacgactcactatagggcgaattcctcgctactgagctccaccgctcggtggcggcacgctctagaactagtggcttacccccgggctgcggagatttcctggaatcgatcaggaagaggtcacgttttaaagggaagtgagagggccgcggcaaagccgtttttccataggctccgcccccctgacaagcatcacgaaatctga

SEQ ID NO: 12469 - DNA, 201 bp, Glycine max
  Peptide Sequence Number=SeqID_104154
atgatgacaacaaaagatgatgaaaaaagtgatgaacaaaaagctcaagtgaatcaaagaacatccatctcaagagaatcaagaacaagtcaagagttcaagaatcaagaagaattcaagactcaagaagaaagcctacaatcaagattcaagactcaagattcaagaatgaagaaaagactcaatcaagataagtattaa

SEQ ID NO: 12470 - DNA, 363 bp, Glycine max
  Peptide Sequence Number=SeqID_104155
atgagaacaacacacgatcttccttgtgcttgtgagctatccaaatatgttgttggttgtatcctattggattcaatccatatgttctggaggagactcagtttttcagatcaagggatatttgagcccaagacaaagcttcgaggaattgcataccctgatcaaaattcgatgtgttctcctctagcaaaggttaacacaaaaggtgcactgaagaaaccgatgaaaagaagcccaaggtcaacaaagttactgggatcatttatccatgtcttcattgataatatagttgatgttggagctgatggaaattgtggatatcaggcgattgccggtttattaggtatgagtgaagcctcttag

SEQ ID NO: 12471 - DNA, 923 bp, Glycine max
  Peptide Sequence Number=SeqID_104156
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaccacgatgagataccatctcacaccagttagaagggcgattattaaaaagtcaggaaacaacagttcaaccattgtggaagacagtgtggcgattcctcaaggatgtaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12472 - DNA, 450 bp, Glycine max
  Peptide Sequence Number=SeqID_104157
atggccgccagcagttctctcgaccatttgagcaaccgtatgaagctggagtggcactccaagctgaacacggagatggtgcccgcgaagaacttccgccgcacctccatcattggcaccattggccctaagaccaactcggtggagaagatcaacgctctccgcagatctgacaacgattcaatagccggtctcaatgttgttcgtatgaacttctcccacggttcgtatgagtaccaccagtccgttatcgacaacgcccgtgaggccgccagagtccagaccggacgtcccctcgccattgctcttgataccgcattgcagaaaggacctgaaatccgtactggaaacactaccgatgataaggatatccccatcaaggagggtcacgagctcaacatcaccactgatgagaagtacgctaatgctagcgacgaccagaacatgtga

SEQ ID NO: 12473 - DNA, 213 bp, Glycine max
  Peptide Sequence Number=SeqID_104158
atgggcccagggcttcccggtatcaacagggacaccaggatttatttattttgcgaaagtgatgttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 12474 - DNA, 570 bp, Glycine max
  Peptide Sequence Number=SeqID_104159
atgtcgacaccgcgccaaattcttgccgcaatttttgacatggatggattactgatcgattccgagccgttgtgggatcgcgctgaactggacgtcatggccagtctgggcgtggatatcaaccgccgtaatgaacttcctgatacgctgggtctgcgcatcgacatggtggtggacctgtggtttgcccaacagccgtgggtgggccccgaccgtgatgaagtgaccgcccgtattatcagccgcgcgatttccctggtggaagagaacaggccgctgctgcccggcgtacgtgacgccgtcgcgctgtgcaaagctcaggggctgaaagtcggcctggcctccgcctccccgctgcacatgctagaaaaagtgctcatcatgtttgagctgcgcgacagtttcgacgccctggcgtccgctgaaaaattgccttacagcaagcctcacccgcaggtctatctggactgcgccgcgaagctgggcctggatcctctaaactgtgtggcgctggaagattccgttaacggtatggtggcgtccaaagccgcgcggatgcgctccattgtg

SEQ ID NO: 12475 - DNA, 567 bp, Glycine max
  Peptide Sequence Number=SeqID_104160
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcacgcttcggtttaagccaagtgccaagttttcaaagggagtttctgttcgtgacatcaaggctacgtccgtaggcaagatggtgcgtgtcaagggtatggatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 12476 - DNA, 231 bp, Glycine max
  Peptide Sequence Number=SeqID_104161
tctccaccagaagatgcctacatctccggaaagggcgcagatgaccatattggcctccgcttatcaatcacacttgagggtgcggataaccgtaagggtgcggataaccgtaagggtgcggataaccgtaaggtatctccgcgtgtcatcgggtctccaccagaagatgcctacatctccggaaagggcgcagatgaccatattggcctcagcttatcaatcacactcgag

SEQ ID NO: 12477 - DNA, 144 bp, Glycine max
  Peptide Sequence Number=SeqID_104162
atgaaacttcttgtttgggagatccttctgtactttcttccaagggtttatggccaaagggttgaggttttggctaaaaaggcttgcggaaggcaagacatggcgtatgttaggggatttgcttggcaagtggttcagagataa

SEQ ID NO: 12478 - DNA, 997 bp, Glycine max
  Peptide Sequence Number=SeqID_104163
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacaatataatagagatggtggtggtgacaatcacggtggtgatggtggtgtgacagagatgacggtggtgatgatggtggtaatggtggtggtggtgctagacatgctggtgacagtggtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 12479 - DNA, 387 bp, Glycine max
  Peptide Sequence Number=SeqID_104164
atgagtgatggattttgcggtactcatttgcagatcatggttaggaacagaggattaggtcgtgccttaggtcaggtcactcgcagaggtgtgggcagaggagatcatgatgattccgatgatgctccacagcgtcgacgacctactgcatcctcacggaggcaacgagtcgctgtgactgcggatcacgtcgaggagccagtcatccctaacccagatgttcaggatgacccgatggaggcaccagctgctgtggaggacattcctgcggacgcatgcgcagaggcggctgaggatcagcctcagggatttccgggtggtccgagcgacccatctgtgctgacagcgtatacggatcatgttgcttgcagcgtatggacgggagag

SEQ ID NO: 12480 - DNA, 329 bp, Glycine max
  Peptide Sequence Number=SeqID_104165
atgtcgttcaccaaaggaaagatgtgtgtaaatcaacgcttcgaggccatcaagggatggtcattccacagggagaggcgtgtccagctcagggaagacgagtaccctaacttccagggagagatagctcgtaggcattgggcacgactattgacccctatggctaaatttgacccggagatagtcatagaattttatgccaatgcctggcccactaaggagggggtttgggacatgcgttcatgggtgaggggtcactgggtcccctttgatgcagatgccatcagccagttcttgggcgacccactgattttggaggaagaccagca

SEQ ID NO: 12481 - DNA, 324 bp, Glycine max
  Peptide Sequence Number=SeqID_104166
atgttgcagagccttcatagaggccaggttattatcatgcagagtttacagagctcaggcctgccatctattatgagcacagatgagttccttgcacaggtggcttggccaggagtccagccttctccttctggagggggtgaggcctccgcagcccaagagcctgtgccagcaaaggagcctatgccagatgcagaggatgagcctgttcctcctgagccatttatctttgagactgatccaatcgctcaggatgatgcagcagctcaggagcctacttctccaattcatatctctccagcacccatccctgaggattcctag

SEQ ID NO: 12482 - DNA, 994 bp, Glycine max
  Peptide Sequence Number=SeqID_104167
atgtctctgatgctatcggacttgatcgtttttggacagcagaagagcaacgctctaacctctgtagacgagctgaggaggactctggaggtggtggcgatgcgtctgttgcctactgctgatcatccccaggctgctgtggtgcctcaccctacgcctgctgatataaccctatcccccaagggggatgatgcagcccttcccccaagggtattggatagaagaatccaagaggattgggctatagctactaaagaaggccctagggttcacatgaacctcgggcatcctcttcaagcttcttatccaaggcacattcttggtggtgaagctccttcttccatggcttattccctagtggatggctctgatgatgggtggtctgatgaccttcttgggggtgatgggcaccctgtaggactgacaaaggcccataaccagagctggaaacccccaagaccctattggacttctctgggtctactgagtgtcttgcgggcggggagatcagagttgtggtcgctaggcagaatgttgctaggtagcaacatcgtccatgtgttggtgcacatgatccacactcgtctccctgcggcggtctgggcaaaatcttgccccgacctgccccctcctctagttgtgctcgcacagttggccgcccttcaagatcaggaggtgtggatgtggagccctctgaaggcgagggcgtgcagccctctaaaggcgaggacatacaaccctctaaaggtgagggcgtgtagccctcccaaggcgaggacatgcaaccctctaaaggcgagggcgtgcatccctctgaaggcgagggcgtgtaaccctccgaaggagaggacctatagccctctgaaggcgcagatgtgtagccctctaaaggcaaggacgtgtagtcctctgaaggcgagggcgtgtagccctctgaaggcgagggcatgcagccctctgaaggcgagggcgtgtagccttctaaaggcaatag

SEQ ID NO: 12483 - DNA, 180 bp, Glycine max
  Peptide Sequence Number=SeqID_104168
atgcctcaaaatgttcttacgatgccattgggatatatcaacggtgatcaagcttatcgcaataccgtcgctcggggggctccggtaccagcttttgttcctttagtgagggttaatttcgagcttggcgtaatcatggtcatcagctgtttccctcctgttcagctactgacggggtga

SEQ ID NO: 12484 - DNA, 189 bp, Glycine max
  Peptide Sequence Number=SeqID_104169
atgattatgaagggccaagacatttatagtagccaagatgaggctactacttcaccttcctctagtgaaagtgaagaagcaaaaggggaagaatctagtgaagaaatctacccccaagaagaaggacaaccattagtggttaaagagaagtgtaaggagatattattaggcaccaagtccctaaaatag

SEQ ID NO: 12485 - DNA, 369 bp, Glycine max
  Peptide Sequence Number=SeqID_104170
atggcttccggggcttcaaggactcccgtaatgcttccgattgcttctggaggaagcaacccaaacacaccaaaggtcccagtggagtcaccaactatcgcaacctaccctttggcgggagggcgacgtggggctcacgggtgtgtcttccaagggaggaaggcgcgcggagtcgccaccaacgtttatttggggaaaatgtcggaaaaactgaaaagcgagaaacgtaaggcgttggaccattacgatctcttgtttttgaaaggagagaacgttaaggcgttggaccattacgatctcttggggtggtcgacaaaagcggggcttttgctcctacgtatcctcaatgaggaactcagacctacgtag

SEQ ID NO: 12486 - DNA, 504 bp, Glycine max
  Peptide Sequence Number=SeqID_104171
atgcgaagtaaatcttctgtaggtgatttagttccattagatttggaaattgaagccacttgtagaagaagcaacgcagaaagaaaaaggaaaatactgcaggataggacaacaccaccaattctagaggaacctcaatcatctgagtcatcttctttctttccacagacaagggaatctataagaggggcacctaaggctaacataatggctaaagatcaacctagaagagtgacccttgaagactaccctagttctgctgtgccgcaatttttcattattatagcgtggctagaggttcaagcacataatattacttatcctcattctttgattcagctaatacagggaaatttattttatggcctaccaaatgaagacacgtatgcacacttagcgacttacattgaagtttgcaatacagtcaagcttgcaggtgtgccggaagatgttgtgtggctaagtttgttctcattttcactgtctggagaagcgaaaagatga

SEQ ID NO: 12487 - DNA, 249 bp, Glycine max
  Peptide Sequence Number=SeqID_104172
atgcttacccaaggttttcagaaattttacggaagcattacggaagccacggaagccccggaaactatttttcaaaaacgtggaggagcttgccgcccagttgcttcctccttaagcaacccaacttctaaaatgaactttacggattacctaacgatgggggttaagtaccttgaggcagtcaagcgaaggttgcataccaccaaacaatggtccccggacgaaattagggtatggcactatacatga

SEQ ID NO: 12488 - DNA, 655 bp, Glycine max
  Peptide Sequence Number=SeqID_104173
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccccaaattctatagggatcatggcatctgtgccatatgtgagtcaggccctcaggatgactctattggccgcctctgtctgaccatttgtctgaggaggatgctcgatagaggtgacaaggtgaacttctccacctcattgggtcgtaatctctcgcagtggtcttttcttgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 12489 - DNA, 594 bp, Glycine max
  Peptide Sequence Number=SeqID_104174
aagaagcaactgagctcatagagaacatgtcatccagtgatcatgccatcctgagggacagaacccatcaacccacaaagaagagcatgttggaactaacatcacacgacgccttgttggcacagaacaagtcacaggttgtaccatttatggtgaagctcatgagacagaccaatgcattcccactgacgataacactcaagaaattcatttcatggggaatcagcagaggcaagggtacactcaaggagggttttcaggcttccagcaaggtccttataatcaacaaggataatggaggatacaccctagaaaccagttcaataaagaccaaggtaacgatgtcgaatcataagagtactgagtcagcactaaagaaccttgaagtacagatgggacaactggccaagcagatagctgacaagtcatcaaatagctttgaagcaaatatggaaaatgatcctaaggaggaatgtaaggctgtgatgaccaagagtaaaaggtttgtggaagttgaggatgaagaaaatgtggtagacaaggaacaactgagtgaaaagacaggtgctgaggttaagaaaaatgatgtgaagg

SEQ ID NO: 12490 - DNA, 84 bp, Glycine max
  Peptide Sequence Number=SeqID_104175
ggatcggggtacaagaacttagttgtgtatgtgtgtcttaatgcggtcttagtcttacaagaggaatctgcggatgaggcttga

SEQ ID NO: 12491 - DNA, 501 bp, Glycine max
  Peptide Sequence Number=SeqID_104176
atggaaattaaaaatctcagccaaatcagctatctttgcttggagattgatcaaagacaggttaccaacaaaaatgaatcttataaggcgcaggtggtggtaaatgacaggttatgtccattctgtgaacttaaagatgaggaggcagaacacttattttttaactgcacctgtaccttacccctgtggtgggagtctatatcttgggctaatttaacaacaacactgccaattaatccaagagaccatttcctgcagcacacacttggagcagctggagtaaggaaccatacaagatggaaatgctggtgggtggctttgacctggtcaatttggaaccacagaaataaaatagtcttccaaaaccacacgtttaatgggagtagattaatggatgatgcagtttttgtactctggtcgtggtttaaaactattgagaaggattttgctgtacatctcaatcaatggtcctcaaacctaaaggaagcttttactagctag

SEQ ID NO: 12492 - DNA, 459 bp, Glycine max
  Peptide Sequence Number=SeqID_104177
atgggtgaagtagaggagatacaagagaagatgaaggccgacatggaggccattaaagagaaaatggccacaatgatggaggccatgatgagcgtgaagaagataatggaagccaatgcggttatagttgccactactagcgctgtcgctaaggtgaacccgatgctcccatctagcctcaagcaaatgaatcatccaacctcaaatatggcacatatctctcaaaccatgggggagacacaagaaattccccaccacaatctagctgacttcgagccttggctcggatatgccactgaagggcaagcagttggtggtataccctttgaaaacactttggagggccctcagtatcacccacaactgcacctcttgcattccacagcggataaaaaccctcatgactatggcaggaatgggaaagttggatcatctaaaggaaaggctcagggccattga

SEQ ID NO: 12493 - DNA, 349 bp, Glycine max
  Peptide Sequence Number=SeqID_104178
cgtctcctctctctcttccttctctattccactgccattcattttccaagaagcaaaggaatccattgatgaagaagatcctagttctacaagctccaatggagcttacatcacatctcttgacgaaagaaaaagtgcaacttcaatgaggtccttcaatggtgattttccaccatcgagatgtagcggaagacaaaggagaagaggtgagaggaggcgccatccactagggaataagccatggaagaaggagcttcgccaccaagatgagccttggataagaagcttggagaggatgcttcaatggaggaaaagaaagagggagagaaagagagaagttgaactttga

SEQ ID NO: 12494 - DNA, 796 bp, Glycine max
  Peptide Sequence Number=SeqID_104179
acgctccctcaatgagtcaatcccttgctttctcataaggttggaccccttcataggattgtacgtcctcgccttcggagggctacacgtcctcgtcttcaaaaggctgcacgccctcgcctccagagggctatacgtccttgccttcagagggctacacgtcctcgcctccagaggactgtacgtcctttgccttcagagggctacacgtcctcgccttcatagggcagtacatccttgccttcagagggctacacgtcctcacctccagagggctgtatgtcctcgccttcagagggctgcatgtcctcgccttcagagggttgcacgtcctcaccttcagagggctgcacggctacacgtcctcaccttcagagggctgtacgtcctcgccttcggagggctacacgtcctcgccttcagagggatgcatgtccttgccttcagagggctgcatgtcctcgcctccagagggcttcacatcctctcctttagagggctgtacgtgctcatcttcggagggctacacatcctcacctttagagggctgcacgtactcgccttcagagggctgcatgtcctcgccttcagagggttgtccgtcctcgccttcagagggctgcacatccttacctttagagggttgcacgtcctcgcctttagagggctgtacattctcgccttcagagggctacacgttctggcctttagaaaactcaagttcctgggccacccccctgatcttggaggagggccaattgttcgagcacagccagaggaggaggctatcacatag

SEQ ID NO: 12495 - DNA, 93 bp, Glycine max
  Peptide Sequence Number=SeqID_104180
atgaacagcagaaaccaacccaaggtacttaggaacggatgcaattggggatggggtcacgatcgactgatcgccaccccttctctgcgctaa

SEQ ID NO: 12496 - DNA, 207 bp, Glycine max
  Peptide Sequence Number=SeqID_104181
atggtgaagcagaattctggtctatcagaaacacaaaggggaactctgggagagaagggtcctagagtctcgaccatggccttagaacaagagcttgtgagggctttcatcattgtggtggggtttacgcagtttgtttatccacgtgtatgtgtcatgtggacaggaggtggcatcactggaattggttcacggttttttaagtga

SEQ ID NO: 12497 - DNA, 216 bp, Glycine max
  Peptide Sequence Number=SeqID_104182
atgtcctcacctttagaggactacacgtcctcgccatcagaggactacacgtcctcgccatcagaggactacacgtccttgccatcagaggactacacgtccttgccatcagagggctacatgccctcaccttcagaggactacgcgtcctcacctttagagggttgcacgtcctcgccttcagagggctgcacaccctctcctttagtgggctag

SEQ ID NO: 12498 - DNA, 495 bp, Glycine max
  Peptide Sequence Number=SeqID_104183
atggcttccaactcccaacagtttagcgccagaaatgatgctatagtcattagaggggtgcatgaggtagccacaaactcatatgcatcatctgaaactaagaagcttgaaggtaaactagatgccttggttaacttggtaacccaactggccatgaataaacaatttgtacctgtcgcaagactctgtggtttatgctcctctgtcgaccaccacacagacctttgcccttttgtgcagcaatctgaaacaattgaacagcttgaagcttatgctgcaaacatttacaatagacctcctcaacctcaacagcaaaatcagccacaacagaacaattatgacctctccagcaacagaatgctactggcccaagcagaccataagttcctccaccaatccagtagcagcagcaacaacaacaacaacaacaacaatggccgcagaaacaacaaacagttgaggctcctccgcaaccttcccttgaagaacttgtga

SEQ ID NO: 12499 - DNA, 309 bp, Glycine max
  Peptide Sequence Number=SeqID_104184
atggcttctaggaaacataaaagtattggttcaagacccacagtgcagtatgacacaaggagattctcttccttagatgcttgggcccgatacatagataatgtcttggggagaaacattttaccagagaggaaagtagagatatatcacactgagctggatgagtttaaggctgaattaaagaggcataatttccataaacgcctcaccaatttagtcgatgggagcatagacctggctttggtgaaagagttctatgcaaatttatacagttctgaggaccatacaccaaagcagtccaaagtctga

SEQ ID NO: 12500 - DNA, 166 bp, Glycine max
  Peptide Sequence Number=SeqID_104185
atggccactcctataagcactgcttgctatctggataaagatgaaaccggtttgtcaatagacataaagaattatagagtattgatgcaatcctccctaggaagggaccagtcactagagccgggtaccgagctcgaattcgtaatcatggtcatagctgtttcct

SEQ ID NO: 12501 - DNA, 513 bp, Glycine max
  Peptide Sequence Number=SeqID_104186
atgaccggccctctcaacgagtcaatctctttctttctcataagggtgcaccctttgggcactagtaccctcaccttcagaggactagacgccctcgccttcagagggctgcatgtcctcacctgcagaggactacacatcctcacctttagaggactacacgtcctcacctacaaaggactacacaccctcacctttagaggactgcacatcctcaccttcagaggactgcacgtcctcacctttagaggactacgtgtcctcaccttcagaggcctgcacgccctcgcctttagagggttgcacaccctcaccttcagaggactacacgtcctcgccatcagagggctgcacgccctcaccatcagaggactacacgtcctcaccttcagagaactgcgcgtcctcacctttagaggactacacgtcctcgcctttagagggttacacgtcctcactttcagtgggctccatagccacaccttaagagaatttaaggtcctctgcccttaa

SEQ ID NO: 12502 - DNA, 401 bp, Glycine max
  Peptide Sequence Number=SeqID_104187
ttcctgaaccttctcatttcgaaaacatcaaggtctccacctccttctcattcgtcaccacactcacctcccctttccctccctccaacgcacagtttcaagaacccaacggcgcaaccctattcggttcactcctccaattccttcacgagaccgtgtcgattattgtgaccgaaactggctggccgagctccagcgctgccgctaacgagttcgatacgaatttagggtatgccgagatatacctcaagggtttattaatttgcatgcacggcgggacttcttcaaggagaggaagcacgagaggttcgagttgcttgggtctatcgccagatggagggattcctcacaccaccgcgacttcaaccgctggggatccgccgagtttcgccgaccgctag

SEQ ID NO: 12503 - DNA, 387 bp, Glycine max
  Peptide Sequence Number=SeqID_104188
atgtgcagtaggaaagtgataccgagagaggcggtcttgatgaagattagagccgatgtggatgcaagaagagagagcactactataactggtttaattgttaggttccagaagaattcacttcaacacttcaagaagccttctgctcacaaacatgagcctgttaatagtctgcaagaggcagtcaaggttatcttagatatgtccttaatatgcttgattattgcacactttcaagtgatcaagccaacaattatgattagatcatcaagaatgggaataacatttacaaaggaagtaattgaggctatggattcaaacaatgatgtaaaaccttgtgtccctcttgttgtggatgagtatttgtgtgagtatttagatgtatga

SEQ ID NO: 12504 - DNA, 264 bp, Glycine max
  Peptide Sequence Number=SeqID_104189
atgaaggcatggtacactttggttcaagggctaataaatggaaaagcagtttgtgggaaaggtagaggagggaaaagagagggtaatgaaacaatgttactagttcataaaaaaatatatcatcaacattgccaaagagaaagatgggaaaacgtagcaaatacaatttatagtgaaatggcatgggatagcgggcctggggagattatcatcatccaggggagagatgtgtggctaagaactgatcagcaggagctttcatag

SEQ ID NO: 12505 - DNA, 330 bp, Glycine max
  Peptide Sequence Number=SeqID_104190
atgaccatgattacgaattcgagctcggtacccttagcgcacagccaacccactcagcgaggacattgtctcttctcacccttagctcgttcaagcctgcttagcgcatatccacttactctcgctcagcgggacatgctcgctgagcgcgccttcagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12506 - DNA, 347 bp, Glycine max
  Peptide Sequence Number=SeqID_104191
gatacgtaggagcaagagccttgcttttgtcggccgccccataatctttgtcatactgaccctgaggtcatgtgacatgcaccctgagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 12507 - DNA, 574 bp, Glycine max
  Peptide Sequence Number=SeqID_104192
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgatgcagaagctacaagctgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12508 - DNA, 183 bp, Glycine max
  Peptide Sequence Number=SeqID_104193
atggctacttcagagccttctgcaccagtggtaaacctaccctcacctcagcctgcagcagacccctccactcctcttctacagatgccagaggacccaactacaccagtccttgctgtggacacttctcctcccattactccagttcttcagctaacagatgaggaggatggtcaaacatag

SEQ ID NO: 12509 - DNA, 384 bp, Glycine max
  Peptide Sequence Number=SeqID_104194
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccattgtacggcactccgctatggttgctgttgcatacactgtctgcaatgttgtttctcctcttgaacatcccttcactttatggatttgagcttgttctctgggtaccgagctcgaattcgtaa

SEQ ID NO: 12510 - DNA, 1002 bp, Glycine max
  Peptide Sequence Number=SeqID_104195
atggtcgtgaccgtggtcatggccgtgatcgtcgccatcggcgtgcacgtgcgcgccattgggaatgccgtagttggtgcggtaggtgctggccgatacgccgaagtagccgccgtcgcccagccacgttgcgccgacgccaccggcgcgggtgcggatcgagctgttgtccaggcggccgcgacgcggctcttcaccctcggccgcgtcatggtcgtgatcgtggtcatgatgatcttcaaggctgtcgatcactgcataaccggggatgcggtagtcgtcgccattgcggaccaggccatccacgtgcagcacgacattgccgctgacgccgtcgaggcggaacatgccgctgcgttcgttgttcaccgaattgccgcgcagttctgcgcggccgctcagcgggcgctccggcagttcgcgcgcgatgcggccatcgaccacattgaccgcaccaccgatggcgccgctgccgaacagcagcgtggccggacccttcagcacttcgatctggtcggccaggaacggctcgatgctggtggcatggtcggcgctgacggtggatgcatccatgttgcccatgccgttggacagcacggccacgcgcgggccttcctggccgcggatgatcgggcggccgacgccgggaccgaagaaggtgctctgtacgccgggcagcttggccacggtatcgccgagggtgccggccttctgctcgtccaggcgttcaccggccagaacctccaccgggcgtgccagcgattctgcgtcgccctgcagcggcgacgcggtgacctgcaccgacgacagttcagtcaggtggcggtcacgatgggaatcgtcttcgctggcggcgaaggcaacggtcggaagcagggcggtcagggccagggcgagggaatgcggcttcaaccgcggggtacgggcgggcatcggtgggtcctttgttacactgtatcaatcgctgggcgcacgcatcccgtcagcgggacagggggaggg

SEQ ID NO: 12511 - DNA, 759 bp, Glycine max
  Peptide Sequence Number=SeqID_104196
atggttgcgtcctgtactggacaaggtaaacataacaaccgcagcacccggcgcggaggctcagactccggcagcgatttcctcaccactaaattctcctcccttcctcaagaatctgattcgaccgacgtgcagaacggtgcgcgtagctgttccgtatcgttatccgataaagcaagcaatggcttacaaggaagccaaccctctgatgttcgtgcgcataatcgtgccgaagctggcgcgtgtgatgaataccaacaactcaaggtgctatccatgggaagacaaaaagcagtgatcaaagctcgtcgcgaagcaaaacgtgtgctgagacgggattcacgtagccataaacagcgtgaagaagaatcggtcacctcgcttgtgcagatgagtggcgtagaagcaattggcatggcccgagacagccgtgataattctccaattgtggcgcgcaatgaggctcaggcgcactacctgaatgctatcgagagtaaacagctcatctttgcaaccggtgaagccggatgcgggaaaacctggatcagtgcagccaaagcggcggaagcgctgattcataaggacgtggagcgcattattgttacccgtcctgtactgcaggctgatgaagatctcggcttcctgcccggagatatttctgagaagtttgctccgtacttcaggcccgtctatgacgtgctggtgaagcgactgggtgcatcctttatgcagtactgcctgcgaccagagattggcaag

SEQ ID NO: 12512 - DNA, 288 bp, Glycine max
  Peptide Sequence Number=SeqID_104197
atgttgccaaatgtgcataagggtccccatttggtaatccttggaataagttcccctgtattaaatgtatcaaagaatgagggtagtttatgttgtgagcttgcacttcaggacgtgcaatgctggctgcaaatttccttgatgatggtgaatcagatgatgacaaatcagatgatgacgaatcagaaagatgagtttcttcctcaagaatggatgctattgtcctatcttgtagtaattttcttctcctctcaatgtagcttcaatctccaagtccagaggaactaa

SEQ ID NO: 12513 - DNA, 300 bp, Glycine max
  Peptide Sequence Number=SeqID_104198
atggctcccatgatggatggcatgctaggaatgaggcaacttatggagaataacgtggccaccactgtcgttgttagttcggctgctgaagcagacctaactctcctagctaccgcacaccatcctcacccaaacgtggcagaacgagaaagaagcacactggggcacctcagcaacctccatcggggatacaaccgagtggcttacccttatggattaccacctaattacacgccaccagtcatgcgtgatgtcgcggatcatgtcccttcccccatccttgaagtggagcctccttga

SEQ ID NO: 12514 - DNA, 369 bp, Glycine max
  Peptide Sequence Number=SeqID_104199
atggcgcctaccaggcaccctctggacccagataagtccaacagggccctaagaattcccgccttgatcacaggactctgccagtcgttcgaagtacccgtcgcacctagcaagagacaggcccagggagatgctccgcaggccgcagacgcgccgccacctcatcaggctggcccagctggatcgtttgatacggagcagtatttgcggcatttggttcgccagcaggcggccaaccaccgggcgcatgtacagacccatgattgtctttaccagttgagcctcagcctgcagagcaagggttttacttcttttccgtgccctactctggaccagtacaggaaaagtttgtcatgtataataatgtag

SEQ ID NO: 12515 - DNA, 438 bp, Glycine max
  Peptide Sequence Number=SeqID_104200
atgatggtgacccgggtgatgttggggtacagctacgagcccggaatgggtttgggcaagaacaacggtggcagaaccagcctggtaagcactagaggaaaccgcaggaagtttgggttaggctataaatctacgcaagctgacataaggaaaaatatctcggaaaggaagaacaaaggccagggcctgcgatcgggacagcaagccaaagaggccccaccctgccacatcagtagaagctttacaagtgcgggtttaagaatcgaaggccaagtcaccgcgatatacgaggatgactccccaaggagatcggatttggtacagctatgtcctcccgatttccgactaggaaattggcgagtggaggaactcccggacgtttacgcgacaagcataatgtatccttttgtaattttaaaactctacggatgggcctag

SEQ ID NO: 12516 - DNA, 156 bp, Glycine max
  Peptide Sequence Number=SeqID_104201
atggaatgtattgatttgcgtcatgagttttctgctgaggttaagcaagtagaagcggggagacattgcggcagaagaaatcctaatcgtcaagcgcgaagatgggatcaaccatgtggcacatcctcacaacatcacggacaccataatgaatga

SEQ ID NO: 12517 - DNA, 192 bp, Glycine max
  misc_feature (179)..(179): n is a, c, g, or t
  Peptide Sequence Number=SeqID_104202
atgcaaaaaataccaaaaataaggggcaaaagggtcttttacttggttttcttggaccctagctcgcccaggctagcctctagctcgtctaggccaccaaatagcttcatggtgaagaaaccagctcacctaggtgagctcactgcttcagggcatcctaggggtgttttaaagggttncaaggttcaggag

SEQ ID NO: 12518 - DNA, 198 bp, Glycine max
  Peptide Sequence Number=SeqID_104203
atggatttgaggtcaaatccttttcaaggggtagggaatgatgcaatcctaccgcccccaaaggcattggatagaagactccaagaagattgggccagagatgcaaaagaagaccctagggttctcatgagccttagggtagggtaccctagaaatgtaggatttttcagtccttgtattttagggcacctagactag

SEQ ID NO: 12519 - DNA, 331 bp, Glycine max
  Peptide Sequence Number=SeqID_104204
caccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggctccctctccggaatcgaaccctaattctccgtcacccgtcaccaccatggtaggtgacgcaataatatatccaatgtgcccgccaaatttcgtgacaaacaaccaacggcaaggcatactttga

SEQ ID NO: 12520 - DNA, 396 bp, Glycine max
  Peptide Sequence Number=SeqID_104205
atgacaaccaaagaagaagatgatgattttagtttcttcgtaaaaagattcaacaagtttctaaggaacaaaggaaatcaaagaagaacaaatttcaatccaaagaaaaaaggagaagactctccttctattccaaagtgctatgaatgtaatcaacctggacatctaagagttgatttcccaagtttcaagaaaaagatggagaagtctaacaagaaaaatttcaaagacaagaaagcaaagaaaacttacatcacttggaaggataatgatatagattcatcaggagattcagaaaatgaagtcgtgaatctgagtctcatggccaaaaactatgatattgaagaagaggatcagtcaaacttgccaaactggtttcagtttctaagaaaataa

SEQ ID NO: 12521 - DNA, 561 bp, Glycine max
  Peptide Sequence Number=SeqID_104206
atgaggcaaattacttctgttgaagacaaatctatgataaagaagcagattggtgacttcattcgtagaactaaagacatagataatagaactatagggccacatacggtgtcatttaggatgagtatggcatggttacatgttagtaagtgtaagcaaaagccacagggacttagtgtatctttctgtaatcaaacaatgacaatggaagtgagatctaaaacaatggcgcggagaattgaagctttcctcgtacctcgatcaggagcacgacttccacaaaccaactccttgcaacacacacaaacaaacatccttgcagtgagcagaagttcctcaaacaaagaaacaaagaaaaagaagaagaagaagacaacaaagactaaggtccttgtggttacaaagaagaagaagaagaagttgtacctaggtaatgtggctacgtgtcacggtcacgaagaagaagaagtaaagaagaaaaagcgaagaacaaagcgcgaggaaaaaccgatgttaattaaaaccgatgttaatatatcataccttaacatcggtttttga

SEQ ID NO: 12522 - DNA, 156 bp, Glycine max
  Peptide Sequence Number=SeqID_104207
atgcttgccgcccagctcgcccaggcgagcttagctcacccaggcgagcagcatgtcccggaatttcacaaattgcctaatgatgggtgccaagcaccttacaaggaccaaacaaaagtcgcatgtcatcaagcaaaggtccccggacgaaattag

SEQ ID NO: 12523 - DNA, 504 bp, Glycine max
  Peptide Sequence Number=SeqID_104208
atgtctaccagtttgtggtggggacatcacaaaatcgtctgcagaatccttggaagcagcatctttgtacgagcaggcagcaattatttccttgtttattgtgccatgcacaatgtcaacaactttaacataaaagagatgaagaggtgccctcttacgaacaaagaggataggcttacaggcataagtgtccctcacctgagaagtgcttcacaggcaaatgctcttccagtcattggagtcaatcttgtagaaagcataatactcctcctttgtgatctcctaaggctctgtcatccaaatggccttatccttctttttgtagttgtgaaaacaaagtcctttaaaggtttccccctcacgaaggatttttcctttcacagcaaactaatgttcaatttacgaatgaatgataaccaaccattagtacctgtccataattcacacgggattgctctttcccaaatctgcccgaacaacttgaatggaaatgttttgacataa

SEQ ID NO: 12524 - DNA, 243 bp, Glycine max
  Peptide Sequence Number=SeqID_104209
atggcagaaatcgaccaaggtaagacgatgaccggtcacgattggtcgcatatcatttggctcttacttgcaggttcaagaaggcaaacgctagcccgtaagggagcaggggacatggttagctcgcttgggcgagctgagctcgcctgggcgagcaacccctgcacccaaattctaaaaaacgagggaggggaacattttggcatccaaaaactccccccccccccctcattcaaaagataa

SEQ ID NO: 12525 - DNA, 72 bp, Glycine max
  Peptide Sequence Number=SeqID_104210
atgaattggaaagaagagagcaaggtgaatgctgtgaaaattttcccggacgcccgaaatggactcggataa

SEQ ID NO: 12526 - DNA, 294 bp, Glycine max
  Peptide Sequence Number=SeqID_104211
atggggaaccatcccagaaacaattttaatgcaggtggattttccggattccagcatggacaacaatacaaccaacaacagggacaatggaggaaccatcccgggaatcaatttaatagagaccagtggggatcatccataaggctgcaaccacaagggcctagtctctatgatcacacaacaaagctggaagagactctagctcaatttatgcaggtttctatgtctaaccagaagagcacagagtctaccataaagaatctggaggtccaagtgggacagctcgcaaaatag

SEQ ID NO: 12527 - DNA, 813 bp, Glycine max
  Peptide Sequence Number=SeqID_104212
atggaacttggccttagatgggaagcgttaaacggcaatttctccaacgtgcttttgggaatcacatgtaaactggaatcgttatcgatgagtaccttggccacgacgtggtacatgcatttgactgacatatgcaaagccctgttatgccctctccccttggcggggatttcttcttcagcgaagattaactcgcctgcctcctctagcgatacttctttcttgccacagccatcctttttcttcgaaaaacctttcactggaatattctcatttggagcaaggatcactttgtcattttgttcttccgctatctttgccttccctttaacgcttacgggtggtgtcgacagatcagggggcacgaacacgcaaccgttgtgggtcatgccactcagccccgtgatatttgttaccttggccgataacgagctgatgtcaatggcttcttccttcctttcgcttggaggcgcatacctccacggaactgcgtggctatttttgtatgggaatggaacaggtctaactactgaggggtactggggcatttggggagctgcgtctctggagaaatatatcactaaaggtttaggctttctaagaccctcctcatctgtggattgcatgcatatgtgcggctcttcaccctcttcattgctgatttccaaatggccttggtctattacctgttgcaacaagtcttctactgctaaacatgcttccatgttatgttgcacgccgggatgcatcaaacaggaatcttcctcgtgcccaccggggggaattacgcctcctttttgtagggcctcgtag

SEQ ID NO: 12528 - DNA, 49 bp, Glycine max
  Peptide Sequence Number=SeqID_104213
atcaaacgtttgcctcaaaacaaagtgtttccaagagatcaaggctctg

SEQ ID NO: 12529 - DNA, 111 bp, Glycine max
  Peptide Sequence Number=SeqID_104214
atgaagaatgttccagattcgggagttatatttacgtttgaggaaggtcgacaaaagcggggctcttgctcctacgtatcctccatcgaagaggaaatcaaaccgacatag

SEQ ID NO: 12530 - DNA, 201 bp, Glycine max
  Peptide Sequence Number=SeqID_104215
atgatggcccgagtgatgttgggtaatggttacgagcccgaaatgggtttaggcaaggacaatggcagcataaccagcctgataagcgctagaggaaaccgtgggaagtttgggttaggctataaacccacacaagcggacataaggaaaggcattgcaagaaggaagagcggaggtcaaggctcgcgattgggacaataa

SEQ ID NO: 12531 - DNA, 156 bp, Glycine max
  Peptide Sequence Number=SeqID_104216
atgggacaccttagtgatcaaggggttcccatgaaccctaagagaataaaggtcattcctgagtggcccactctaccaagtgttgagggaaggagcccagagtatgaagaacctcaggatttgaggtcaaatcctttccaaggtggagggaattga

SEQ ID NO: 12532 - DNA, 288 bp, Glycine max
  Peptide Sequence Number=SeqID_104217
atgaccatagattcactcactcttatgttcccacggacccagtccccagtggagtcgccaactgtcgcaacctacccttcggcgggagggcgacgcgagggctcatgggtgcgtcttccaagaaaggaaaatgcatggagttgccaccaatgtttatttgaggaaaacattggaaaaaccagaaaaggtgtggtctacgcaaagtgtgaaaaggttcgggagttgtttttatgcacgaggaaggtattagcaccccacgcgtccatcacaagggatggcagcctttaa

SEQ ID NO: 12533 - DNA, 394 bp, Glycine max
  Peptide Sequence Number=SeqID_104218
ttggccgctacacacgttcggaaggagtgtgccgggttacgggaagagaatgcaaattaccgcaagagccattgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctcttcgaggtccaaaagaagcgtgtctcagcgtttatgcgagacggagaccaacatgctagctatcattgccaagtaccaagaagagttaggtctagccgcggcccacgagcataggattgcggacgaatatacccaagtatacgcgaaaaggctagaggaagggtga

SEQ ID NO: 12534 - DNA, 546 bp, Glycine max
  Peptide Sequence Number=SeqID_104219
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgctaacacttcacggcgtatgtcttgtgctaaacctgaaacaaaacagcttaacagaaaaggtggtggcaagccgataacgcgattagctaaccgtttgaactcgctgggaaatcttgaagatccagcccatggggtcgcggccgtcgaacctcggaatgtccagtttgacagtattgcgctagtggaactaggtggcggaaccggtttgctcgcgcgcaggagaacgcaagtgaaggtgatcgaggatcgagtccaccttcccggaaagcgg

SEQ ID NO: 12535 - DNA, 845 bp, Glycine max
  Peptide Sequence Number=SeqID_104220
atggttagaacacgaggtttaggttgtgcgttaggagctagtagaggtagaggcattagtgaggatatgcatgaggctgatgtccctctgcgtcgcagacctactgcttcagcacgtaggcaacaggttcgtatgcgtgaggacgtgacaggaagacctgaggatgtgcctcagttgcatgaggatgttcctcatgtgtctgatgccaccccagagatgacaggcgccgccggtgctgttcagacagagggagtggctactgatgggagcttggggtcacctgctgcagatgagggtttccccggtggaccacgcgacccatcgattttgatcgattttgctgagcatgtcgcacacagcatctggagtggacggaccagcgctgagatcgaagggttgattgctggcatcggattgagtccactgatcaggtgttctgttatcaccactgatcctggattgatatccgccttcgtcgagaggtggcatcgggagactagcacgttccacctgccagtaggcgagttgacaatcacgttggatgacgtggcatcactcctacaccttcccatcactagcgcgctgcatacgttcaagccgcttgttacttcagacgccattcgtctactgacggagcttcttgaggtcagtgatgaggaggctacattagagacccgacaggctggtgggcctcatgtccggttggggtggcttcgagacttgtatcagagccagtgcagcaccagacgatgggttgtagcagcccgcacggacctggcccagacaaggggattcgcctggggggcggctgcattagtccacatgtacgaccatctgaatgacgc

SEQ ID NO: 12536 - DNA, 282 bp, Glycine max
  Peptide Sequence Number=SeqID_104221
atgcatggaaagtcctctacaggtgatttggttccattggacttggaaattgaagcaacttgcagatggaacaacacagaacggagaagaaaatttctactggacaagacagcgttaccaattcttgaagaacctcaatcttctgagtcgtcttccagttttccagaaatcagggaattcgaagctgcagtgcctgaggctgacatactggctgaagagcaaccgagaagaataacccttgaaagactactcaagttctattgtgccatagttttccactag

SEQ ID NO: 12537 - DNA, 417 bp, Glycine max
  Peptide Sequence Number=SeqID_104222
atgtcgcggggggtcaggagaccttggggacgtcaggaagctaggggagcttctggtaatcgattaccaggggatgtaatcgattaccaggcttcaaaagggaactggaagactgtggaggcctctggtaatcgattaccagtctgggtaatcgattacacagaggaatgggtcactggtaatcgattaccaggttttcatgtcctgaagctgtgtaattcgagtttggcctctggtaatcgattaccaaggctgtgtaatcgattaccagagatgaaaagccttaagataccccttttacttgcatgtagtggttacgagacgcattgtgttgcggcgcagttagattttcgtgaaagagtctacccctttcttttctttcccgtagatcgtgatggtggcgcagctaatccatga

SEQ ID NO: 12538 - DNA, 120 bp, Glycine max
  Peptide Sequence Number=SeqID_104223
atggcgtgtaaagaaagggttgcttgtggagccaactgccaagtgatgatgaaagattcatatttgttggcgatggcaaaaaaggttgcggtggaggctataggaacttttagattgtag

SEQ ID NO: 12539 - DNA, 309 bp, Glycine max
  Peptide Sequence Number=SeqID_104224
atgtcactctcactaggtaaaatcatagggagaccagttagggtcacgttgttttgcaagaatgctccaaccatatgggatcaacataggcttaaaggagcactcaaaccaggtgtatttactcccaaggcctacactccgaagacccgtcagggcctctcccttctgattcaggtccaacccagaaaaacatttttgcacatagactttatctatgaactgtacaaaacacacgactccacaattattctcaaaatagttttaactcgtcgccctttaagggtcttagcattaactcgtcgcccttaa

SEQ ID NO: 12540 - DNA, 438 bp, Glycine max
  Peptide Sequence Number=SeqID_104225
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaaccgaagcagctcccccacctcactcatttgatactggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 12541 - DNA, 518 bp, Glycine max
  Peptide Sequence Number=SeqID_104226
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaagccg

SEQ ID NO: 12542 - DNA, 255 bp, Glycine max
  Peptide Sequence Number=SeqID_104227
atgctgagcactactccaagtctccctcaccaatttttgataccctttttgatgaatccaccaattagctaccctaaatggcttaggaccccaatccaccagcttagtttgcaagatgggttatcatttaccacggctaattggcgttgttgtggaagcactttgattatatctttgaagcctcgaactcagaccaatagttgtagggctgggcaaagcctttctccagctgtcttctccgcaaattccctttag

SEQ ID NO: 12543 - DNA, 366 bp, Glycine max
  Peptide Sequence Number=SeqID_104228
atggttgaactcactgttcaacaggtggagaagttgagggaaatgagtccactttatgaatttgtcaaggaagcgatgtttatgaagaggaatgacatgcattggcagtttggtactctgaacctttcccacacttcttcctattttcccccttcttgtgctgaaggaatggcgattttaagttttgctctatctctgttcctgatcagggagagggggagctggtgcaagcacacggctcttttcatgatgtctagttttgctctggaaattgcttctgggatatcaaagatgtttgctcagaagaaagtcacgctgagcccggggaggcacaagatagtgatactggatgaagctgataggtga

SEQ ID NO: 12544 - DNA, 399 bp, Glycine max
  Peptide Sequence Number=SeqID_104229
atggagaaaagtatgattgatgctgccaggggtggagcccttggagacatgacccctgcggaagccaggaatttaattaagaagatggcttccaactcccagcaatttagtgccagaaatgatgctattgtcattagaggagtgcatgaagtagccacgaattcatcttcatcagctgaaactaagaagcttgaaggtaaactagatgccttggttaacctgcaacctggagcaattgagcagcctgaagcttatgctgcaaacatttacaatagacctcctcaacctcagcagcaaaatcagccacaacacaacaattatgacatctccagcaacagaccatgcgttcctccaccaatccagcagcagcagcaacaacaacaacaacaacaacagtag

SEQ ID NO: 12545 - DNA, 258 bp, Glycine max
  Peptide Sequence Number=SeqID_104230
atggaggatcctgaagtagcaaagtttagagaacaaggcctcaacttcttacctgagatggaattcctctttaagggtactattgctactagttttgcagcatatgcaccatctaaagattcaagacaaaatgaaggattcaacacaagaacagaagagaaaaatgataacattgacgataacactgagatggaagtgaatgaacctaagatagacatgacaactcaaacaatgtcttcagcaaaggaaagtggatag

SEQ ID NO: 12546 - DNA, 924 bp, Glycine max
  Peptide Sequence Number=SeqID_104231
atgtaccctcccttgttctctttgaacctagtggatgtaccctccactagaactgatccacaagagatgtaccctctcttgttctcagtcaaacccaaggaatgggaagaatcaaaagaattctcaaactgtgtcgttttgaattctttgacaaggaagaagggagacacaaaagaattcaggcggttagtcctttgttcttttggaaaagggagaagagagacacaaaaagaattcaggcggttagtccttggtgaattctttttggcaaagggagaagagaaagaaaagatgaatagcacaagttttcaaggtttagaaaaccagaaaacttcagaaaacttttggactgacacgtgcgaaaggggcgggaggtgggttcgatgggaaaagaagtttcacatcaggttaaggaataaagggtttataaggagaaggttgagtgttaggtttgaggagactaatttcaaagacaattttaggaaaattgtctttgaatacttactttttgagacgagattctatgataaaaatggatacaattttgttaatttgttctgtgaatatagatgcaatcgcgataaagagctcacgtataaggtttgggatcagaactttgtggagtgtggcattgataaacgagtgacccaacttgagaaggctaaggctgacaagaaaagggtaactgaagcaacaaagcctcaactcaagagaccccgtgctaatggtgtaggatatggtccacgtgtcgctaaatttccatctgacaaaacttcctatgctagagttgctgacagacaatcactgccccctcttatgagttctgtgacttataaaatctctcctaatcctatcaattactttggaaatggctattggtattgttgtaactgggtcatcacgaggacgggcacaaataattaa

SEQ ID NO: 12547 - DNA, 168 bp, Glycine max
  Peptide Sequence Number=SeqID_104232
atggttttactgtggaatccttccccgctttccgtccccgaaccttatcatgctccccgtccccgcttcctgtggtggggtattttttatcccgttctcgttcctcgactccctgtgagacctacggagactccgttttatattaaaaatgtcaaaaattataaataa

SEQ ID NO: 12548 - DNA, 76 bp, Glycine max
  Peptide Sequence Number=SeqID_104233
atggctcgtggtcgccaccgatggtcgtggtggtggagagagatgttagggtatgggtgccgtttgagagagagag

SEQ ID NO: 12549 - DNA, 279 bp, Glycine max
  Peptide Sequence Number=SeqID_104234
atggagcaaagagggttgaaattgaaagagagaaggaaggaagcgatacatgattacctgaaggaagaagaagaggaagagccaagatatagtaatcctatacctgtacccgtacctgtacccgtacccgacttttggttatcggagaaaacccgaactcatacccgatcaactcggatattacccgtcaaagtcaggacagattcgagcgggtacccacggatacaggttttcttgccatgtctagtagtgactccaaaggtgaacccattgatgtag

SEQ ID NO: 12550 - DNA, 246 bp, Glycine max
  Peptide Sequence Number=SeqID_104235
atgatactcaaatttaacgacgatccaacggtgaacgggttcgagatcgtcatttttctgagactggtttgctttttaaatttatttacgaaaaattgggatgttacagaagtcgtcatcaagataaccaaacatcaaattgctaattccacctccaatgccaattccacagttgactccattgttgattccagcgacgcgtcttttctatccccttgcctgcgacggaaccctaaactactctaa

SEQ ID NO: 12551 - DNA, 51 bp, Glycine max
  Peptide Sequence Number=SeqID_104236
atgaattggaattgtggcttggtgtggagtgggagagtgggggttggaagg

SEQ ID NO: 12552 - DNA, 231 bp, Glycine max
  Peptide Sequence Number=SeqID_104237
atgggtgatcaagccaaaatgagacagggcgcgctgagcgcgagaagagacaacgtcctcgctgggcgggctagcaacgcgctgggtgagcacatctctgacttatcctcttctagggtttctcaatctgctaagcgagttgtatgcctcgctaggcagatgccactcgctaagcggatctacctcgctgagcgagtcatcaactacttgaccttctcttctttgacttga

SEQ ID NO: 12553 - DNA, 1062 bp, Glycine max
  Peptide Sequence Number=SeqID_104238
atggcggcagtgtcaggaggagggagtgagatatggaaggcccacacggcaatggccatggtgcagttattcaacggaggttatcacgtcatcaccaaagttgctctcaacgttggggtcaaccaaatcgtcttctgcgtcttccgcgacctcattgccctcgccattctcgctcccctcgcttacatccgcgaaaatgggagggttccaatgcaccacctctccttcctttcccttctcccttcatcaccaagccaaccttatatctccttcttttccccaaatggtgtgcccaaggttttaaatagtggttgtgttgcagtttccttgcgacaaattgcggacaaatgcagccaatgcagtcccaattgtggttgcgggcagttaaaaaaccttgatgttatggcccaaatcatggtcacagaccgttttgtaaaaccttgggcgtatgcggccacccttaaccaaacgccttctgttgtcattcttctttcttggattgactgggtgaggatatttggcaaccatcttttgtttctgattggcttaagctatactaatccaacttatgctgctgcaattcagccagccactccagtctttacttttctgttggctgtaatgatgggtacagaaagagtgaacttgttaagatatgacggtctggccaaggttggaggaactttttcctgtgttttaggtgctgtactaatggttttatatcgtggtccggcattgatagggtattcagaaactgactttgtatcacacagtgagataagtgccaaaggtcaaccggagccttctggatggttaattagtggtttacaggatcttggattagaccattttcatctcggggttttgtgcttcatagggaactgcatgtgtatggctgcttttctatccattcagagactcataggtcaaactctcttgacttgcttcaacccacgacctgacctattttcatctgatcaagctgcttgcagcaacatcatgacagttgcgggggctgctggtgagaagtgtttcctaccattgagaattttgaaagggtaa

SEQ ID NO: 12554 - DNA, 534 bp, Glycine max
  Peptide Sequence Number=SeqID_104239
atgtccacaaagaggcacaatcaaagcgccgccatgccggtgcaccccattgaggatcttcccggagctccgttcggcgacgcggcttcgaatttctccgaatcggagctccgggagacggcctacgagatcctcgtcggggcgtgccggagttcggggccgaagccgctgactttcatatcgcagtcggagaggggggatcgggatagagcggcgccggcgccgtcgttgcaccggtcgctgacttcgacggcggcgagtaaggtgaagaaggcgctggggctcaaaacgacgtcgtcgtcgagggggagtagcaagcgcgcggcgacgacgggggagttggtgagagtgcagatgaggatttcagagcagagtgataccagaattagaaaagcattgctcagaattgctgcaggccaggttggggtattcaatttggactcttcaattaatttttgcttaagtgcttgccttgcggttgaagttttgtgcatctttattcttttacccgattcaggttttccaaatgagtga

SEQ ID NO: 12555 - DNA, 381 bp, Glycine max
  Peptide Sequence Number=SeqID_104240
atggtggttatgccaggaattgagaattctgatatcggattgatgaatatagggaaagaggtactagcacgtaacgctgttatcacttgctacttgctaataaatgaaaaaagctcatggaccaaacgtcctgtagaagttgatagtcctaaaccagtttcccagtgggatcaaatagctgagtgccctgacagtacctgtgctcaagttgttcactccaatgctgaaatttgtgggattgttcctctagctgcaaaggagtgtccagaacagaaggaacaacttgattttcatggtcctaattgtaactctttatcccatgtattgcctatttatgcatctattagttctataattaaaggatcaagccttccaatgtaa

SEQ ID NO: 12556 - DNA, 189 bp, Glycine max
  Peptide Sequence Number=SeqID_104241
atgaaaaatcgagatgccatctcttctcttcatgttgtaacaatggttattggcaaaccgaaaagattactggctgagtcacagacaatgtcgctttctttaagacgtttcgtggcactgccaaaaattgtgcaagcagactatcaatcacgacgtccccaagataaaacagctcagatcactgtataa

SEQ ID NO: 12557 - DNA, 142 bp, Glycine max
  Peptide Sequence Number=SeqID_104242
atggtggtggtggcagcagtagtgacgacgatgacgattataacgatgatgacaatgacaattgataacggtggtagcgacaacgacaattatggtggtggttgcaatggtggtcatgatggtgacagtgatgatgacaaag

SEQ ID NO: 12558 - DNA, 561 bp, Glycine max
  Peptide Sequence Number=SeqID_104243
atggctcaagcatgtgcaaacatgaccaccttccacctttcctacaagaactggataccctctgatgccagtaactccatccttactcccatcaatcgaacgcctagtccgaggaatccccctgttgacatgctccctctgactggaaaggagcctaaagggaaggacaatcacaagaaaagtagcaatcgagaccataggagcgacttagaggaagcttccagccataaagatgtcaaccatcgctgcaaaaggttgaagcaacacatgttggagttccttccttccaatcctttgaccaacctctcggtcttgagcaatcaaggcttctttgtcaaatattttgtgttggagcctcttgtcgatcaagggtttatctcagagcatggtcaccaagtgctgaacaagaatgatgacgtcgccaattggaccaacttttgggcttttcagtctagggcggcaaccattacgcaacaccttcaagggttctccaactacgagaggttgaaggaagaattggctaaggccgaggagtccataagcctttttatcaaaaactaa

SEQ ID NO: 12559 - DNA, 228 bp, Glycine max
  Peptide Sequence Number=SeqID_104244
atggacactcgtctccgtgtgattggtgatcccatgaatggagttcaacgggattcacctagtgagtatggtggtggggccgtcattatgagatatgggctaatctctaaggctcaaacccggaaggggttgtttatgagaaaccctgttagccaaggcagtgaccaacatgggaccaaacctaagtgtagcaccaagagaccaacataccttaaggattatgcttag

SEQ ID NO: 12560 - DNA, 1566 bp, Glycine max
  Peptide Sequence Number=SeqID_104245
atggtttcagggattatgacatataatggccttgataattgcattccggataatcgatcctacggagatgaaagcagaactagcagaggagatggatgtataactgattcattcaatgatgatgatgactccagctcttcatccagcaaagatgcttttggatcattctcatcaaaatgttttgcaatgaaaagagatgaacaagaattggaagagtgggaaatcgcagaaagtcctcaacatttctatgttaaagataagtccgcttttgacgtggccaattgttcagatgtagaagccatgaaagaaaagtttgcaaagctgcttctaggaggtgatgttacaggaggagctaaaggcctcaacacagctttggcactgtctactgccatcacaaaccttgcagtcacagtttttggtgagttgtggaagttggaacctctatctgaagagaggaagagcaaatggcgacgagaaatgggctggttgttgtctcctaccaattatatggttcagttagttcccgctaagcaaaatggtgccaacggtggaatctttgagataatgaccccaaaagctcgtgcagacatccaaatgaatcttccagcacttcagaagttggactctatgcttattgaggcactagactcaatggtgcaaactgagttttggtatgcagaggaaggaagccggtcagcagggaggaacacaagcggacggcaaagcagaagatggtggcttccatcgccccgagtaccaagaatggggctatctgacattgaaagaaagaggctgcttaatcagggaagggtagtacagcagatattcaaggctgccaaagctatcaatgatagtatgttgcttgaaatgcccatgccaacaataattaaggatgcacttctgaagtctgggaaggcaagccttggagaggaactgcacaaggtcttgatggctgaatcgagttctggagaagaaatgcttaaagctctcaatttgagttctgaacatactgccctagagaccattaatagattggaagctgctacattttcatggaaagagagaattatacaagaaaatagtggaaaatcccccgttcgaacctcgtggtctttcatgaaggaccctatggcagaaacgcttctaagtatgcttaaagcaagatatccaaaccttccccaaacatttctggatgctgcgaaagttcaatttggcaaggatattgggcattccattttagaagcatactcaagagttcttggaagtttagccttcagcatactgtctagaatagcagatatattgcaagaggattctttaagcaatcccaatacaccaatttcagcaagttgctctcctgggataaatctttatgaagcttgggtggttggttcgcgtgtcaggcactcgttaatcgataagatgaacgaggtagatggacaatattgtgcttctagttgtggcagtacttctgacatagaattctcatctactcatgccaatgctagtaactctgtacccgccatgccaagccgtggtcgattgtggtgcattggtagaggctag

SEQ ID NO: 12561 - DNA, 498 bp, Glycine max
  Peptide Sequence Number=SeqID_104246
atggacaatggtgatgagcctctgttgcatggcaaaatcggtaccatactaatagccatgggttcagccagtttcctggtcacaatattccatctcgtaatcctttgccgcacccaccgccaggtggcgaacaaccaaaattcagaacaagaagaagccctagggcggcgcacgggagagaacgctcgggtgccgcacctgattccagcccagaagtacgaaaagaagaagaaaagtgatggtaacgagggtgatgaaacatgtgctgtgtgcttggaagagttcgaagagggtgaagagttgaggaggcttccggaatgcatgcactttttccacgtggcgtgcatagacgcgtggctctactcccattccaactgtcccgtttgcagggtccacgccacgccctcgccggcgttgaatgcgcaacacaccatagatatcatgcaaatagctcgcgttcaaaatggctctgcacgacttgaaataatattgacctga

SEQ ID NO: 12562 - DNA, 783 bp, Glycine max
  Peptide Sequence Number=SeqID_104247
atggccatgttgctacaaacgcattaccctctcggtctacactcaccgcgttacccttatcttttcccaaacccttattatcattcatttctcattatccccaccaaacccctaccgcgattcaatgccgcagttgcattatccggtcaccggactctgtcgccacccccagccttcgcttccgaccgccacgcgcttccggaaccagccccttcccctcaaggtttttacgcgcgtcgccgtctccaccgtgctgtttctctgcttcggcgttcgcatgtgcttggcctcttcgccgccggcggcggcggctctacccacgatgatcaggatggaagaaaacaagacaacaaagaaactgtagtagataaggaattagaggaagcttttaatgcctggaaatctaaaacatttgcattgactgttcctctgaaagttgttgctctgcgtggttccatacctccttcatggatcaaggacttcataaattctcaagggaggagaatgaagtttaacgtcaagtattatgcaagtcttgagaacatgttttctgatccatctattccttttactaaaggaaaaattggcccagcatctgctttggcagctgatattgttggtattggcgattcatggctcaaatttgctattaacaaaggtataattgagccaataagagatgtagaagatcaggagtggtttaaaagcttagatgacaaatggaaggaaactgtaccaaaaaaggatgcacaatactaccacatagaagcgttgttgggatga

SEQ ID NO: 12563 - DNA, 189 bp, Glycine max
  Peptide Sequence Number=SeqID_104248
atggtccatgacaacaccatcaggcaaagtgagggagacgacatgagaaaccaaaggaaggagaagagcgaaggtcaaagaaggtgggtagcagttgatgcagaatggacaaatctggacggtagtgttagtggttatagaggttacgtgtttggatggtggttgtggatattagattggaggagatga

SEQ ID NO: 12564 - DNA, 1638 bp, Glycine max
  Peptide Sequence Number=SeqID_104249
atgaagatcttggtggttttgaagaggtctactgggaggcataaaaagactccaatgcccatggttattgttgttatgagtgtttggaagtggccattgatgtggaaggaaatgaaggctagaattggaacagctagggttagacctccaccccatgcaattgatgtccactccaaagaggaaaagcttgaacttctaactgatatggttggtgtggagaggcaaattgacgagccgacattgcaatcaattatcatggcaacaattatgagtcatggtggcaagtgcgatgaaccagttgcagctaaggcgtcatgtatttgggacatcgaggctgggcggcccttcagttcgaggcgcgggttgatgaacgggaagcaagacccgacgcaagcggtggctgccggaatattccagatcaacaccgccgtctccaccttccagagactcgtcaacaccctcggaacccccaaagacacccccgacctccgcgaaaaactccacaagacaagactacatattgggcaattggtgaaagatacatcagctaaacttaagcaagccagtgacattgatcaccatgctgaagttaatgcaagcaagaagattgcagatgctaaacttgcgaaagattttcaggcagtgttgaaagagtttcagaaggcacaacgtcttgcagctgagagggaaacagcgtacactccttttgttccacaagcagtccttccttcgagctatacagctagcgaagtagatgttggttctgataagtcaccagaacagcgtgccctgcttgtggaatcaaggaggatagttggtccacttgcagctaagccagcatctcactttgcccaattctgtgatggctttggaggtgggaagaatcataaaacatggtgtcgatggtggattgcattaacaagctcaatatggcagcataggaatctcttggtattccaaggccaccggtttgatccagccaaagtgatggaagacgctttactcctaacatggtcatggtcagatctagatatgtggtggggtcatagcttgtttttaattatgctggtagatgttatcagcatctcccactccctcttcatcggatgcctcaaaatgatgcaagatctcttgaatctcactctcattggtcacgctgttgcctcacgtgcatccacgtgcccttcttctccgtgccaaacagtttttttgtgcgtccttctgccagcgcatgaacaacccgttctagccatgcttccagtgcctaggttgcccctccattgcaaccttatctcagatttttgggacgattctgacaagttccgatggcaggaggttttattcttagataatgagattgccttcaatgaggctattattgaggaaagggagcaaggcattcaagaaatacaacagcaaattggtgaagttaatgagatcttcaaagatcttgctgtgcttgtccatgagcaaggagccatgattgacatgcttgcttttggtgatttttgggattgtgcttctcatcgtgatcatagttcttgctgcttagtcaaagattgtctcaattccattatggagcaaatgcatatatacagggaagcagatagcatctcccttgctgatgatgtcacttga

SEQ ID NO: 12565 - DNA, 321 bp, Glycine max
  Peptide Sequence Number=SeqID_104250
atgactgtcaccacctccatcggcatgaccgtcgtcactatcgttgtcgtcaccactaccgcagtcacggtaacagtggtgatggtagttgatgacgatggtggtagcaatgacaatcatggtggtgactgcaacgatggtggcaacgacaacaatgaaggtcatagcgaccgaggtggtgatgtggtggtggcaacaatgatgacatgtttggtggcaaagctggtgacggttgataataatgataatgatagtgatgattatggaggtggttgctggagtgatcctggtgttggtagaaacaatcatgattggtggtga

SEQ ID NO: 12566 - DNA, 435 bp, Glycine max
  Peptide Sequence Number=SeqID_104251
atggatggtattagttggagcattgtcttcgtcgattgggtttcatggtgttgttcattgcttctgcgagaagccgttaaggacggtagattttgggtttgggatgatgatttgaagaaatcattgaaccaagactctcaaagtaatggcaacgttggaagtaatgtggatgtgaatcatttgttgaaggttgcaacaaatgaagaaagaatttgtttgtatgaggaacaaatcatggagttgaagatgatgttggctaaagaagaacatcattttcaagcaaattctaaagttgttgttgaactaaggaaaaaaattgcaaagcaacatactaagatttacattgaacgaaagatagtcaaggttttaggatgcattgaggtgttcctttggggtttgttgagtgttgttaccattgcatttgcaatgaagtag

SEQ ID NO: 12567 - DNA, 225 bp, Glycine max
  Peptide Sequence Number=SeqID_104252
atgtggtttgggtctcttcttgatttaccaatagtgaaaatattccctattggttttgttgttgttgtcgctgctagcatcattgacggtggcgatgataacaaagacaatgatggtcatggcgacagaagtaatgacgacgatggtgataacaacaacgacaatgatgaggatcatgttagtagagttggtgataatcatgatgatggtgataatgataattga

SEQ ID NO: 12568 - DNA, 2970 bp, Glycine max
  Peptide Sequence Number=SeqID_104253
atggagtacatcaagtctaagaagctagagttggatggattgagaagaggaaagaagatgatgctagaaaagattgatgacctcatgagagtgcataaaaaggactatgccaagcttaaggagtgctttgagtctatcttagaaaggttgaaggctatggaagcagcacatgctggatcaaaggacccatctgggtgttcatcgccttctccagagaatgacaacaatgagctcagggaagctctgtgtgctctgaaaaatggggcttcagaaaacggggttggtttctctggccatgggaaccaaggttctggtgatggtggggttgtcgaagtggggaagagcagggtctctgagaccaaggtttcggatgagaagggttttgaggggagagaaatggaggatgattgtcaaggtttggcagattcggagatgaatggggtctcctctttgttgaaaatgagagagagtggtaggaacttaatgtttttgtatggtggtgcgagtgagagtgctgggaaggtgaactctgagggtggttcttttgaggttggagtggaaggaggagaaagagatgggaagaaaattgagggcgaggatgatcgaaatgggaaaaccgtgactgcagatgttccaattgctgatacaagtgaaaacaaggatgtggaaatggaagatttgggtgatgaaggatgtggtgggttcttggttggtgattttgtttggggtaaaattaagagtcatccctggtggcctggcagggtttatgacccttccgatgcttctgattttgctttgaagctgagacaaaagagtagactacttgttgcttactttggggatggaacctttgcttggtgccatccttcacaattgaagccatttgaggagaactttgaggatatgatgaagcagagtagctcccgggcttttgttaatgctgtacagaaagctgtaagtgaggttggaaggcttttgaatttgaagatgagttcttcatgtgctgcggataaaactagctctgaatttgttcggccgttagctgccaattctggagtcaaggagggaattcttatacctgaaaacggtatagagaaactttctgatgttctgattgatccagcagaattcctttctcgagtgaaacaaattgccgaaattatttccattgctaatattctggagctggaaatattgaaggctcagctttcagctttttatctatcaagaggaggttatagattacctatgtatgaggtgccccagccagttcctggacttgaagatagtttaagggataaaacagtgaatgtaggcagcagtgagtgtgcagtggaagcacctgcacatgggccatttgaagaggactactctaccatgccaatgagcccaaaatctggtgaattgagtcattcacatgggatttcaggaaatagattgaatcataggattaagcagaaaagcattgctgaaattatgggagaggacaaagatgtcaataccaaaaatcaggaaggagatgcaactgaaaaagtgactgtaagaaagaagaggaaaggcagtgaggatacaatggcatctaaatctgtgcagatgagaaaagcgttgttctcaaatactgatagaaatgtggcaggtgctgaaaatgatggtggttgttggggcaaagaggacggtgacaatggaacattggcgcagttgaaaaagaagaaaaaagcttttggtattggaaagtctagtagtgggagcaaaaaggaaactgatctagaagggaagttcaaaggaaaaaatgagaagggttctttgtcaagagaaaagaagaaaagcaagtacttgtcccctccttttactattccagccagagagcagaggaaaggagagatagaaacagaatcccctaaagtttctggcaaagatcaggaatcagagccactgaccagagcttctgatcaacttctcaagtcccctgtacctttgaagttgaatgatgaggcatttcaggagaatgtttcgaaggaacttgtcaaagaacaggaccttcctgatagctcaaattaccgaacaccagaatatgatgagaacaagactattgatacaacgaaaatccaggttccacttggggaagttctgtctgaagtccgttatgcagctattaatccacaaactccatcgaataccaattctcttgaaagaattgtggattttatttttatctacagaagctcgttatttcgccaaggatcctactataaaatatacaagaagcataaacctagcaagaagagaaagaagccagaatctgatcttgggattttgaggaaagatcaaatacaatctgatcatatatcagctattaatgattcagagccaaagaagagaagaataaagaaagagacagctttaggtttgcctaaagagaagctatctgctgcagctaagattggcaagaaggggactgataaaaatgcttcaggtgctgccctttttgtctcatttgagccaggatcctctctgccttcaaaatcggatcttatcacactgtatggtaagtttggagctctaaatgaatcagaaacggctatgttcgctagtgattacactgctcgtgtcttcttcctgaaagcctccaatgctgaaaaggccttaagccattcacagaacctgaacccctttgactcttccggagcctctttcagactcgagtatctttctgctggttccaagtctgaaaaatccaagcctaaagcttcttcaacaaagaagaaagacaagactccagccaagccatctgcttcattgtcaccaggtactgaagcatccaaattgaactacataaagcagaaacttcagtgtctgacctcaatgctagaagcatctgatgctaaattacctgatatcaaggcaaaattagagagtgagatgaaacgccttttggaggatgtgaacaaaatggttgaatcttcttcctaa

SEQ ID NO: 12569 - DNA, 1662 bp, Glycine max
  Peptide Sequence Number=SeqID_104254
atggggagagcctttgtgtatgtgattcttggaggaggcgtggctgctggctatgctgctcttgaattcgtcaagaaaggagtctctcatggtgaactctgtattatttccgatgaaccagttgctccttatgaaaggcctgcattgagcaaaggatttttgcttccagaagctgctgcccggcttccatcctttcatacctgtgttggtgcaaatgaggagaggctaactccaaaatggtataaagagcatgggattgaattagttcttggaaccggagttaaatccactgatgtgaaacgtaagacactattaacaacaactggagagaccataagttacaagattctgattgttgctactggtgctcgggctttgaagctggaagaatttggggtgagtggatcagatgcagaaaatgtatgttatttaagacatatagcagatgcaaataggcttgtagatgttatgcagtcttgtcctggaggtaatgctgttgtcattggtggtggatacataggcatggagtgtgcagcgtctttagtgatcaataaaataaatgtaacaatggtcttccctgaggaacattgcatggctcgtttatttacctcaaagattgcaaactactatgaagaatattataaatcaagaggagtaaacttcattaagggaactgtgctgtcatcatttgattttgactccaatgggaaggttacagctgttaatcttagagatggaaccacgctatctgtggacatggttgtggtgggaattggaatacgtccaaatacaggtttgtttgaaggccaacttactttggagaaaggtggaatcaaagtaaatgggatgttgcagtcaagcaacagctcagtctatgccattggagatgttgcagcatttccagtcaaagcatttggggaaacacgaagacttgagcatgttgattcagcacggaaatctgcaatacatgttgtttcttccataatggaaccaaacaaaacgggagaatttgattacattccttttttctactccagagtcttcacactgtcttggcaattttatggggataatgttggggaagttgtctattatggagatatgtcaggtagtgcatttggggcatactgggtaagcaagggtcaccttgttggggctttccttgaaggtggaactaaagaagaatatgaagccatagccaaggctactaggttaaggccagcaattgaagacttgactgaactggagagacagggtttgagttttgcagttacagttagccagaaaccggtggtgccacccccagtcgaggttagggcctcggacctacttttggaaaaaccactatatgcttggcatgccacagccggggttattattgctgcatcaatagctgcatttgcatatttttacggaaaaaagcgccgcagatgccaaaggatgccctggattttactccgtcttatgtctagagctctgcaaacaaacatatccggaattgggaagttatggattcaaattccaatcctagtccagaaaatagaagcaggacatataatttatcagtttcaaattgttcctttttctttttctactgcttcagactggagcaaatttgaggatgagatacaatgtgaacagtgcttgaaccctgctgaatag

SEQ ID NO: 12570 - DNA, 345 bp, Glycine max
  Peptide Sequence Number=SeqID_104255
atgttgctatatatgcacacctatatcgccaatggtgttggcggtatatgctccttgtctcgccaacactacttgcgaaagaccatagcctggctgctactctacaagcatagtctgcctaacctgtcccgtccctgccctgccctgcacgctgctcaggccaagtcgctagtgagagtggtgagaacttgcaaccccaaactcgccagctccattggcggtatccagccacgtgtcaagggtttgtgtatctcaccattcatgatggcgatacacttgcatgactacgtaaaaaacagacccagcttgaaaataggtttgaaacagacctatcttggaaattag

SEQ ID NO: 12571 - DNA, 1152 bp, Glycine max
  Peptide Sequence Number=SeqID_104256
atggagtttgatccaatcttcccagcagaaaaaattcacttcctttctggtattttctctgggatcaaatcagagatccctgttatccccatgtcacaagagaacaacaacaacaccatctgcatgcaccaaaacaatttcaacaaccattttcagcaccttcccctgaatgaaccaaaccatgaccataaccaccaccatcctactattacaaaaattttcacagagggttctaattcctccatcctcaccccattgttctgtttgtcctcttcttcaggttactcataccgtaatgagtccctcagaggaggctttgccaacaacaacaacaactacaaacactccatcatgccttatgcaccaaacagcacccaaaatgaacccatgcatggccccaacagagcaatctgggatttttcccagaaaattccccttcagtactctggtgcaggtgcaagtgcaacttcatcacagcctcatcagggtgctcgtccaattggtggaacgcttcgggttcaaaaaatggtctcacatcgcaaggttgctgaatggaagggttgggaaacaaaggagtcatggaacgaagaggaggacagaatcctgatcgaagctcacaaggaggttggaaacaggtgggccgaaatcgcaaggagaatgcctggtaggacggagaacaccatcaagaaccactggaacgcaacaaagcgtcgcttgaacgccaagaggctgaggaacaagcgcaggggtttgaagggaccaacgcttttggagagctacataaggcaagtcactgcaaatgaagaaacccaaaaggagatgatcaagaattccatgagcaacatgaacctgaagggcgagagtagtagcaacaccaccaccactaataccaataccaataccaataccagatatccgcatctctttcgggtttggtatgagagctcagagggtgggttcagttctgaggaggatgaggctgggtggagtgtgcagcagccacatggtgttggtggcggctatgtgcctatgatgctaaatgctactgtggaagatggcacaatgggttatgatgttgcgatggagatggcgccggaggttcagatgaagaaggaaatggatctcatggagatgatcattagaaaagcttaa

SEQ ID NO: 12572 - DNA, 2658 bp, Glycine max
  Peptide Sequence Number=SeqID_104257
atggctttcctagtagttggttatcacaatggtgggctttgcctcaaagatcgaagtattgtggaaggcctttttctcaagggtgacattcaagtactttgcactacaaatacactagcccatggaatcaatctcccagcacatacagtggttatcaaatcaacacagcactttaacaaggaaaaaggtctctatatggaatatgaccgctctactatattgcagatgtgtggaagggcaggccgaccaccatttgatgatacaggcatggttataatcatgacaaggagagaaacggttcatttgtatgagaatctcttaaatgggtgtgaagtggtggaatcacaattgctgtcatgtgtgacggagcatttacttgcggaaatagttcaactgacagtatctgatattacaaaagcaattgaatggctgaaacgctcctacttgtacgttagaatgaaaaaggcaagtgacccaggatatcaattagttttgttcattagtctcccatcccatctgatgcaattttttatgcacaatcagaaccctatgaactatgcaattaagaaaggaatttctggcgatcgtttagagaagcacgtgcaagatatttgtgtgcgtaaagttaacgagttatcacagaatgatatggtctgggttgatgaagatggtttcctcttgcgaccattagatcctggaaggttaatgacaaagtactatttgagatttgacacaatgaaacagataatgcggactcctgaaaattgcagtttggaagatgcacttcatgttgtgtgttgtgcagaagaaattgcatgtgcggatatattttgtgaactttttttaatacacaatgtattgacatcaaaacttgacacaattctgcactgggaaaatgaagggatacagctcagacgcaatgagaagaaactcttaaatgagatcaatgctgataaagatggtcggcttcgctttcacattcttggagataaaaggaaaaagaagaagcgcattcaaacaagagaagaaaagatatttatattagcaaatgactgcttaaccggtgatccatcagttcatgacctatcgttgattcaggacatgaattctatatgctcaaatggatgtagaattgcaaaatgcttgaaagactattttgtttataaaaggaattacaaaggaactgtgaattcagcccttctggccaaatcactaggccagaagctttgggatgacagtccataccttctgaaacagttacctggaattgggatggttacagcaaaggcactgcattcaatgggagttagatcgtttgaggaacttgctgatgctgatccgaggagaatagagctagtgactggtcgaaaatacccatttggtaaccatattaaagattctctactgtctctacctccaaaagttgatgtgacgcttgcagagattgaaagccatatacaaggaaattccaagctagtagtaacattggctaggatatcacagtcaggccagtcagttaaacgacattatgctgatatgatcgttggttcggaggaggacaacactattctctttcatgaaaaaataagcccatacagtgcaacaatttttgtgcccatcgcacaagggaagcaaaccatcaaagttgattttatatttgaggaatacattggtattgatgtccaccaaaaactttcctttacgagagagagcaattcaattgtgcttttaaaaagaaacaagaagcaggcttcttgtcctccacctgaagagatatatgttatagaagatgataacataactgtacctcgtttaccaacaaaagagctatgcaaattgaacgaggacagggattccattccaagtttcgacctcttggatgaaagttttgaggaaggtgtgcgtgcttttggggttgtagaggacgaatgcaaaagcatcaccgagaaaacagtctttgaccacattcgggagaaagccaaaaacttttctctcctgtctgcatatgataacattcactttccatcactagaggtccttctttcaagaaatcatgcccgtgagaagaggcctgatcatcgtcatgaggtagttgttctggatgatgaagacagacctgaagttcctcaacgaaatgatgtcaatttgcaagttgagctgaggaaggcagaacaagatgatatcaaattttatctgaacgatcattgtacaactggaagctctaatatagttgatacaggtgttttccttcctgaacctgaagcaataactcatgaaaaatcaactgaagaaacagtttttgaccatatacggagaaaatctaaggatttcccaccgattaataagcttaattgtgcggaatcaataatccataaaacggaattattctcaaagattaatcctagtcctcccagttctttgagcgatgcttttggtgtggcaagagagacgaattccttagaggtcaccgataatatgcttacttcatacatgaaaactgctgctgaagtagaaaaatatacatccagtattcagtttttcaatgtcaggaggagagaaaaaggtcttcagatcccggaagctttccagagagtagtaagaagcagcgttgcgcttctagagactctaaagaagagaagcatagttcaagtgaaataa

SEQ ID NO: 12573 - DNA, 318 bp, Glycine max
  Peptide Sequence Number=SeqID_104258
atgagcttctggcatggtggcacgactctcgctcaggtgatgctgagtgaggggttgtctctttcccttggtggaggggtttttataggaacattctggcaagaatggtggttaggaggcacatggcctcgtgaggcaaggatctcggacgcttgtgtcagcaatgccagtttggttatccgagatggtgactcggtaactggtattgttcataagagcgatgccggtctggttttccgagatgattatcattcgagataccctcccgtaacaaaactcaacctgattgcaagcttcagatttacaactgacacttga

SEQ ID NO: 12574 - DNA, 654 bp, Glycine max
  Peptide Sequence Number=SeqID_104259
atggttcacaaattcatgatttttgaccttagggatgaggcaaatgtctatctggttgacttctctgatatccaagggactctcccaaacatcgacgttcttgaccgcggcggcgccgagctcaagatcctctacttccttgagaagctaaagtgcaaggtggcgcggcacggcagcagcatcatcacaatgaacggcaaccacgagatcatgaacgtcgagctgagggcaatttcggcttctccatggaacctggcgtggaggaatttaggggaagtgttccacgacgggtttcgagcccgggtcgcaacactgtggcccaacgttttcgtgcacggggtttgctgccgcagcacacttcgtacggctgggagaagatcaacgaggaggttcgggattgggttaactgggttaacggctcaaccgtgtgattgttcggcgcttgagcatgttttatccacggtgcctggtgttaaaagaatggggtgtggggatggtttgcctgaggttttggagatcagtggcaattctgggttgaggatattgacagcgaaccctttgtatcagaacaagggtaatgtggatgatgatgttgggaaggagcaatggcttggggaacacggtggacctaggcaagtggaagttaaggcttaa

SEQ ID NO: 12575 - DNA, 399 bp, Glycine max
  Peptide Sequence Number=SeqID_104260
atggaagtatccaaaaaatttctccatgcttatctatgttggaaaccacatgccatgctatgtttacgtgtagattctcttatagcatctagatgtcggtttatagctggctcgacatctcaaaagttctactggcggaaggacccaagagatcattggtggctgccctgtgggtctatcaggggatggaagaaaacgaaaaaatggtggtgtgtatggatagccacggtttggttaatttggctaaggagaaatgatttcatattcaacattgggatcattgaaggcaagaacaagaggttttcatttttgtttgcaagaatggaaaacgctgtcggtgttgtgcttataagtggggttggttttgattgtggcccatcatcaatgactgtaaactaa

SEQ ID NO: 12576 - DNA, 459 bp, Glycine max
  Peptide Sequence Number=SeqID_104261
atgccttgcagacatgcagtggctaccatacaattcagaaattttaaggttgtggattatatgaataattattattcaaaggaaacatatgacgcttattatggccataaggtggcatcaatcaatggtgagggtgcaactcaaggtgtagctcagggtgcaaatcaaggtgcaggtgagggtgaaggtccacctgctggaggtcaaggagcaactgagggtggaaatgagggtatacctactggaagggaaaaagggcattgtgggcacaatactgctttaaatgaaaaagtacataaacttctttctaaacgcaaggcaccaacaacaaccaaggcaccaacaagcaaaaaacttaaaggttctcaactaacaactattgataggaacattgagctgggaagtggactttttgacactcagaccaagccatgtgcatcagttaaagatagaaattga

SEQ ID NO: 12577 - DNA, 1173 bp, Glycine max
  Peptide Sequence Number=SeqID_104262
atgcctctatcctcctcctcctcctcttccgccgccgccgccaactccgccgtctccggcgagatcatgctgttcggcgtcagagtcgtggtggactccatgaggaagagtgtgagtatgaacaacctctcgcagtacaagctccctcgcgacgccgccggatacgcctccgccgccgacgcagctccgatcgactccggcaagaaccgcgaccgcaagcgagcattgtttgattctcccaaaacagttggcgttaaggttcgtgaaataacacatcctggtgtcaaagtgtccagaggcggtgctagaacaaatgcagatactcaggaacaccccgagtgccaaggagatagatatagtcacaagcgagtgcgtactttgatgtccatgagggttgggggaattgatttctgttgttcacttgctagtattttgcttctaacagagaccactgggagcagagggattttgagtcatatggtccaatcaaacaggtggtcgtatatatctggtgcattggatccccttccaggctggttctctgattcaaggagattcaggcatgttccctcaatcgcaagctctccaaccttcaaaggaaagctatcacagagtgaaaactatttgtcttctcaatcccccattgatcaagaaccacagtttaacagtgggaacttcatggctctctttaaccatcaaccacttggtacaccttgtgatgttgtaggtagcttacttggtcaaggagtaaatgcttcacagaatgctgtttctccaccgtccaaggacatactttgggcaagccatgccatggttgttgctggcaacccattcctcaggattgattttcctcttgatttatctatttctttcaaccttaagggaactaaatcaccgcagtttgatgtttggtgggagattgtgagtatgagctgcaaatgccttgtaaatgtggatattatgcactattttgggatagactccaaggctgttgagttgcttgttaagaattcttctcatttgaggagaatgaaggttgaggggagcaagctctggtgctgcaaaaatttgggcgtcaaatacttggatgtgggatttcaagtggagaaggagatggttcgaatgggagacatttttggttacaaccataaatcacatgttagcaaatgttag

SEQ ID NO: 12578 - DNA, 231 bp, Glycine max
  Peptide Sequence Number=SeqID_104263
atggattgggcctcatacggattagctaatccatacgaggcctatggattagctgattcgtatacttttacagaaggtagagttttaggaagagccttagatagacaggttaaaggtgatgaggaagaagcccttcagcgtcgaggtccgacatcatcggcacatagacaacagacaactacagttgttgcagaggttgttgagaatgtggataatgctgctaacgagtga

SEQ ID NO: 12579 - DNA, 1572 bp, Glycine max
  Peptide Sequence Number=SeqID_104264
atgaggtctagtagatggaaatggtggtggttggcactgacatggaccatttggaagcacagaaatgatattatcttctcaaatggtacattcaatgccaacagaatcctagatgatgcagttttcttattatggacgtggctcacaaatttggagaaggatttcaacactcactacaattactggtcttctaacattagagcaggtgcttttagaaagagggcgagccctggtgcagcggtaaagttgtgccttggtgacttgttggtcatgggttcgaatccggaaacagcctctttgcatatgcaaggtgcttttagaaaaatgtatccaaacaggcctttaataacatgtaagttattggaaaaagatgcagtagaaataggattagagagtgataagcatgcaaaaagtgacaacaagaacatccaaacacttttaagaactgataatgaggatcagtttgaaaaagaacatgagcctgagagagcgatagctccagcgagggatgaggaccaagagtggactacggtgaggcgagggagaggtaaacagagggtgggagtgagatcgagagaggatcccgaaacgcactacactagcgaaaggcatggacaaactcgaaggtaccaaaaggcaaattggagggaaaaagcaaacgttactactttctacttcacaaggttccttgactacataacagagaaggatttatgggttcagttcaagagatggggggatgtaagggaggtctttatacccaatcaccggaataaggatggcagaagatacggcttcgttagattcacaggcgtagctgatgaacgaaaacttgagagacagcttgataacattgtgctggggggacttaagttgtacgtcaacattcctaggtacgggagacgaaacaagaggatcgaagagcagatagacaaaaacggtatcacgcaggaagggcatagcataacagagaacaaagggcgccttgcaggaactcgatacaggaacccctctatgacctacgccaaggtgctgtctgccaacaattgcgatgcagaactacgcaggaaataccaacacccacaccctagagccatggagtcccactcatctatccatctcgatgtatcacaaggggaaaaggaaaaatacactgatacatgggtaggccgtttaaaaaacttgggaagcttcgagacaattgaagatgatctcccatgggagttaggcatgaacgtcgtgctgaaatacataggcgacgacatggtactccttctcggactttcggactcagaggtagaggagatttcagcaactgaactccaacacggcacaactcccttctccgtgcttcaaaaatggaacccgacgatgaggccggggcacagaatcgtatgggtccaatgttggggtgttccccttgaagtttgggacattgggcatcttcgaaaactggtggcggctgtcggagacctaattgaggttgatgatgatgtagaagagctaagaagaatggatagggcgcgtattctgatcaaaactccacggaaaccttttctccagcattctgtg

SEQ ID NO: 12580 - DNA, 552 bp, Glycine max
  Peptide Sequence Number=SeqID_104265
atgtcaagcctcaatgacaacaatgctccagtaatgaccatcatcacaactgatgccaccactttccacacagaaggagaacccatcattcacataaagcacttctttgacattgaagtattaaaagggttaggactcgacacacaagagaccctgctctactgtgaatgtcctggaggagcgctcgattcaaggattgaaagaccattgtttccagtgttcttggaaaaagttctatacgggaaccacctcaaggaaattgatggaaagaagaaagtacaatacaaccttatgtgcgacatggctaaggtcttggaacctgaagcaacgtcgcacaatgacaaaatccatggcagcaatgttgttagtgatgttgtcaatggagttgaagcgataagtgtgaagaaggttaaattgttgaaggaaatgttggattttggtggttggttgttcacttctctgactgtcgatggggagaaaatgacagagaatgaagaaaaggaaagtgaaatgagggagggtattgagggaagtttctctgacagggaataa

SEQ ID NO: 12581 - DNA, 294 bp, Glycine max
  Peptide Sequence Number=SeqID_104266
atgaagaatcatggaaaagatagaaaagtgggtgagtgcggtaccttctggcatgaagcgagacccatgttccacgacgccattacaattagcttctcttctcttcaattctcgtcacgcaaaatggcaacagcaaagccagaaaaaactccggattttttttgtggtgggacacgagtcacaggggttttaaggtctaataataaaacaaatgcgaggcctaagccaaaaaaggagactacacagataatcctgggagtagcaaactcccaaactatgagcaagaagcagtag

SEQ ID NO: 12582 - DNA, 231 bp, Glycine max
  Peptide Sequence Number=SeqID_104267
atgtcgccacttctatctgcgaagaaccaacaaatgcaaattccaatccacaacattcagctctccaacaacaacgacgatgaaggcatgatcggggaaggagagacggtagcgaagggaatgactaaaaaagaggaaaatattgcaatggtggtggtggcaatgagggaagggagcgacaaagagggaaaatggttcgggtcaagaggagaagtggttgttggggtctag

SEQ ID NO: 12583 - DNA, 660 bp, Glycine max
  Peptide Sequence Number=SeqID_104268
atggtggaagagggataccttaaaggtccagatagcctttctggctatccttgcttgccacctacaacacttacagatgataactttgtgttcaatcttcaacctgcaaacacctcacagttccctactatcaaagctggaattagcactgcatttgttaatgaattccctgccctcaatggtcttgacatctctgtagcgcatgtagctttcgaaaaagatgggttttttccaatgcattctcatcctgatgccactgaactaatcatcttggtggaaggtgaaatcactgctggattcgtcaccggtatgaattcgattgcttatctgaagacgctgaaacccggagatcttatggttattccaccaggacatttgcattttgtagcaaattctggtaatgagaaagccactggttttgccactttcagtagctcaaaccctactatccattcattcaacaatatatttgccaacaatataccttctgacatacttgcacaagctacatttcttgatgttgcccaagtcaagaatcttaaggctcttgtgttcttcctaattactcctccgacgcctactttgcccagattcccaagaggagaaccatcagtgttcaacttcaagaaatttggtggtggcagactccgtgagatatag

SEQ ID NO: 12584 - DNA, 126 bp, Glycine max
  Peptide Sequence Number=SeqID_104269
atgacactcttatgcaaatccaaaagaaggcatcaaagagaaataattgtcatttctgtgggaaatatggacacttccaagcccaaagcgcaagtcttggttcgaaaagaaagggattccttatga

SEQ ID NO: 12585 - DNA, 414 bp, Glycine max
  Peptide Sequence Number=SeqID_104270
atggtgtcgaatccgtacgccgacgccgacagccccttgcctaccgccgtcgtcaacctcatctccaactcctcgccatcgtccttcctcaacgcgttcagctccaccaagcctccgatcagtctctcgtcgaagaagatcttcggcatcgtcgcgctccccattctctctctcaactctttctctcgctccgcaaaaatgtcaacatttctctcgatgaacctcaatgctctctctctaaagaaccttcacattgcgcaacactctctgcagtttgagcgtgagaagaagctgattctcattctttcccgtgcaaacgatgcgtcgtttttgtttttcaccgtcacaaagacctttagccccgagaggttgaactccgtcacacgagaagaagttgattctcattcttgctga

SEQ ID NO: 12586 - DNA, 429 bp, Glycine max
  Peptide Sequence Number=SeqID_104271
atggatgagtaccttcacaaaatcaaaggtcgtgttgatgagcttgctggcgttggatttccagtacgacatagggagcatgccgatgctattcttgaaggtctaccttcagactatgcgctagtagtttctgttattgaaagcaagaaacttacaccatccattacagagattgaggctctactttatggccaggaaactcgccttgtttggcacaatcgagacactcatatgtttgcatctccacccctaaattacactcgaggttattcgtatggaagctcatataaaggtaatgattctggtggctttagaggatgttatggtagaagtaacggtggtcgtaatacttcgtttgatcgaggtagtggtcgtggtgattctggaagagaccgcgatggaggcatatttgctaacttccaatgttaa

SEQ ID NO: 12587 - DNA, 423 bp, Glycine max
  Peptide Sequence Number=SeqID_104272
atggcggaaaagcatggtagaattttgaaaaaatgtcaccgaatagcgatgacgttgcaggttgtgtatggcgacgtcatgtcgagtcatggcgaaaaaggcaaaatagtgatcttttttgttttttttcgcgataggtgttgggctcacatgactcaaccttacctgataatatattgcaaaagcgcagcagccatgaacgcagaaacagaacagcagcacaaccccgcccccgcatccaacggccaccagcagcgacgaccggcagcagtacaaccccgcgaagcaacgaccagcacccacacaaccccgcgaagcagcgaccaacaccagcacccagcagcaccacaaatggcggtgacgaatggcagcacgaacgacagcacaacagtgaaaacgaacgttgacgtggaggacggatag

SEQ ID NO: 12588 - DNA, 696 bp, Glycine max
  Peptide Sequence Number=SeqID_104273
atggttctacttgtttccatatctgggaaacatgatctgatgttcactcctgaagtagttgagaagcctggggataactcattggctaggctgaaatttttgtacactcaagcaaaagatctttcagaaagtgaagcaagtatttccaacttactgataaaccaaattgatgccctactgcctacgggtccacaagggcaaacacgaagaagaatagaaggtaatgagcagaaaaggaaacgagtgaagactgagtcagacatttcaaggctaactcctaatatgcgaagtcaacttgaggcttgtgccagtcttaaaggcgaacaggtagcggctagggtcacaccacgaaatgctgataaggacgagtggtttgtcgtaaaagtgattcattttgataaggaatcaaaggataccgacatggtcccaaacagtggtgtttctgttttcgacatgccgacgacatggacacgtgccggacacacaccggacacattactggatgaggaaccaggcgatgatgaagaaagcagtggccaaagacaatacaagcttcccatggcaaatatcattcctttccccaagagtaatgatccttctagcgctcctgatttccctcctggaaaacatgttttggcggtctatccaggaactactgcactttataaagcaacagttgttcaaggccctcgcaga

SEQ ID NO: 12589 - DNA, 342 bp, Glycine max
  Peptide Sequence Number=SeqID_104274
atggaaggtaacatgccatgccaaaatgagtttgttggttactcgttcacaggaaaaaatcccaaaaagtttaacattccttccagatgtatcatggatgaactgaaggatttgatcaagcaagttgcgcttcatgggattcccccttatggtattcatatcaaatataacttctgcggatcaacaaaaacctatgtggatcacgtcatagcatacgcggatcaagctgaacgagttgggtgcacaaaaacaatttttaaaatacacgggagtatttttgtcttttcacgtagggtgctgggtgcacctagcaactcccgtattgttaatgttcaagcatga

SEQ ID NO: 12590 - DNA, 431 bp, Glycine max
  Peptide Sequence Number=SeqID_104275
gaggaggaagaacaagcatagctaggttccttagtgggcttaatatggaagtgagggacaagattgaacttcttccatatagggacgtagatgagctagtccaactatgtataagagtggaacaacaacttaaaaggaagccttcttccaaatcttatggctttcactcttatccaaggaaggaccaagcccaaggaagtttggaggctgcaccttcaaaacccaaggaagataagggaaaggaagataaagtaagaggtgaagagtatagtgaggaagtctaccctcatgaagaaggtgacctcctaatggttagaaggctccttggagactttgaacacaccttggaatccctcacccttgtgctcaaagattctccaagagacaacccgtctcttgattacaattctcacaatccaagagacaactag

SEQ ID NO: 12591 - DNA, 405 bp, Glycine max
  misc_feature (86)..(86): n is a, c, g, or t
  Peptide Sequence Number=SeqID_104276
ggggaaacgcctggtatctttatagtcctgtcgggtttcgccacctctgacttgagcgtcgatttttgtgatgctcgtcagggggncggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtaccttttcaaactggtggtctagaaatcaagttcccgattagaattgggagcagcttttgtatttctgcctccaaaagtgcagataggaatgagaaggctgctagagctgcggggatcctctag

SEQ ID NO: 12592 - DNA, 293 bp, Glycine max
  Peptide Sequence Number=SeqID_104277
agggggaatcactctgtgcttactctagattttcactcctaaggcctgatcctcaggagttggctgctaagctctgtatcccggggaggggattcgagcttaatgctgatgggcagcccctgaagattttgaggaagaacatgaccaccttggctcagacatggagtgttctatccttctctaacttgattcccacctcccacacttctgatgtcactcttgacagggccagactcatttatggcattattatgaagatggatatgaatgtggggtacctcatttcccactag

SEQ ID NO: 12593 - DNA, 385 bp, Glycine max
  Peptide Sequence Number=SeqID_104278
catgccccgggaacagagcaaaaagaagctctttgtgaccacactacagaatctttcgtttcctatggtctttcgatcgcttcaaagccgtacccgggtggactcgcttccctttgtaaatcatttgttcttccttattgtagaactgttgaagtgtcctccccttccattctttgcattccctctggcccttactttcttttactccttatggcatctggtttcaaagatagattggttagtagccttctgttcattcttacccctgactaccggaccccattgttggagagggaaaagtcccatccgttccagaagtcgcagagaaatggaaggcttaaataccaaaaactacggaggcctgatctaaaaatgggtaagcccg

SEQ ID NO: 12594 - DNA, 570 bp, Glycine max
  Peptide Sequence Number=SeqID_104279
tgcgaggaagacatcttggtgaactgcccatcctctatgccttatgtggaagccgcagaagaatcgttagaaaccactttccagtcttttgaggtggtcagcatttcctccgtagactccttctctgggcagccttgtctgtccgatgcagcagtaatgatggcccgagttatgttagggaacggctataagcccactcaggcggatatgaaaagaagcatcgcgggaaagaagagcagtggtcaaagctcgcgttggagacaagaaagggaaggaagcccgccctgccacataagtagaagctttataagcgcgggtctgggagacaaaggtcaagtggtcgcgatatgcgaagaggatgttccgagtacattggatttggtacgaccatgccctcctgatttccagctgggaaattggcgagtggaggaacgccccggcatttacgcaacgagcaaatgtaaacctttacgatccgatgacgagtcccccgaaggtactaatacctgggacccgcttatcgacttcgagcaagaaatgaatcaaacggaagatgaaggaaatgaggat

SEQ ID NO: 12595 - DNA, 126 bp, Glycine max
  Peptide Sequence Number=SeqID_104280
atggtcgacaagatcttaaatcaggtgaaagtcatacttactcctcaaaccagggagaagctcaataggccaagacgacctatcaccatactggttgacaagaccttcaaccatgtgctaatcaca

SEQ ID NO: 12596 - DNA, 249 bp, Glycine max
  Peptide Sequence Number=SeqID_104281
atggccccgaggaagcttgcctcaaagaggtccaggaaggataaggcggctgaagggactagttccgctcttgagtatgacagtcaccgctttaggagcactgtacaccagcagcgcttcgaggccatcaagggatggtcgtttctccgggagcgacgcgtccagctcaagacgacgcacctagttgctcatgatcctgggaatttaaataaaacaagcgcaagctcggaaggtagaaagataccttga

SEQ ID NO: 12597 - DNA, 357 bp, Glycine max
  Peptide Sequence Number=SeqID_104282
atgtcttacctagcgatcataactccgatccccctctgcctaagtgccagtatgccatccaccaggcaccctttggacccagataagtctaacagggccctggggtttctggcgttgattacgggcctttgccagtcattcggggttcccgtcacccccagtaaggggcagggtttcgctccttttgcatgccctactccagagcagtttggggctgaggtcgcatggctcagagactggcctaaggcccaggcaggggaggagcccgcaggatcccccggtgaggcaaaggaggcccgtatggatgaagaaatgaccgacttgctcggtttcttgggaggaagcggagccacgtga

SEQ ID NO: 12598 - DNA, 216 bp, Glycine max
  Peptide Sequence Number=SeqID_104283
atggttgcttacatcccagatccaaggattgatccttctcaatatcgtgatttagcacattattggtgttctgagaaaggacataaaataagcaacatcaacaaaaagagccactcaaaatatgaggacttgcattgcatgggaaccaagaatcttccaagacagattcatgagatgacaacaaaggctaagggagtgcaaccttctaggtcataa

SEQ ID NO: 12599 - DNA, 648 bp, Glycine max
  Peptide Sequence Number=SeqID_104284
atgtgggtaaggcttcgagctgccgtggaagaactgagaaagttccttgtagctgattcattagaagaagtgaataggaaacttgacaagttctacatggttcttattttgagaagcttgcattcagactttgatcatgtgcttgatcaagtacttgctggagaccagattccatcgatggattccctcatcactaggcttctccgcgtgccttatttattgaaggatgagaatcctactaatggagtggggacgtcagccatggttgcgtctcgaggaagagggagtagccgcaacaacagaggaggtcgcagtggaaggggtggacgtcctcattgcacttattgcaagaggatgggtcacacccaagagaattgttattcgttgcatgggtttcccgacaaggtcgcacaggtctcttgttcagagaaagcagagtctagattttctgatgaggagtatcaggagtatttgaagcttaaattcgagaaacccagcaaccaagctcaatcctcatctgtaccatgtgtttcaatagcctgtatctctcaatccattgaaggttctagtccttggatactcgactcaggtgcctctgatcatatttctggaacatgggacggggcgactgattggagaaggacatga

SEQ ID NO: 12600 - DNA, 543 bp, Glycine max
  Peptide Sequence Number=SeqID_104285
atgaatatcttgacggcacaggatcaagagtgggaacaggagttaagtccttacaatcattatgaagaagaaagaactcttaatcttgaaagtgtgtttgaggaattcatggtataccatgccagctcaaaagctaatcaaaactcaatggaaaatcatgaaattcattttgaaagaggatccaatctggataaattgttgatgcaattcatggaaacaactaaatcaactcagcgagcacttcaaagtgtagaaatccatgttggtgagctggcagaagcagtgactcaatttatggtcagacaagaaaaatcctttgtagaggttgaagctcaaaagaaaagcccagtaaaaaagcatgagtcaagagaaaaagatgaggagaaagatgaggaacaagcacaacaacaatgggagaagtactcaatagtagaaaaccaacaagaaaatattctccaaagcaataaccttcctcatcaactgattgacaagaaaggaaggcaaggagagcatgaggaaaccataagtgccattctttcttaa

SEQ ID NO: 12601 - DNA, 384 bp, Glycine max
  Peptide Sequence Number=SeqID_104286
atggcacctccagactttattcccttagtagagcagtttaatgagatggtacctcagcatgtggaggatgagtcatctgaggccaccatcccagagccatttgatataggagaagaggcagaggagacactggtgagacaggtagttgctgccactcctgagcgatccattgaggctacttcagagccttctgcactagtggtaaacctaccctcacctcagcctgcagcagacccctccactcctcttctacagatgctagaggaccctactacaccagtcctagctatggacacttctcctcgaactactccagtgcttcagctgacacataaggaggatagtcagacacaggacacccaagaccagtcacaggaattttga

SEQ ID NO: 12602 - DNA, 840 bp, Glycine max
  Peptide Sequence Number=SeqID_104287
atgaccgctgagcagggcaaaccgctggcggaagcccggggcgaggtgctctacggcgccagctttgtgaaatggttcgcagaagaggcgcgtcgaatctacggcgacaccattcctgcacccagcgaggaccgccgcatcctggtgctgaaacagcctgttggggtggctgcggctattacgccgtggaacttcccgattgcgatgatcacccgcaaggttgctccggcgttagcggccggctgcccgattatcgttaaaccttcggagctgacaccgctctcggcgctggccctggccgtgctggcagagcgcgccggattcccgtcgggcgtgttgcaggtactgaccgggctgcccacggagattggtgcgtcgctaactgaaagtcgcacggtgcgcaaaatttcgtttaccggctccacccgaatcggccagttgctgatgcagcagagcgccaacagcgtaaagcgcctgagtctggagctgggcggcaacgcgccgctcatcgtgtttgatgatgcagatattgaaattgcggttgccggcgtcatgctcagtaagttccgcaacgccggtcagacctgcgtttgtgctaaccgtattctggtgcagcgaagtatctatccgcgctttaccgcacgactgcttgaggccgttgccaccctgaaagtgggcgatggctttgcgccagacagcaccataggcccgctaatcaacagccgcgccgtcgagaaagtgaacggccatatcgacgatgcgctcagtcacggggcaacgctgctgaccggcgtatcagccagggcaacggcacgtttgtgcaacctacgtgctcggtga

SEQ ID NO: 12603 - DNA, 173 bp, Glycine max
  Peptide Sequence Number=SeqID_104288
agattcctttatgggaaagaccgataccaactgtgttgatccattgcgatagtaccgcgactattgcaaaaattgagaaccgttattacaatgatcctttgacgaaaggattagctagagagaaagtccataacacttctaaaagaatgggactattgcccttactgcgatga

SEQ ID NO: 12604 - DNA, 542 bp, Glycine max
  Peptide Sequence Number=SeqID_104289
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgccgccacagcaaggacctaacctctatgagagaacaacaaagttggaggagactcttgctcaattcatgcaggtttcaatgtcaaatcacaagagtactgagtcagccattaaaaatttggagatccaggcggtttgcgtattgggcgctcttccgcttcctcgctcactgactcgctgcgctcggtcgttcggctgcggcgagcggtatcagctcactcaaaggcggtcgtacgctccaagctgggctgtgtgcacgaaaccccccgttcagcccgaccgctgcgcctttaccggtaactatcgtcttgagtccaaaccg

SEQ ID NO: 12605 - DNA, 324 bp, Glycine max
  Peptide Sequence Number=SeqID_104290
atgaactctagaggtggtggcggtgcatttgttgcccgctgccagccatccccaggctgttgtggtgtctcgccctctgcctgtctgggggtgcaatacttcttgatgaaagctcgggggagatcggcattacagtcgctaggcagaatgttgctaagtagcaatgtcatacatatccgtgtaagagtggtcatgttggtgcacacaatccacactcgtctttctacaatggcacgggtgaaatcttgccccggtatgcatagtagctgtgtgatagcctccctctctggttgtattctcacagttggcgccctccaatattag

SEQ ID NO: 12606 - DNA, 123 bp, Glycine max
  Peptide Sequence Number=SeqID_104291
ggagtgcctgtcacccccagcaaggtaattaggccccctaccaatcgagctttcatcaagaagtactgtgcccccaggcaggcgcagggcgaaacaccacagcaacattgggatggccggtag

SEQ ID NO: 12607 - DNA, 109 bp, Glycine max
  Peptide Sequence Number=SeqID_104292
atggataaccatcagcatggaaatcatagtgatccagcacaagccaggataaagaaaaaagctaatattcttgattcatcagaggatgagagttctgaatcaacacaag

SEQ ID NO: 12608 - DNA, 117 bp, Glycine max
  Peptide Sequence Number=SeqID_104293
atgtcggtctcttcgcgtcaacgggctcgtttgcccccttggttgacaaaaggtgcagaaggtgcaggagacgatgttagcctctacacgctatcatgcgttgagtcttacagatag

SEQ ID NO: 12609 - DNA, 1489 bp, Glycine max
  Peptide Sequence Number=SeqID_104294
atgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtccgaaccaaggaatcccttaaatatgattcaaaatggatcttattctatcgttgatcagagatttctctatgaaaaatatgaatcggagtttgaagaaggggggggagtcctcgacccacaacagatagaggaggattttttcaatcacatcgtttgggctcctagaatatggagcccttggggctttctattttatt

SEQ ID NO: 12610 - DNA, 108 bp, Glycine max
  Peptide Sequence Number=SeqID_104295
atgccccaaccacatggaatcaacatgggcttaaaggagcactcaaaccgagtacccccaaggcctagactccgaagaatccgtttgggcctcaccttcctgactcag

SEQ ID NO: 12611 - DNA, 708 bp, Glycine max
  Peptide Sequence Number=SeqID_104296
gtcacgcgccagaaagcctctcatcaggtgctggcgcagctgaaagccggcatcaacgacggcacctttccggtcggcgagaagctgccgtcggaaaacgtgttggcggacgcgttcggcgttagccgggtgccggtgcgcgaggcgctcggcgtgctggaggtcagcggcatcatctcctcacgccagggcggcggccaccgggtggaacagcattcgctgctgagcaaatacgaaccgctggtgatggaggtagccgaccgccgcgaggtggaagcgctgctggaaatgcgcgaagtcatggaacagcaggcggcgcgcatggccgccgagcgccgcaccgaacaggagttgcaggcgatcgaacaggcgcacctcgcctttcgtgactgtacgctgaacgacggccagatcggctatcggcaggactacctgttccaccgcgccatcatgcaggcttcgcataacccctttttcgtgcagatcctcgataacatgcacgagctgtatctgggggtgctggtgtactcgctcagcaaaaacctagggcggcaggccgagcgccagcgggtgatcgacgaacatgagcgggtatttatcgccattcgcgacggcgatgcggcggcggccaccgccgccatgcaaagccatctgaacaacgtacgcggcaaattacgccgcctggaaaacgaggagcaagagccgtga

SEQ ID NO: 12612 - DNA, 228 bp, Glycine max
  Peptide Sequence Number=SeqID_104297
atgacaaaaggtgccacttatgatgttacaaactttcattgtagcgaggacacttcttgctacaacgaggcttcatcttttgcaaatgatacttcacttgaatcttcttgctctatgaccaactttcgctatggtgagagttgtactcgttgtggcgagtgcttgctcaatatcttagtcttcaacattcatattcgttgtggcaagtcttcacattcattcacttga

SEQ ID NO: 12613 - DNA, 516 bp, Glycine max
  Peptide Sequence Number=SeqID_104298
atggataagagcttgaaagaggagaagatgagggtagggagaaggagagaagaagcacgaaatttccgagaggagaagatgagtcaaacacaagctcaccctacccttcaccgcctcattctccggctttggcgatcccatcccctggctcattgccctcactttcttcttcaccaaggggaggcacttcttgcgctagcaattccctcggtgtcgatgagggtggggggaattttcctgccactggtgaaggcactatgcatggtgtgtgggagcaacaccagtgacgggatggagcacaagttggggaatgtccatggcaagcttgcggaggtcatgacaggcaaggatagtcacaagtgtaggtctggtaatctgaacatgggaaccatccttagaagatggttagaagtttttgggttttcgataggaaaagagggtgaagaaagagaaagagattatggggggaagttgacaaagtatgagctttttcaaacaggatctgacccactttag

SEQ ID NO: 12614 - DNA, 817 bp, Glycine max
  Peptide Sequence Number=SeqID_104299
cccacattcctaccaagagaagcctgctagagctttcatcacaagatgcattgttggcacaaaacaagctgttgtccaagcaattggaagcattgacagaaacactaagttgcaggttatgtcatatgtggaggagcacatgagtccggctactgtattccccaagaagaaacaccacatgaagtcaactacatggggaaccagccaagacaaaatttcaatgcagggacattggaggaatcaccctggaaaccagttcaacatagaccagggtggtccatctaagaggccacaacaacaagggcctagtctctatgatcgaacaacgaagctagaagagactcttactcagttcatctttggagctaatactgagaaaaatccaaaggaggaatgtaatgctatcatgactagaatcaaattggtgaccatgaatgagagtgagaatggaataggtgcagagaaacaacagctagtgtctaacccatcacttgacactatggtagagtctttgagtgaatctgaagaagagttggaggtagaagatgagaagaaggagacaacaataaaagtgagtgaacaagaaataaaagaggagaaaaataatgaaaatgaaaaagaaaatgaaaaaaatgagaaaacaggaaaagaaaaagagaaggtagaagagataaagaaaagcaagagtgagatttcaagggagaagaagagagaaaccactccagctgaaggcaaggaactaccatatcctttggtaccttccaggaaggataaggagagacatctagccatatttcttgcatcttcaaaaagctag

SEQ ID NO: 12615 - DNA, 270 bp, Glycine max
  Peptide Sequence Number=SeqID_104300
atggcctcgatcaaatttggcaccgttaccggggagcagtgtccaaagtgtatgactagaggcaatccatctgacttacaaccctttgatcctgagatagataggacatttcatagattagttaggcatcattttataccttttgatcatcctgagcattccattactggtgaatatgtgcattatgttattggtgattttgaacatcctgattttgagcaatataattttgagcattctgattttgaacattccgagaacatggcataa

SEQ ID NO: 12616 - DNA, 342 bp, Glycine max
  Peptide Sequence Number=SeqID_104301
atgactggccctctcaatgagtcaatctcttgctttctcataagggtggaaccttgggtactagtaccctcaccttcagaggactacacgtcctcgccatcaaagggctgcacgccctcgccaagggaggactacacgtcctcgccatcagagggctgcacgccctcgtcatcagagggttgcacgccctcgccttcagagggctacacgtcctcaccttcagatgactacacgtcctcgccttcagaggaccacacgtcctcaccatcagagggttgcacgccctctccttcagaggactacatgtcctcaccttcagaggagtacacatcctccccttaa

SEQ ID NO: 12617 - DNA, 560 bp, Glycine max
  Peptide Sequence Number=SeqID_104302
atggcgccgaccaggcaccctatggacccagataagtccaaccgggccctgggttttcccgtactaatcacaggactctgccagtcgttcagagtctccgttgcacctaccaaggtgattcggccgcccatcgcccgggcttttattgagaagtactgcacccagagacaggctcagggtgatgctccacaggccgcaggcgcgccaccaccacctcatcaggctagcccggctgggtcgtttgacatggagcagtatttacggcatgtggttcgccaggaggcggccaaccacagggcccatgtgtggaccaatgagaccctttaccagctgagcctcagcatgcagagccagggcttcgcttctttttcatgccctactccagaccagttcagggcagaggtcgcatggcccggggattggcccgaggcccagacaggagaggcacccccagaggcccccgacgatggagaggaggcccacaagacgaggagatggccgatttgcttgacttcttgggagggagtggagctaaatgactgggagatccccagattcat

SEQ ID NO: 12618 - DNA, 1116 bp, Glycine max
  Peptide Sequence Number=SeqID_104303
atgaaaaagcaattaacatatatagccgtagcatttttattaaccggaatgctttcagcacaaaaaatagatcttaatgcaatgccaaagccaggtcctactccagcgataaacattgccaagccaaaaactttccagctaagcaatggccttacggtgatggttgtagaaaacaacaagttaccacgagtaagcgccaatctatctatggacagacctccttaccatgaaggaaatgtgaccggtgtaagcgaaatcatggcagaacagttcgaaaacggaacaaccaatatcggtaaagatgaatttaataaaaaggtagattttctgggagctaaccttaacttttcatcttccggagctttcgcaagttctctttcaaaatatttccctgaggtattgggattaatggctgatgctattattaatccaaaattttctgctgaagaaatccagaattctaaggaaagagctattgaaagtttaaaatctgatgataaaaacgcttcttctatagcagcaagggtttccaatgctttacagtatggaaaaaacacatccagaggagagtttgagaccgttgagtccatcaataaaatccagctggccgatgttcagaatatctacaaaaaatattacgctccggacaatgcttatttagttatcgttggagatgttaaatatgatcaggtaaaacctttgatcgaaaaagcattcagcggatggaaaaaatccaatactgcttttaccgcattagaacctgcttcaaatgttgcaaaaacagagatcaatgttgttgatgttccttcagctgtacaatcggttgtttccgtaggcaacctgaatacactgaaaatgaaagatcccaactactttcctgcaacaattgccaactacatccttggaggaggtggtgaagctagacttttcatgaatcttcgtgaaaaaaatggatttacttacggagcttattcaagcatgtctgccagcaaatattctcctaatttctcagcacaggcaagtgtaagaaacgaggtcacagacaaagccgttaaagaattcatgaatgaactgaatgctatttctaccgtaaaaccggagagcttgaaatgctaa

SEQ ID NO: 12619 - DNA, 171 bp, Glycine max
  Peptide Sequence Number=SeqID_104304
atgctcaaacatgtgttggcagtagacaaagaagctatgttaactcaatccatcttctgccccaacttttgcaagctgaggaaaatgcaaggatcttgcatgagtgaacatgacatgcaaacgatggaaatagaatatatgcagttggcagaacaaaagcatgctaaatga

SEQ ID NO: 12620 - DNA, 285 bp, Glycine max
  Peptide Sequence Number=SeqID_104305
atgtatgacacattcgaccggggatgtgaaaagagcggcgcaagaattgtttgttgtgcactggctctctatgtgtggctggtttcacacccttttctccaagaaggtaggcccgtctatctgctacaaggtcaccgctcgtgcgtcgaaaaaggaaaggcgaattgggaccaactcttggctagcatggaggggcgtctgttaattggttccctcgctagaaggaaggaagaatcaagatttagtcttatgggcagcaatagtgatgtccaaatgttcccttga

SEQ ID NO: 12621 - DNA, 781 bp, Glycine max
  Peptide Sequence Number=SeqID_104306
agcgattttgtcaggatttgatgtacccattctaatcactggtgaaaccggtactggtaaagagctgtttgcccgtgcaattcatcatcaaagcccaaggtcaaataagccatttatcgctgtcaattgcggctcacttcctttggagctcattgactcgctcttatttggacataaaaaaggcgcatttacaggtgctcatcaagagcatttgggttttttcagagaggcacatgaaggcactatatttttagatgaattcggtgacttaccatcctctgcgcaagtcaagctactaagagcgttacaagaaggcacagttaccccagttggtgatactaaagaaattcctgttaatgtcagagtcattgctgctacccataaaaacctcatgagtatggtcgtagatggcacatttagagaggatctattctatcgagtctctgtagggatgattaacattcctccgatacgaaatagagatggcgacttaatcttaatcgcagaacaaatattagcgacattaaaagaaaaagaaaccacactaaaagataaatatttttctgttttagctaaaaatattatcattcaacacaattggccgggcaacgtaagggaaatgcaatcgacaatcatgcgcgcagccttatggagtgagggagatgaaattaatgaaatcaacatttctgatgccgtcattaagagaccgataaaaccaacagcagacgccgtcaaagatatatcacaaggcattgatattaataatgaaatttcatttatt

SEQ ID NO: 12622 - DNA, 87 bp, Glycine max
  Peptide Sequence Number=SeqID_104307
atggaggtgctcaagattcaagccaagatagaagaggatgaagaggaatttgttgaaatggaggatttgcttcaccaaacaatctga

SEQ ID NO: 12623 - DNA, 246 bp, Glycine max
  Peptide Sequence Number=SeqID_104308
atgaccgaccctctcgatgagtcgatctcttgctttctcataagggtgaacccttgggtactagttaccctcaccatcagagggctgcacgccctcacctccagaggactacatgtcctcgccttgagagggctacacgccctcatcttgggtactagttaccctcaccgtcagaggactgcacgccctcaccttgaagaggactacacgtcctcgccaacagagggctgcacgccctcaccttga

SEQ ID NO: 12624 - DNA, 333 bp, Glycine max
  Peptide Sequence Number=SeqID_104309
atgcgtagtgattgcttagtgcaattctccattttcaccctttttcggagccccatcgaattgcgttttcgttcatgctatcctccacccttgagtttggagtgttcatgcatctccgccctcgagtttggagccatgcatagtgattgcatagtgcaattctccattctctaccctttttacggaggccccttgaattgcgttttcgttcatgcattctctgcccacgagtttggagccatgcgtagtgattgcttagtgcaattctccattctctaccctttttcggagccccatgaattgcgttttcgttcatgtatcctccaccgatga

SEQ ID NO: 12625 - DNA, 63 bp, Glycine max
  Peptide Sequence Number=SeqID_104310
atgaaaatactgaaaaaggtgtcgagggaaggagcccagagaatgaagaaccttgggatttga

SEQ ID NO: 12626 - DNA, 255 bp, Glycine max
  Peptide Sequence Number=SeqID_104311
atggatcaagctggcgaggaaatgaagttgcaactgagtgagttagatgaaatccgcctagaagcctacgagaatgccaagttctacaaagaaaagaccaagaagttccatgatattgagatcaaaagcgactccacaaacaagagcttcaaggtcaacggacatcgacttaagccattcctcacgaacccttctttagtggacgtagtggtggaagagacttccttactccaccctactcttcctccaccatga

SEQ ID NO: 12627 - DNA, 231 bp, Glycine max
  Peptide Sequence Number=SeqID_104312
atgaaaaaggaacaaaggagaagtcatgctaaggaatgcacactgattgattggcctaactctctaaaaacagtccccagtggagtcgccaactgtcgcaacctgcccttcggcgggagggcgacgcgagggctcacgggagtgtcttccatgaaaggaaattgcacggagtcgccaccaacgtttattggaggaaaatgtcggaaaaaccggaaagggtatggtgtatga

SEQ ID NO: 12628 - DNA, 240 bp, Glycine max
  Peptide Sequence Number=SeqID_104313
atgcagaaggggtccaaaactgaatcaattgatgtagaaatgggagatcaattagaggatatgattcatgatcttggacaagagtcatttgagcaagcacatgcccatgtgtgtggggtatcatggtacaaagtgaaggatgatgacgagagtagtagtgatgaaagcacaacgaaaggccccccaacaaaggtggtatggtatcttccgatcattccaaggttgaagtgtttgaaataa

SEQ ID NO: 12629 - DNA, 261 bp, Glycine max
  Peptide Sequence Number=SeqID_104314
atgcatacgcatacgcatgcagattgttgtggtaaaatttttttcaggggcaggatcatcttgagctaccttctggggtggggaccaaatgtggacagcagaaaccaatcaaggtacttagggacggatgcaagtggggatggggtcacgaccgaccgatcgttgccctttctctgcgcgaaacaagcagagaacgtcgctgcaaggcagccctcgtatcctttgtattcgcagttttcttttactatttgtttgttttaa

SEQ ID NO: 12630 - DNA, 204 bp, Glycine max
  Peptide Sequence Number=SeqID_104315
atggttacctcagagccctacactggggcaatgaaaggcaccatgcataaacctcaagtgaacctagggccttacactggggcaatgaggggcatcgtgcatgagcctcaagtgaacataggggcagatcaaaagttctcacccgtcgatgtttttaaacgaaaaaaagggggacaaatcctggaatttcaatggattgattaa

SEQ ID NO: 12631 - DNA, 336 bp, Glycine max
  Peptide Sequence Number=SeqID_104316
atggggcagatggatactcagttgaaccaagctcagtcccaaaattctgacaaattgccttcacaaactgtgcagaatccgaaaaatgtgagtgccatcatcttgaggtccgacaaacaatttgaagtgcctccatcagtagcagcacctgcacctgaacctgtcaagcttcattctacacctgaaaaagaggatgagatagttgcacaaaagagaaagcttcctgattatgagggagctaacaaaaattttcatgcaggtggaccttcttctagtaattctgacttgaggccattaaaggctggtcgttcctcaaggagaggcaagtccaactaa

SEQ ID NO: 12632 - DNA, 432 bp, Glycine max
  Peptide Sequence Number=SeqID_104317
atggctgaatatgaccctgagatagtcatggagttctatgcaaatgcctggcccaccgaagaaggagtcacggataagtgctcttgggactttgcacaaagcgtgacgagaaggcgggtgcggatcatgcacactagcataaccactttgacacagatctggatgacacttctcctcagcaacatccttcccagcgaccataattctgatttcccgttgcctaaatgccagctggtctacgctatccagacccagatcaatgttcacgtagcccagctcatctcagatgccatttaccagtttataggcatcacacccccaagacacccagtggacctggagaagtccaacatggcactgggatttccaactttgatcataggtctctgccagttctatggggtgccagttatgcccacaaagctcatctag

SEQ ID NO: 12633 - DNA, 621 bp, Glycine max
  Peptide Sequence Number=SeqID_104318
atggcagaatcatcaaagaaacgtaagggttcatccacctccacttcagcttcaagagctcatcgttctggagccaccagcgcatccacagcaccaattccaccctccttatcctcttccacactgttttcttccgaagaacagcagatacggtactcaaaccttttctcatctcgttccattatagaccctaagttcatagatatggatttcttttctgctgaaagttttgattgcattcaagcatttcagaacttaggtctcatacctttcatgtcattacaattgcctgtttattctgaattggttaaagttttttattgtaaccttgaaattcaggaaaggactttgatttctgaggttattgagataaaaatggtcattgaccaatcccttttccataacttaacccaattgtccagtgacggtgtacaatttgaaggtacactgaatgacgattggaaatttgatttctctgcatatgatgcccgccagttggtttgcaccaaccatgcggatatgactggacgccttcttgtcggttcattggcttttgaaagccgcatccttcattatctcattgtgcatattttgcttccacgatcttccaaccttgcctag

SEQ ID NO: 12634 - DNA, 270 bp, Glycine max
  Peptide Sequence Number=SeqID_104319
atggtatccataatcccaacaaagattcctcaacctccatttttccgaggatacaaccccaatgtgacatgtgcttatcatgggggagttccggggcattccattgagcattgtatgaccctgaaacataagacaacaatagatacctcagagccctacactagggcaatgagaggcaccgtgcatgagcctcaagcgaacctagggacagatcaaaagttcttacccggtaggtcgagaactcgaaagggcggcctaggcaaaaattag

SEQ ID NO: 12635 - DNA, 362 bp, Glycine max
  Peptide Sequence Number=SeqID_104320
atgactagaggaaatccacctgacttacaaatctttgatcctgagatagataggacatttcatagattagttagacatcatttagtaccttttgagcatcctgagcattctgatattggtgaagacccacacaagcatctgaaagaattccatattgtctgctccaccatgaaaccaccagatgtccaggaggatcacatatttttgaaggcctttcctcattctttagagggagtggcaaaggactggctatattaccttgctctaaggtccatcacgagttgggatgacctcaagagagtattcttagaaaaaaaatttccctgcttccaggaccacgacaatcagaaaggatatttcag

SEQ ID NO: 12636 - DNA, 1029 bp, Glycine max
  Peptide Sequence Number=SeqID_104321
atgtccaagcaacagatcggcgttgtaggtatggcagtaatgggccgtaacttggctctcaacattgagagccgcggttacactgtttctatcttcaaccgttcacgtgaaaagactgatgaagttatcgctgaaaatcagggcaaaaaacttgctccttattactctgtagaggagtttgtcgagtcgttagaaaaaccccgccgcatccttctgatggtacaggcaggcgaagcgacagataaaaccatcgcttcactgacgccacacctcgataagggcgacattctgattgatggtggtaacaccttctataaagacactatccgtcgtaataaagaactgtctgatcagggcttcaacttcatcggtaccggtgtctccggcggcgaagagggcgcactgaaaggcccatcgatcatgcctggcggtcagaaagaagcgtatgaactggtagcgccaattctggataaaattgctgcgcgtgcagaagacggtgaagcctgcgttacttacatcggtccggacggtgctggtcactatgtgaagatggtgcacaacggtatcgagtatggcgatatgcaactgattgcagaagcatacgctttacttaaaggcgcactcggtctgaacaatgaagagctggctaaaaccttcactgactggaacaacggtgagctgagcagctacctgatcgacatcaccaaagatatcttcaccaagagagatgaagacggtaaatacctggttgatgtgattctggatgaggccgccaacaaaggtaccggtaaatggaccagccagagctccctggatcttggcgagccactttctctgatcactgagtctgtgttcgcacgttacctctcttcactcaagtcacagcgtgttgccgcgtctaaagtgctgagcggccctcaggcgcaagctttcaccggtgacaaagctgagttcattgagaaagtacgccggcttctctcaactgcgtgcggcttcagaagagaacaactgggatctgcattacggtga

SEQ ID NO: 12637 - DNA, 138 bp, Glycine max
  Peptide Sequence Number=SeqID_104322
atgtatcctccaatgtgtttagacaaagaattcttaggcgggaagaggaagaatcaaaagaattcaaaggcagttagtccttcaaaatcttttggcaagaggaaaaaggaagaatcaaaagaattctcaggcggttag

SEQ ID NO: 12638 - DNA, 342 bp, Glycine max
  Peptide Sequence Number=SeqID_104323
atgtctgccagtgatcatgctattctaggtgatagagtgcatcaacccaccaagaggagcttattggagttatcatcgcaagacattgtgttggcacaaaataagttgctttctaagcaacttgagatcttaatagaaacaattggttgtaccatttctggtggtgctcatgaatccggccattgtattccttttgaagaacaaacgcaggaagctagttacatgggaaatcagcaaaggcaaggatacaaccaaggaggattctcaactttccagcaaggtccctacgatcagcaaggacaatggagatcacaccctggtaatcaattcaataaggactag

SEQ ID NO: 12639 - DNA, 252 bp, Glycine max
  Peptide Sequence Number=SeqID_104324
atgcttgagtacccacctagctgtactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttggggatga

SEQ ID NO: 12640 - DNA, 218 bp, Glycine max
  Peptide Sequence Number=SeqID_104325
atgacaagggaagcagttgagggggaaagggatcgagcatttgaggagttgtggaatctaaagatgccaataaaagttgcggtttttgcttggaggcttcttagagataggctgcctactaaactctaccgattgacccaaggcaacactttctccatcatggttccatactggctggtggtacaaggactaatagatggaagtgctggtggccggct

SEQ ID NO: 12641 - DNA, 474 bp, Glycine max
  Peptide Sequence Number=SeqID_104326
atgacctcactggctcagacttggagtgttcttccttactccaacttgatccctacctcccacacttctgacatcacactagaccgggccaagttgatttatggcattatcatgaagatggacatgaatctgggctacctcatctcccaccagatttctatcattgcccagcatgactcctctaggcttggatttccagccttaatcgtagctttgtgtaaagctagaggagtcgcaccagattccaaatctttggagagtcttagccctgccattaacttggcatatataaagaataactgttggaatctagatgatccaacagtggcatttagagggccaaggaaggccaggggtaagagatctgaggcttctcctacttcagtagcaccagatacttctgctccttcttcatctactttaccagatcctttagcaccatccacttcgactccacatcttccacagtttcca

SEQ ID NO: 12642 - DNA, 806 bp, Glycine max
  Peptide Sequence Number=SeqID_104327
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgattccctgctggggtgcaggagtcagtaaaccttgctgcaaggggcggggaagagcatttgagcttaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12643 - DNA, 422 bp, Glycine max
  Peptide Sequence Number=SeqID_104328
atggaacataatggtgtttgggaccttgtagaattaccaaagggttgtaagagagttggttgtaagtggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12644 - DNA, 552 bp, Glycine max
  Peptide Sequence Number=SeqID_104329
atggtgaaagttggaacctcttacgtgccgaataatcatacctcatttgactcgctgagcaaattggcagccttcccggtatcaaggacatctttatcaagcttattcgatatccgtcacctcaggtttggcgcaaaggcgtcggctgtccctcctgttcagctgagggaattgtggtatccggcaaaagcaccgccggacatacagcgctggacaagtgtaaagcctggggtgcctaatgagtgcgcaactgttgggaaacgggcgatcggtgccgggcctcttgctattaatgaatcggccaagcgcgaagggagaggcggtttgcaagggatattgggtacgccagggttttcccgtcgagtgtatagcggcttactatgttgtatgactcactatgagggtgtcagtgaagtgcttcacccaataatattccgcttcctctcactgactcgctacgctcggtcgttcgactgcggcgagcggaaatggcttacgaacggggcggagatttcctggaagatgccaggaagatacttaacagggaagtga

SEQ ID NO: 12645 - DNA, 261 bp, Glycine max
  Peptide Sequence Number=SeqID_104330
atggagaggggtgagagtgcattgctaacaactgcttgtggaaaaaacaaagcaattaagtctcaagctaatgagaagggaaatggtaaaataccacctcaagctaatattaagaaggtgacaaagtatttcttttttaagaagaagggacacatgaagaagaattttcccagattccaaatatggtatgagaagaaagagagatgcaaagaaagtgatgaggtatcttcaaggaaccaaagattacatgcttatgtatag

SEQ ID NO: 12646 - DNA, 219 bp, Glycine max
  Peptide Sequence Number=SeqID_104331
atgcgggggtactgtatggttatccgcacctttcgtcaaccaggggcaaacaagcctgttaacgcgcaaggactaacgtcatcctctacacctttcatcaaccttgggggaagcgagcctgttgacgtgcagagactaacgccatcttctgcacctttggtttttgcttttgtcgtccgacgacattcaaacccgacgacgcacgagattcttctctaa

SEQ ID NO: 12647 - DNA, 798 bp, Glycine max
  Peptide Sequence Number=SeqID_104332
atgataagcggtagttcgcttcaaatatggcacgccgtttctggtgtattgaaagagagtcttattatgagtgcaaaatttccgccgctgattgcggttatcggcagcgacggatcgggtaagtccaccgtttgtgaacatctgatcgcgtatatgaaacattatggcccggcggtgcaggtgcatctgggcaaacaggcgggcaacgtcggccgcgcggcggcgaagttgccgctgctcgggcgctcggtgggcaaggctatcgagagcaataccaaaaaagtcaaaacgaaaaaatcccgcattggcctgctgccgtcggcggtgatcatcgctttcgtggggcggcggctgctgcggtttcgccgcatgctggcgtatcggcggcaagggttcatcgtgttgaccgaccgttttccgcaggcgcagatccccggcgcttacgacggcacggtttttcccgtcgacgttgaagggagccgtttcgtccgttggctgccggcgcgcgagcgggcggcgttccaatggatggcggggcaaaaaccggatctggtgctcaagctgaatgtcagtctggcggtggcctgcgcgcgcaaacccgatcaccgcaaagcggcgctggagaagaagatcgccgtcacgccgttattgacgttcgaaggcgccgacatcgtggatctcgatgccgatcggccgatcgaggaggtgctttcggcggcggaaaaagccatcgcggaatttatggcggcgcagggttatcgctattccgctgatgaagtatcaacggctgcgcactga

SEQ ID NO: 12648 - DNA, 653 bp, Glycine max
  Peptide Sequence Number=SeqID_104333
acgaagttccaggcgccctcgatgcggcgcgcgacgttgaacagccgtggcctcagcgcgccgtggatatcgcggcggcgcagctcgcgcgcggtgaaccaccagaacagcgtgccgccgatcaggttagaggcgtaccaggtgacgataaagccagggaatcccagatcgaaataataggagatgacgctgcccaccgcctgcaggaacggcttgatcgcctgctgaatggcgatgagatcgaagcggttgaaggcgcgcagcacgccggtcggcgtggacgaggtcatcgacgggatcagggtgcagtacagcatggcgagccagaagctttcgctgtccagccccagggcatgggacaagaacggcagcatgatcatgccgcccagcacggcgatgacgccgctggcgatatccagcccgaaggagaaggcgacgacgtcgcggaagcgcccggtgttttgatgctccagcgccggggtgccgaattgcaccacaaactgccaggtctggaatttgatgaaatcgctgaccgctttggtataggcctggatcaccaccagcacgccgaacatttcaggcgacatgcctttaccggcgcaggagagcgccagcaggccgagcagcgcgctggccacgctgccggagcctaa

SEQ ID NO: 12649 - DNA, 129 bp, Glycine max
  Peptide Sequence Number=SeqID_104334
atgcagcgcattcttgacagactggatggactccacactttcgtcggaatggatacccgcatcactcagcttgaggaggatgtgagttatgttcgtcagtgctttgaccttccaccaccatcctcatag

SEQ ID NO: 12650 - DNA, 2133 bp, Glycine max
  Peptide Sequence Number=SeqID_104335
gcaggcgtcgacacggccctgcgcatcggccttgaactgcagatcgcgacggccctgccaggcaccgttgacgtagacgtcgacacgatagttgccggccaccatcgggttgccgttgctgaaggccgccaggtcgacctgcttggcctggccagacaggaagctggaattgaactgggccgactccggccacgccagcaaccagcaggcaaagcgcctgatggatcgacaatgccaggggccagcgcggcgcgttcagcccccggtgctgccgaggcggatggtgtgttccacccggccgccgtagtcgttgatggtgatgaagcggacctggtcggtgcccgccggtgcggcgaactccaggctctgcttcggcgcgaccatcgcgcccttgtcctcgacggccttttcactgctgccggtcacggcatgtacttcggccagagtgacgtggaaggggctcgggttttccacccgcaggcggtcgccggtgcgggtccagcgcagcgctgccggcgcgtcgttggcgacgcccttcaggccctgcggccggtagaaaagcttcaggcgcgaacggaacgcgacctgcaggtaattctgttcgccgctgtcggcgttgtccggggacggcggaacatccagcacgttgagccagaacaccgactcacggtcggtcggcagctgcgcgccggagaagatcaggcgaagcgcctggctgcggccgggttcgacgcgcgcgatcggcggcgtcagcacgaacggggcatcgctggtatcggcggtctggttggcgtcgccgctgtcgatccaggcctgcaccagcgccggcgaatcgcccacgttgtcgacctgcacggtgacttcgcgcgcctgcgcgggatagatcactcgcgtgccattgaccaccacgccggccagagcgttctggcagagggcagcgtgaacgctgccagcagcagcgcccggggaaagagtgctttcatcggaagtactacgctcgaggtgtgtggccaagggccgcgaagcattggccggtgcgtacgccggccaatgcgggtacgactacgatcagttgtagatgatcgtgtacttgacgctgctggtgacgtcgcccggggtggcggcggcagtggcgtagtactcagcgtagtagttcaggttggcggtgccgtcgccggccacggtcacccactgcgagttgtcctgggccaggccggtaccagccgccttgatcggcaggaacgtgttgttcgagcccagcagctgcagctgcacgttggtggcagcgttggccgaagcctggttgaccaggcggccgctgttgaagtcaacggtggaacccggctcgaagtaggtggcgacgttgccggcgctgcacttgctcaggttgatggcgaacggggtacggcccgcaacggcaccggcggtggccagggtgttcttggacacggtcggcaggttgacggcgaagtccttgccgcccggggtcgagatggtgcaggtcttgtcggtcaccttgccgttgaaggtgatggtgccgtcggcggcgttggcggccagcggagcggcggccagcatcagagcggcgatgatattgatcttgtgcattcgcttttacctaaccctactgaagagatgagaagtagaggaggaagcaaggagcactgccgggctatcaagacccatccttgcgtctcacctgcgaaatcgagattcagggagcgcggggaacgtgacggtggccggatcaggtcacaaacgaccctgcatgacgctcctgacggatcgaacctgtcgctaactaggacacaccgaaccagagaacgtgtcatgaggaactccattctgctgtgcgtggccctgatgtccgtcagcgcactggcccaggccagcagcggcagcatccgtttcagcggccgcatcgccgagccgggctgcacgacggccctgtcccagggtgagctgagcctggccgcctgcccgccgtcggccaagggctcgacggttgccgtgacggcccttgccgatggccaggccgccacgctgcgcgacggcaagcgccagggccagaagctgtcggtgtcggccagcgcgatgcgcgccggcgatatcgccttctccgagcgttacagc

SEQ ID NO: 12651 - DNA, 851 bp, Glycine max
  Peptide Sequence Number=SeqID_104336
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacaacatgggagaggcacacagaaacttttgaaagtgacgaatatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12652 - DNA, 686 bp, Glycine max
  Peptide Sequence Number=SeqID_104337
gcattcagagacctggcacaggcagggacattctcttggggagcggccgctttggtacacttgtacgtcaacttaatgaggcgtcgcaggcccctacacgacagatgactggttacatttcactacttcagtgctggatttacgagcactttccatcagtccacaggtctgttgttgacgatggttatgctgaggctagcccatgtgcctgtagttggcttacgggtaaggcccagatgaccgacattaagggagccccttacagagcacggattgatgacctgacagtcactgatgctgagttgatctccttgtacatgtggcaagtcagatggggtccgatcatcgtctaccttcgaccagagagggtggttcggcagatggggtacattcagacagttcctccgccaccggttcctgattcgttgacaggtactgatatagacgaccggtgggtacaatttgcagatcatgtagcgcctacaggggagctctgtgtagttcctagacaggtggccccagactacatggagtggttttttcagatttcacacccctttgtgacgctgacggacaacactgctgagcccagacctgcgccttcccttcccactcatgatgatgacttcgtggagccacctgtcggccagattccagtcacgtcagatccccctgcacattctgtg

SEQ ID NO: 12653 - DNA, 146 bp, Glycine max
  misc_feature (115)..(115): n is a, c, g, or t
  Peptide Sequence Number=SeqID_104338
atggctcctaattatatgggccatcaagtctatcatgtgctgacaatagcggaggagcccgtggatctcctcgggggcggagtaggtgtctgccatagttgtggcctttgccagncaccgggggaagctcttgactcccgttcaaa

SEQ ID NO: 12654 - DNA, 213 bp, Glycine max
  Peptide Sequence Number=SeqID_104339
atgtggtaccatgacagtgaaaaatctcttcgggcgcctaggaggagaccagccagcgtcacactgttttgtgagaatgctccaaccatgtgggatcggtacaagcttaaaggagcactcaaaccgggtgtatttacccccaaggcctacactccgaagagtttgtcagggcctctccctcctgattcaagtccaacccataaaacattttag

SEQ ID NO: 12655 - DNA, 330 bp, Glycine max
  Peptide Sequence Number=SeqID_104340
atggcagggcacttgtgtgatgttgatgctatggaggcagctcttggaagctcaaaagattattcactgaagcaatatataaaatttgtggataagttgcagaggaaagcggagaaaccttgccattattactcattctacatcggtttactgataaccgatgtagaaaccctaccattcaacatcggtttcaaccttagaatcgatgtagaaagctcacattctacatcggttgagctacacaatcgatgtagaaaggtcgcccttcaaagacggtcttccaaccgatgtcggtattcaacgacactgtattaccaccacgcgtcgtaa

SEQ ID NO: 12656 - DNA, 661 bp, Glycine max
  Peptide Sequence Number=SeqID_104341
aggactacacgtcctcgccttcagagggctacacgccctcgccttcaaagggctacacaccctggccagccctcgccttcagagggctacacgccctcgccttcaaagggctacacgccctcaccttcagaggactacacgtcctccacttcagagggctacacgtcctttcccttcaaaggactatacatcctcgccttcagagggctacacgccctcgcctttggaggactacacgtcctcgccttcagagggctacacgctctcgccttcagaggactacacgtcctcacctttagagggctgcacgccctcgccatcagaggactacatgccctcgccttcagaggactacacgtcctcgccttcagagggctgcacgccctcgccttcagaggactacacatcctcacactcagagggctacatgccctcgcctcagagggttacacgtcctcgccttcagagggctacacgtctcctccttagaggactacacgtcctcccctttagagggctacacgccctcacctttagaggactacacgtcttccaattcagagggctacacgtccacttcaagacacccgtatttgctgggtcgcacccacaagacacccagtggactcggaggagcccaacaggtccctggggtttctag

SEQ ID NO: 12657 - DNA, 926 bp, Glycine max
  Peptide Sequence Number=SeqID_104342
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcttcggcgggagagccgatcccgatggcggggattccctaccatgcggtggaaaactatctcgccaaactggtgaatcagggagagtccgttgccatctgcgaacaaattggcgatccggcgaccagcaaaggtcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12658 - DNA, 609 bp, Glycine max
  Peptide Sequence Number=SeqID_104343
gttggtgttgaggagattagagatgcagatgctcccattcctgtacccactaaagaggttaaggtcatgggacaggctcttaacacattccttgcttggccgacacatcttgtcaagcgtttatcagaacagggagctgtggtacccgcgaaacctacagataggccggatgataaggtcgatgatccgctatatctaatgacattgaccatcccacagctttttctgaagccattgcaggttatgtgggatgctaccttgtttggcctgtttaatgaaaacttccccttgtacataaagcatgaagatctgtctgaaattgcacacggtggtcaatgtctcagcatatatgttatacagttgtggattctgcatatggctgagacaagtatacgagccgggaatatcgatgtgtatggattcctcgagccacagtctatccagaaatctagccaatcacaatttgaatcagaaaattacattaagaactggatgcaaaattcaaaacgggatgtgtacctaggagcctacctgaatggtgctttgaaaggacttgacgatactcaacaaagtaaatccaagtctcttgctaggtggattgttgttaaa

SEQ ID NO: 12659 - DNA, 315 bp, Glycine max
  Peptide Sequence Number=SeqID_104344
atgccctcctggtttccgactaggaaattggcgagtggaggagcgcccagacatttacgcgacaagcataattccctcaaaggtactaatacctgggacccgaccatcgatttcaagcaagaaatagatcagacggagggtgaagaggatgaagatgtgggacttcccccggagttggagaagatagtcgcccatgaggaccaagagatgaggcctcatcaagaagagacagcactagtggacttaggaatcggcagtgggaaaaaggaagtaaagataggcatgggtatgaccgcacccattcacggcctgtga

SEQ ID NO: 12660 - DNA, 293 bp, Glycine max
  Peptide Sequence Number=SeqID_104345
gtcacattgcctctcaatgccccacaaagaaaaccatgatcatgaggggtctagacatttatagtattcaagaggagactacttcttgcccttcctctagtggaagtgaagatgaagtaaggggtgaagagtctagtgatgaagtctacccccatgaagaaggcctagaatcttcttcgtcaatggattcctttgcttcttggaagatgaatgacaatagaatggagaaggaagagagagaggagacgccacttcaaggagaagatgagtctagaagaagctcaccaccatag

SEQ ID NO: 12661 - DNA, 612 bp, Glycine max
  Peptide Sequence Number=SeqID_104346
atggcgcagatgctgacccatatcagtggcgacaaaccggtaaccatcctgacggcaacttccggcgataccggcgcggcggtcgcccatgccttctacggcctgaaaaacgtccgcgtggtgatcctctatccgaaaggcaaaatcagtccgctgcaggaaaaactgttctgtaccctcggcggcaacattgaaaccgtggcgatcgacggtgacttcgatgcctgccaggcgctggttaagcaggccttcgacgacgaagagctgaaggtggcgctgggtctgaactccgccaactccatcaacatcagccggctgctggcgcagatctgctactacttcgaagcggtggcgcaactgccgcaggaagcccgcaaccagctggtgatctctgttccgagcggtaacttcggcgatttgacggcaggtctgctggcgaaatcactggggctgccggtgaaacgctttatcgctgccaccaatgccaacgataccgtgccgcgcttcctgaaagacggtaaatgggcacctaacgcgacgcagcgaccctctccaacgcgatggatgtttcccagccgaacaactggccgcgtgtggaagaactgttccgcc

SEQ ID NO: 12662 - DNA, 291 bp, Glycine max
  Peptide Sequence Number=SeqID_104347
atgaccatgattacgccaagctcgaaattaaccctcactaaagggaacaaaagctggtaccgggccccccctcgagacaggaccctcagctgcaggtctgttggaataccctgccgtgtgaggtgtcagtgtgcccctgctggggggtgcctcccagttaggctgctcaggggtcaggggtcagggacccacttgaggaggcagtctgcccgtatcgaattcctgcagcccgggggatccactagttctagagcggccgccaccgcggtggagctccaattcgccctatag

SEQ ID NO: 12663 - DNA, 884 bp, Glycine max
  Peptide Sequence Number=SeqID_104348
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatttcgcaaagcggcgggtgcggtagggctcccacaggttgggggggtaggacaggtgggcggggttttcctcgcccggggtcttggccacatcggccagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 12664 - DNA, 809 bp, Glycine max
  Peptide Sequence Number=SeqID_104349
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttattgactagccaatgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12665 - DNA, 264 bp, Glycine max
  Peptide Sequence Number=SeqID_104350
atgtttactaatatactaacccatattcctccccactgcaacggacactggcagatggtggtcatcgtgcataacaggtcagacaactaccttaaggggataattaacagacaaaaaggaagtactaagtgcggctattatgtcatgcactggatgttcaccatcattttaggaagttttaggaataactgggaagcgaccattacagccagagagattaaaggcactgcggatccagtgggcacagtattatctctgagttag

SEQ ID NO: 12666 - DNA, 429 bp, Glycine max
  Peptide Sequence Number=SeqID_104351
atggtgaaagttggaacctcttacgtgccgatcaacgtctcattttcgccaaacagtggcccagggtcttcccgagttcaacgacatctcaattattttttgaagatgctcttggcctttgacatcacaggtcttattggcgcaataccgtgcgcctcagggctgtcttcctgttcagttgaattgggttatccgctcacaattcgcacacaagcataccgagccggaagcatcagcgggcaaggtgttcagtcgaagtgcgttcgtggagaaaaagctgcaccggtgcgtcagtcagaatatgtgaatacaggactcactattccgggcgaattctcgctcactgagctcgctaccgctcggtcgttcatgcggcgagcgctcagaacagtggttaccccaacggggcaggaattcgagaataatgca

SEQ ID NO: 12667 - DNA, 842 bp, Glycine max
  Peptide Sequence Number=SeqID_104352
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccttgcatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12668 - DNA, 429 bp, Glycine max
  Peptide Sequence Number=SeqID_104353
atgcacagtcaaggtgttccttttgagggcactcttgtggatgattggaaatttgattattcaagtcatgatgctcacagaatggtctgcaatgaccagatcgacttggcccatctagttcagtaccggatgcataaggcattacgggccaatgcacctctcccatatccccaccttgttactttttttcttcatcatttcaatgttcctttggatgatgaaccatatgtcaaggttaaaaggtctttctccattggtgccggtgctgttacctcctttggttaccgaaaggatgttgatggtcagtgggttctcaaacaagacttgccatcgcctattcctgatgaacgtatcctatctcctccaccacaaaggtatgcttcttcttctttgttgactgaagtcctcatagagctccacgatctttga

SEQ ID NO: 12669 - DNA, 213 bp, Glycine max
  Peptide Sequence Number=SeqID_104354
atggcacgcagcgtgtccactccgtgcccctattcaaaggacctatatgggagggagctaacaaggcttttagtgataattcccaaggtggtcatatctcacttgatggtctctagaggtatcatccccttcgaagaacatattgcagcagtagggactactagcaacaatatgtcatcgaagagtaaaactctagatgagggttcactgtaa

SEQ ID NO: 12670 - DNA, 337 bp, Glycine max
  Peptide Sequence Number=SeqID_104355
atgactaggggcaatctaggtgatttacaaccctttgatcttgaaatagatagatcctttcatagattaattaggcatactgtgcatcctggtcattatgtgcattgtgagcattctcttgagggtgattttgaatattctgattttgagcattccactactaatttttatactgagaacatggctcaacctccacctcgtgagaggactcttagggagatgactgcacctgatttcacttatgaaagcttgtgcattcaatatcctgatgagggtgttccatatgttctcaagattggactaatacatttgctgtccaagtttcatggtcttgcag

SEQ ID NO: 12671 - DNA, 324 bp, Glycine max
  Peptide Sequence Number=SeqID_104356
attatgattagaactagagggttaggtcgtgccttaggtagggttatagatagagccctagggagagaggatcatcatgattcagatgatgtttcccaatgtcgaaggcctacagcattcgcacgtaggcaacagcaagctgcccctattgctgaggatgatcctgtggtgattgaagatgtacatgcacatgctgaaaaagctattgatgatgctcagggattttcagaacgtcttgaattgaagttatcctcccatggaaggaaggttcaaaaatttggaaggcctgctccagaaattgaagggctagtccctgtcacatga

SEQ ID NO: 12672 - DNA, 412 bp, Glycine max
  Peptide Sequence Number=SeqID_104357
atgggaagccaacaacgaccatacaataacttccaacaaagaggtttccaaaccatacaaggaaactacaaccaagtaggagacaacaaaccacaacaaagaccaaatttgtgggaccacactgcaaagttggaagaagccttgaccaaactcaccgaagtggtcatcaccaaccacaaaaacattgaagccgtgatcaaaagcatggagactaaaatagagaaattggccaagcaattgcaaacctcttcaattggcttttccacaaccaccaaggagaacccaaagggtcattgcaaggctattatctccaccatagagtgtgacgtgggaggtgaagaagaagaagaggtagaagaaagcaccatgctagaggaagagatgaaagcacaagccaacccttcaacccaag

SEQ ID NO: 12673 - DNA, 513 bp, Glycine max
  Peptide Sequence Number=SeqID_104358
atgaaaaagagcattgcactgacgatggtggcgctggcctgcctggcggctaacgtccaggcagcagagaaacttgctggtaatgaaatacttgccgtacagaaaggcggggtgccggataaagtctatacccaacatcagccgaaattacgtatagcaacctataatatcggcaagaatgaagcgtctgataatgtggccgattttacggcacttaattcagcgattaaaaaaattaacgccgatattattgccgtcccggaagtcgatcacaaaactcagcgcagccagaaaatcgatcagcttaagacgattgccgatgctaacaatatgcattatgcctttggtaaagcgttagatttcgacggtggcgaatacggactggggctgctgtcaaaatataaaatcctgcattctcaggtggtgaagctgccgtcaggcaatgcggaacagcgcgtggcgctactggcgcaggttgatgtaccgggttttgattccgcgccgattattatg

SEQ ID NO: 12674 - DNA, 177 bp, Glycine max
  Peptide Sequence Number=SeqID_104359
atggctcttaccaacaaaatctcttcacaaaggtctccacaagctccttctatggtagaggaagaacaaagctccttcctcccttacaatgctagggtcgacacactaaagaggttcatccacccctgcaactacattcatgatacccttgaccatcttgtcttgccaacaccttga

SEQ ID NO: 12675 - DNA, 1182 bp, Glycine max
  Peptide Sequence Number=SeqID_104360
atggcttctaggaaaagaaaggcaccctctacacctacccaagccagatttgatagatccagattctcttcccaagaggcttgggagagatacactgacattgtggtgcctcgtaagcttttactagaaaggaatgtggtagtctactatacagagtttgatgagttcaagcaggaacttgagagacgccattgggatgaggagttgattgactttctggatgacaacattgatgttgccattgtaaatgaattctatgcaaacctttatgaccctgaggacaaatcacctaagcaggtgagggtgaaaggtcatctgattaagtttgatgaggatactcttaacacatatttgaagacccctgttgttgtggaagagggggaaacactcagtgcttactctagatttgcactcctgaggtctgatcctcaggagttagctgctaagcattgtatcccagggaggagatttgagcttaatgctgatgggcagcctttgaagattctgaggaagagcatgaccatgcttgctcagacttggagcgttcattccttttcaaaccttattcccacttcccacacttctgatgtcactcttgacaaagccgaactcatttatagcatcatcatgaagatggacatgaatgggagttcactcagattcgaggtccccaccacttcagcaccagagacaccaactccttcttcttccacaactccattacctcctattcagactccaattattcctcctacaccctcacatataccacttccaacttctttatctacagatgctacacgccatgctccaaagcatccacaggggcagtccattatcatgcagagccttcagggcttgggcttgccatccattatgagcatggaggagtttgaggctcaggtggcctggccaagagaccagccctcttcttctggaaggggtggggcctttgcagcccagaggcctgtgactgaggaaccaccagcaccagcactactagcaacaacaacaacaaagggggaggatgagctcatccctcccgagcccttttattttgatgcaaatacacacatgcctcaggagaagggtacccccacagatcagataccggagccatcctctgcacctgctcttgaggagacccagccatcctctgcacctgctcctgaggagacctag

SEQ ID NO: 12676 - DNA, 654 bp, Glycine max
  Peptide Sequence Number=SeqID_104361
atggatcgatatttcattgatcttatgttagagcaggttgcccaaggccgtaaatttgaggatcatttgtttagcaaaagagcatggaagcatatgtctacaaagttcaattttcagtatgaaaaagatgtactcaagaaccgccacaaaacattaaggaatttgtacaggggccttaagaaccttcttgcccaaccagggtttagctggaacgaaaagcgaagtatggttattgctggtaatcatgtttgggatcaatatctcaagatattgatcccatcgaattcctgcagcccgggggatccactacttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12677 - DNA, 201 bp, Glycine max
  Peptide Sequence Number=SeqID_104362
atggaaaaatccgacaagaaaaatttcaaagataagaaagaaaaaaaaacatacatcgcttgggaagataatgacatggattcgtcaagtgattcaaaaaatgaaatcataaatctgggcctcatggccaaagactatgaaagcggagaagagatgcattcaatgacttacataaagaatctgtcaaacttgccaaattag

SEQ ID NO: 12678 - DNA, 327 bp, Glycine max
  Peptide Sequence Number=SeqID_104363
atgggtgaagtagaggaggtgcatgagcagatgaaggccgacatggaggccatgaaagagaaaatggccacaaggatggaggccatgatgagcatgaagaagataatggaagccaatacagttgcagttgccgctaccagcgctgttgctaaggtgaattcgatgcccccatctgatcacaaccaaatgaatcatccaacctcagatatggtgggcaaagatttaggaagtacgagcgatatgtgcaaattcaaaacaagcacgccttcccgccatatgtttggcccccaactatacgccacccaatgtggcgtacacacccaataa

SEQ ID NO: 12679 - DNA, 908 bp, Glycine max
  Peptide Sequence Number=SeqID_104364
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgattcgccgtccccgccaggcaggatcgtgatgttgctgatcccgccgagattgcagacgacccgcgtttcgcccggcgcgccgaacaccgtcgcatggaacgcgggcgcgagcggcgcgccgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 12680 - DNA, 621 bp, Glycine max
  Peptide Sequence Number=SeqID_104365
atgttagccgacctatatgacaccttcgaccgaagatgtgagaagagcagtacgaggattgtttgctgtattccagctctttatgtatggttggtttcgcacttttttcgccaagaggtgaggcaagcttgcccgctagaaagccatcgttcatgcacagagaaaggagggacaaattgggaccgactcttagcaaacaaagaaagagcgtctgtcaactggttccctcgatggaaagaaggaagaaccggggttcttatttcatgcaaaggatttccgaatgttcccttgatggggacaaggggttgcatcagttacaatcctgttcttgctataaggcaacttggctaccctatgagaggggcaccgctagaggaagagctcgcgcctatcatttcacgaggtttcaataagaccaacgtggagacacttcagaaggtccgcaaggcatgggaggtggtgcaaaagaaggacaaagaactcagtggcagtaacaatgggcccatcggtggctaccgaaggtggttgaaagcccacgtgcaaggtttggattggctcccgagtttgagaaccactaaaagggaggaagttgaggcatcggaggaagacgaagaggtgtag

SEQ ID NO: 12681 - DNA, 297 bp, Glycine max
  Peptide Sequence Number=SeqID_104366
atggtgcatgatgatacatttattgaactagatcctcctcagtatccggtctccacagtggctatgccagaaccacctgcagctgcacctgctgatgtagacatgcctcgacatgcacatgaggtttgccaagcaataatagaaaggttaaaactcctgattaacctgagggtagtcactgaaggaacatacgcatacactgtgaccgaggagtgcccaaggatcgctagcagtgtgactatgcaaggaaatgtatatgttcgatcgagacgaaaatggtgtatgccagatgcatga

SEQ ID NO: 12682 - DNA, 453 bp, Glycine max
  Peptide Sequence Number=SeqID_104367
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtgtcgggacgggtggtataaacttgcaggaatttcgcgtaatcgccttccaagccttgtttgctgtcgtctga

SEQ ID NO: 12683 - DNA, 420 bp, Glycine max
  Peptide Sequence Number=SeqID_104368
atgacactcgtctttgttgaggcaaagtcaccttcacggcctctcatggtgtcgtcctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12684 - DNA, 414 bp, Glycine max
  Peptide Sequence Number=SeqID_104369
gagtatgcccagaggtggagggatttggtagctcaagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12685 - DNA, 730 bp, Glycine max
  Peptide Sequence Number=SeqID_104370
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaaaacagtcaacaaaaccattaagaatggggccagagaatgggactcagtcatgtatagatcatttttgagatgtgatgatccaaaaggagtagtagaatgtgggacaataaggaaatataggactcgttctcacaaagtgaaggacaagacaagaatccagaagacgggtgaaaacttggagacatccttgtccttgatgaacaaaagatacaaagaagagaataaggtcccaaaaggatgtgatggaaatctcatcgatccatcatcttatagagatattatgtgtgatgaaaagtctaaagatattgcagaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 12686 - DNA, 501 bp, Glycine max
  Peptide Sequence Number=SeqID_104371
atggcgcctaccaggcaccctttggatccagataagtccaacaaggccctgggatttcccgcgctgatcacaggactctgccagtcgtttggagtccccgttacacctaccaaggtgattcggccgcccatcacccgggcttttattgagaagtactgcacccagagacaggctcaaggggatgctccacaggccgtgggcgcgccaccaccacctcatcaggctggcccggctgggtcatttgacatggagcagtatgtcgcaacctacccttcggcgggagggcgacgcgtggctcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 12687 - DNA, 731 bp, Glycine max
  Peptide Sequence Number=SeqID_104372
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggccattatctataagtcaggaattctctatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12688 - DNA, 305 bp, Glycine max
  Peptide Sequence Number=SeqID_104373
atgagggacgacaagaggtcttcgtacgtcattgggagtggggtgaattatggaattggcctcaggggaaagttcctcatcgcgttggaaacgacgccaaagtgggcattgccggtcgggcaagtcatggttggagctggagcttggggggcctccctctggatgggggcgggcgccttaggccgtacggaggtctacgggggcttgacccgtgcgggcgccaaagtgacaacatgggtatctccttccttcctttttgccccagttgctccgactcttttaacattggtacttgtggaggaaac

SEQ ID NO: 12689 - DNA, 764 bp, Glycine max
  Peptide Sequence Number=SeqID_104374
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12690 - DNA, 520 bp, Glycine max
  Peptide Sequence Number=SeqID_104375
atatagagttgaagtcatggtcaattataaagatgaaaacacaaaatttctcctgtggaattgtgaatgcactgaattgattgggcagtcagctgatgaagtcaacaccctcaaaatagaagatggtgatctagatttaaatgcctccccaaaagcacttgataaactactgggtcatctgttcaccttcaaagtcaaaattcagccgcagtataaaaattctactgttttgaagtgctccagtgacttaactttaattaatgatgttctggacatgttgcctgatgttgagacatgttcaaagattgaagctacaacatcgtttgattccaatgatcctgtccacgatgaatgtcaattcatttctataacagcagaccatgatccacttattggacttcccttgacaccaacaaaacgacaaccatttaatgaatgtgatgatgaagcaagaagctcccagatttcaccagctcagctatcgtccaacaaattagcaaaacatgagaagatagaatag

SEQ ID NO: 12691 - DNA, 240 bp, Glycine max
  Peptide Sequence Number=SeqID_104376
tcagaaccatcatctatgttgcaagatggtgaatcaggaggggcaacatcttcatcagatgattcatcgaagatgattatcagaggtggagctggagctggtggaggagataatatttcaagctcaggagaaaaaggtggatccactactggaggtagtggttcagctggtatcggctcagtcctggctagtgcgggctcaggaggaacaacctcatgggatctctctaatggaagctaa

SEQ ID NO: 12692 - DNA, 458 bp, Glycine max
  Peptide Sequence Number=SeqID_104377
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 12693 - DNA, 465 bp, Glycine max
  Peptide Sequence Number=SeqID_104378
atgtcttacaccatcgtgttgtggatcataatcttggctaagtcagggatgcatatcatatttgggagctgcaagattagctttcattcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12694 - DNA, 435 bp, Glycine max
  Peptide Sequence Number=SeqID_104379
atgatccagccggaaatcgggctgccgatcatgctcgacagcggcaggcccaccatgaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12695 - DNA, 2252 bp, Glycine max
  Peptide Sequence Number=SeqID_104380
tctggcagaacaaaaaattcaatgagccgcttggctatccgccgctcgccagcgggccttaccgcgtcacttcgtacaaatccggccagttcattcaatatagtcgggtgaagacctactgggcggccgatctgccggtgaaccgcggtcgctttaattttgataccctgcgctacgactactatcttgatgacaacgtggcttttgaagcgtttaaggccggtgcctatgacctgcgcgaggagagttcggcgaagaaatgggccacacaatatcgcgggcgcaacttcaccagccaagccattgtgaaagccaccacgccgaatgacgtcgccaccgacacgcgctggctggcgttcaataacgagaaagcactgtttgccgaccgccgcgtgcgcgaggcgctgacgctggcgtttgattttgagtggatgaacaaagcgctgttctacggcgcttacaagcggaccgacagctacttccagaacaccgcttacgccgctaaaggctatcctgacgccgatcagctggtcctgctcgcgccctacaaggcgcagctgcctgccgaggtctttaacaacgcctacgcgccgccgcattctgacggcagcggctttgaccgcaacaatttgctgcgggcgatggcgctgctgaagcaggccggctggcagatcaaaaatcagcagctggtgaacgtgaaaaccggccagccgtttcagtttgaactgttgctgcgcagcggttctcagaacgactgggcgctgccgttccagcacagcctggcacggcttggcattacgatgacgctgcgtcaggtggacagttcgcaatatctgcgccggctgcgcgaaggcgattacgacatgattccgtcgctttatcaggcgatgccgtggccctccaccagcctgcagtatgtctggcagtcggattacatcagctcatcgtggaacaccgcgcgggtaaaagatccgctggtcgaccatttcgtgcagcagatcgtggcgcatcagggcgatgagaaagcgctgctgccgctcggtcaggcgctggatcgcctgctgctgtggaacgcctacatgattccgatgtggtacaacgccgagcagcggctggcctggtgggacaagttttcccatccgcagattaaaccggcgtttgccaccgggctggaaaactggtggctgttgctgattattcccacgctgtgggccatcatcaccctgaatttctttatcgtacagattgcgccgggtggtccggtcgatcaggcgctggccaacatccagtttggtcatagtaccggtctgcctggcagcggcggcagtgacagcggtgcgcgcggtgcgctggtgcgcgacaatcccggcgacagccagtaccgcggcgcgcgcgggctggatccggaggtggtggcagaaataacccatcgctacggcttcgataagccactgctgcagcgctatggcgaaatgctgtggaattacctgcgttttgactttggcgacagcctgtttcgtaacgcctcggtgctgcagctgattaaagagagcctgccggtgtcgatcagcctcgggttgtggagcacgctgatcatctatctggtgtcgattccgctgggcatcaaaaaagcggtgcgcaacggcagcgcgtttgatatctggagcagcatctttatcatcatcggctactcaattccggcgtttttgtttgccatcatgctgattgtgctgtttgccggcggcagctatctcgactggttcccgctccgcggcctcacttcgccgcagtttgatacgctgccgtggtacagcaaaatcagcgattatctgtggcatatcaccctgccggtgctggctacggtaattggcggctttgccaccctgaccatgctgacgaaaaattcgttcctagatgaggtgcgcaaacagtacgtcgtcacggcgcgcgccaagggcctggatgagaagcgcatcctgtacggccacgtgtttcgcaacgccatgctgctggtgatcgccgggtttcccgccacctttatcagtatgtttttcaccagctcggtgctgattgaggtgatgttctcactcaacggcatggggctgctcggctatgatgccaccattcagcgcgactatccggtgatgttcggcacgctgtatatctttacgctgattggcctgctgatgaatattctcagcgatctgacctatacgctggtcgatccacgcattgattttgagggccgctga

SEQ ID NO: 12696 - DNA, 282 bp, Glycine max
  Peptide Sequence Number=SeqID_104381
atgtcaatctccctctacggaagtatcagttggggtcgcgcccacaagacacccaatggacccggagaagtccaacagggccctggggtttccagcttgggttacgggcctctgtcagtcctacagggtgcccgttccccccagcaagctctgattacgggcctttgtcagttatacaaagcatccgtcgcccccaacaaggtcattaggcctcccattaaccgggctttcatcatgaagtactgcgcccccaggcaggcgcagggtgagacaccacagtag

SEQ ID NO: 12697 - DNA, 381 bp, Glycine max
  Peptide Sequence Number=SeqID_104382
atgacaccggggggcggagcctatggaaaaacgataggtttgccgcgtctcaccttgccctgttggggaagtgggatcgaattcctgcgcccgggggatccgccccgttctagagcttccgtcgccgcacgaccgagcggtaggagctcaacaggaattcgcggacctatatttttttctgccacagaacgcttcgactggaacaccctggccagttacgccaacatagtaatcgccagtatgcagcacatccgccctttagcgccagctggcgtaatacgcaaaccgcactcgatcgcccttcgcgcaacagttggccgattcagcctgaatgcagcgaatggcgacagcgtttccgactggaatagcggcgcagtgtag

SEQ ID NO: 12698 - DNA, 1028 bp, Glycine max
  Peptide Sequence Number=SeqID_104383
aatgtagcaccagttccccaaatcaccaaacttgtgtggacgtgcgtgaggaatatgccaacacattccgtacggagtcatacactgagttttggacacgtgtccttgcatattccaaggatgaatcctctacttgtttgtctagagagtccaccacttcggccaggcttccctcttaccgtttgtttgcggagcatctcttggacccagatcagtccacggttactcgggccctatcagaagcccaatgtcggcccataatccattctctcttgtctgactattttgcacacactgctaatgcttctcttctttgtagtcatctattaaaggaaattgatcgtgtacgtgtgaagtataggtcactcaagaccatccttcaatgtgttccaactaatcaaattccttccccaatgataatgatacatttaactgaattttccaacttcttgaacccgtttggcgcatccagctcgccgtcggcccggattcgggctacccaatgccaatgctctgacttgcaaaagcggcttgagtcaagtcgtgacaaggcgcgagccaagcttcaattagttgctaggttaaaatgtggctcggcttgcctttttgtggtaattacagcttcatttgttgtgattcttgtgactcatggctttgcaatgattgtggctgtgtcgggattggcttccatgaatttggcttcagaaaggaagttggctaaagtgacatctcaacttgatgcagccacgaaaggaacttatatagttaataaggacttggagacaacaagtcgacttgtggctagactaaatgacgagttagagtacatgaaaacaacaatgagattttggcttgagagaaaaaaggataagtttcaagccgatggtgaagtgatgcgcttgttgaagaagaaccaatgtagttttagcgatcaattggatgagttggaagaacatttgtttttatgttttatgactattaatagggctagagaccttgtgttgaaccagatcactaactcaacttga

SEQ ID NO: 12699 - DNA, 294 bp, Glycine max
  Peptide Sequence Number=SeqID_104384
atggagtacttgaaggaagtggaaggaaaaactgtgcatgattatcttgaggtaaagatgtgtaaaatgacaaagccaataggtgtggaaggaccagtgatagtgggtgctggtccatcaaggcttgctgcagcagcatgttatttggataagtatgttagcaccaggagtttctctggctatagcatggaaccttctatatctgttactgatggcaaagcagggaattccagcttgagtacaacactgactgatttggcctcaaatgtgttggatcgagtgacctcagaataa

SEQ ID NO: 12700 - DNA, 687 bp, Glycine max
  Peptide Sequence Number=SeqID_104385
atggtttttgataaagacattgggcaagataagcaattgggaatagtaaaatttccacttaatgacttggaaccagaaactgaaaaggagtttgaattgaggctgctgtcatcacttgatacactgaaagtgaaagacaagaaggatcgaggaaccataaccataaagatcttttatcaccaatttaacaaggaagaacagttggttgcactagaagcagagaaaaatatactagaagaaaggaagaaacttaaagaagagggagttataggaactacaatggatgcactagatggagcagcctcggcagttgggtccggtgttggaatggttggtactggtgttgctactagtgctggacttgtggggactggaattggtgcgggagctggacttgtggggactggaattggtgcaggagctggacttgtggggattggaattggtgctggagccagtcttgttggcagtggcatcggtgccggagttggttttgtcagcagtggtcttggtgctgttggtagtggactgagcagagcaggaaagttcatgggaaggacaatcattgggcaaggtagttttagaaggagcggctcaaatactcctgtcaatgtgagggggtgggaaaacgattttaatgttcctttccatcaatggtcctcagctatggctatggcttttaattag

SEQ ID NO: 12701 - DNA, 459 bp, Glycine max
  Peptide Sequence Number=SeqID_104386
atgaccatgattacgccaagctcgaaattaaccctcactaaagggaacaaaagctggtaccgggccccccctcgagatagaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12702 - DNA, 719 bp, Glycine max
  Peptide Sequence Number=SeqID_104387
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12703 - DNA, 465 bp, Glycine max
  Peptide Sequence Number=SeqID_104388
atgaccatgattacgccaagctcgaaattaaccctcactaaagggaacaaaagctggtaccgggccccccctcgaggtagaagtataagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12704 - DNA, 183 bp, Glycine max
  Peptide Sequence Number=SeqID_104389
atgggtgccaagcacctcacaaggaccaaagaatggtcacatgtcatcaagcaaagaatgaccaaacttggtctctgcttgtcatcgggcccgccgcctctggatgacaaaagggtgcgaataaccataaggtatctccgcgtatcatgggtgcagaaaaacctgaaaattatcctgtcatag

SEQ ID NO: 12705 - DNA, 966 bp, Glycine max
  Peptide Sequence Number=SeqID_104390
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatatcgccgtggcggccgacgaacccctggtggcccagcactacgagctgcgcctgctgctgggcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttccgg

SEQ ID NO: 12706 - DNA, 827 bp, Glycine max
  Peptide Sequence Number=SeqID_104391
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaaagcccaagcacagtctccttttaccacacatcccttgtctcagaattttatattcttgaactctggtgtgcttctctgggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12707 - DNA, 539 bp, Glycine max
  Peptide Sequence Number=SeqID_104392
tcagtatgacagatcttgtgagcgcggaagatgacgtaaatctccgcgtgtcaacgggcttgtcggccgcgattgacgaatggcgcagaagacgacgtatttccgcccgtcagcgtgactcaaaagtcagtatgacagatcttgtgagcgcggaagatgacggcttttcgtcttatagacaacaaaaagtttatacggataaccactcgggtatttccgcccgtcagcgtgactcagaagtcagtatgacagatcttgtgagcgcggaagatgacggcgcaagaaacgacgttagtctctgcgtgctattaggcttttcgtcttacagacagcaaaaagtttgtacggataaccactcgggtatttccgcccgtcagcgtgactcattagtcaatatgacagatcttgtgagcgcggaagatgacgcttttcgtcttacagacagcaaaaagtttatacggatagccactctggtattatctgcccgtcagcgtgactcagaagtcagtatgacatatcttgtgagcgcggaagatgac

SEQ ID NO: 12708 - DNA, 276 bp, Glycine max
  Peptide Sequence Number=SeqID_104393
atgatattggttaccttggccgacaacgagctgatgtcgatggtctcttctttcctttcactcggaggtgtatacctccacgggactgcgtggctgttttggtatgggaaaggaacaggtttagctatcgaggggtatcggggcttttgtgaagctgcgtccttggtgaaatatatcaccaaaggtttaggccttccaaaacttctctcatctacggactgcattcatatatgctgctcttccctccccttatcaccgacttccagtcagccttga

SEQ ID NO: 12709 - DNA, 750 bp, Glycine max
  Peptide Sequence Number=SeqID_104394
atgtggatggatcggtttgctcttaccttgaacgggagtcaagaacttccccgattgttagccaaggccaaggcgatggcggacacctactccgcccccgaagaaattcatgggcttctcggctattggaaaaacaccataactaaacgcgccacaaggcatccctatcacaccagatccaaatgtagaacgatgggtgatcaagaggagacacaggaacagatgaaagctgacatgtcagctctgaaagaacagatggcttccatgatggaagccatgttaggaatgaggcagctcatggagaaaaatgtggccaccgctgccgctgtcagttcggctgccgaagcagacccaactctcttggcaactgcgcaccatccttcctcaaacatagtaggacgcggaagggacacactggggcacgatggcaaccctcatctgggatacaaccgagcggcttacccttatggattgccgcccaactactcaccacccgtcctgcaagacgatgcgggccatattgcttctcccgtccttgaaagagagcctcctcaacagcccgacgaggtccacaaagaccctcaagtggctcctcccatggttgagagagagatgatcaccatgatggtagacactctgccagtgttctactatgagaagctagtaggttacatgccgtccagcttcgcggacctagtgttcgccggggaaagaatcgaggtagggttgaaaagaggaaagttcgattac

SEQ ID NO: 12710 - DNA, 597 bp, Glycine max
  Peptide Sequence Number=SeqID_104395
atgtggagataccttatggttatccgcaccttttgtcaactagaggcaagcaagcccgttgacacgcagagactaaagtcatcatctgcacctttgtcatccagagacggcgagtctgatgacatgcagagataccttatggttatccatactttttgtcaaccagaggcaggcaagcccattgacacagagagactaacatcgtcatctgtacctttgtcatccagagacggcaagtccgatgacatgcagagataccttatggttatccgcaccttttttcaaccagaggcaaaggcaagcgagcccgttgacacacagagactaacgtcgtcatctgcacctttgtcatccagagacagcgagttcgatgacatgcggagataccttatggttatccgcaccttttgtcaaccagaggcaagtgagcccgttgacacgcagagtctaacgtcgtcatctgcacctttatcatccagagacagcgagtctaatgacatgcagagataccttataattatccacaccttttgtcaaccagaggcaagcaagcccgttgacacgcaaagaataacgtcatcatctgcacctttgtaa

SEQ ID NO: 12711 - DNA, 306 bp, Glycine max
  Peptide Sequence Number=SeqID_104396
atgtcaaatcataaaagcactaagtcagcactgaaaaaccttcaggttcaggtgggacaactggccaagcagatagttgacaagtcatccaacagttttgtggtgaatatagaaaagaatcccaaggaggaatgcaaagctgtgatgacaaggagtaaaaggtttgtggaggcggaggatgaggataatgttgtatccaagaagaaagttgctgaaaagaaaggtactaatgaaaagaaagatgatgagagaggtgaaagcaatcaagaaaaagaaaaacaaataatggtcaagaaaaaagaataa

SEQ ID NO: 12712 - DNA, 812 bp, Glycine max
  Peptide Sequence Number=SeqID_104397
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttactagttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12713 - DNA, 509 bp, Glycine max
  Peptide Sequence Number=SeqID_104398
atggtgaaagttggaacctcttacgtgccgatcaacgtctcattttcgccaaaagtctggcccagggctcggtggaaaacagtttgggacgaatactctggatttaatttattggaatcgtgtatttccgttcacaggtgctccagtggcgtatctggtttctatcagctgttcctcctgttcagctatgacggggtggtgttatccgctccaattcggcacacaagcactacgagccggaagcatcagcgggcaagtgtaaagcctggggtgcctaagacggcggatgtgtgcatactggcgattactatgttgggtacactgtgccagggtgttcagtcgaacgctgagccaccgcgtgcgtccgctcagaatagtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12714 - DNA, 830 bp, Glycine max
  Peptide Sequence Number=SeqID_104399
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccaccgtcacaacccaaacacctcctttaggccccaccttcaacgttggggatcaaatttcaacatgaggcttggcagaggaatgtccttccttaaatccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12715 - DNA, 456 bp, Glycine max
  Peptide Sequence Number=SeqID_104400
atgaccatgattacgccaagctcgaaattaaccctcactaaagggaacaaaagctggaggtgtttgggttgtgacggtggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12716 - DNA, 240 bp, Glycine max
  Peptide Sequence Number=SeqID_104401
atgcgaggttaccttttggttacccacacctttcgtcaaccaggggcaaacgaggccgttgacgcgaagagactgacatcgtcttctgcaccttttgccatccagggacagcgagtcaggtggctggcggagataccttattgtcatccacgccttttatcaaccgaggggaacgaattcgaaggttccgctggcggggatattgaccagccaaaagacgttctgctcgaacgaaattag

SEQ ID NO: 12717 - DNA, 150 bp, Glycine max
  Peptide Sequence Number=SeqID_104402
atggagtcgtcaactgtcgcaacaaaccctttgacgggagggcaagttatatcaccaaactccatatatagtgtgcctgcatatacatctatcttagttctagcagttttcataaaaggtttgcctagactgatgggaactgatccttga

SEQ ID NO: 12718 - DNA, 171 bp, Glycine max
  Peptide Sequence Number=SeqID_104403
atgaacttagagaatgttcaaagtggaaagacttctattatgattcttgatgcaatcctccctaggaagggattaatcaccagagccatgaataagaggctccaagaggattgggctagagctgctgaagaaggccctagggttctcatgaatcttaggatagatttctga

SEQ ID NO: 12719 - DNA, 960 bp, Glycine max
  Peptide Sequence Number=SeqID_104404
atggcgttctctctccctccaccaccaccctctctctctctccacttcacgcgccgctccctcctcctcctctccaccaccaccaccctctctctcccatccacacctccacctactcccattcccaccacccccacagtcaccgaccgcgtcttcatggactttagcctctgccccaacaacttcctccccgaccgcgccgacgccctctcccctctctgctccgactccaacctattgggtcgcgtcgtattgggcctctacggcaacctcgtccccctcaccgtctcgaacttcaagtccatgtgtctgggcggcctcaacgccacgtcatcctcgtacaagaatacgctcgtccacaaggtgttccccggccagtacttcctcgccgggcgccagggccgccccgacaagggcgaggtccgcccgccgcacgacctgccgcgcaacacggagacggtcgacgctaaggcgttcgccctcacgcactcccggcccggcgttgtttcgctctcgctctccgaaaacgacgacgacgacgagattaagctcgatcctgggtaccggaatgtagaattcttgatcaccactggtcccgggccttgcccccagctcgataacaagaacattgtctttggaacggtgctcgaaggtagtgctaatgatggattggatgtcatcacagctatagcttccattcccacataccaaccatctgagcgaattcgccagtttaacgacttggctcgattttttggagatgaaagggctcagaatgcacacggtggtggttgcaacggtagtagtgatgatgacaatcatgatgatagttccaatggtgatcatggtggtggcaacaacgatgacgaaggtcataacaggggtggtgacgacgatcatggtgatggctgcaacagtggtcttggtggtggcaatgatagtcatggtgataatgattga

SEQ ID NO: 12720 - DNA, 67 bp, Glycine max
  Peptide Sequence Number=SeqID_104405
atggatggtccccggacgaaattagggtatgacagttcgccagtaggcggccaaccaccgggggcag

SEQ ID NO: 12721 - DNA, 169 bp, Glycine max
  Peptide Sequence Number=SeqID_104406
ggcgaggctcacaggtgcgctttccaaaggaggcaagatgcgcggagtcgccaccaacgtcgacaaaagtgggacttttgctcctacgtaccctcctttggagaggaaatcagacctacgtagttctttcttaagcgtgaatcaagcgattcttttacttgaagagtga

SEQ ID NO: 12722 - DNA, 162 bp, Glycine max
  Peptide Sequence Number=SeqID_104407
atggcttccatcattatgtctatttgctcttacatggcctccatgtcggccttcacctgctcttgcacctcctcaacttcactcattactctagctctagcaggtgttcggaaagaatgcaatgaggaatgcaaccaaggtgaaaagcatgaatgtttgtga

SEQ ID NO: 12723 - DNA, 480 bp, Glycine max
  Peptide Sequence Number=SeqID_104408
atgaggcaccaaatccctatgataggtggtatgatgaatgtgttgagtggtgcaaccttattttgtaaaatcacccatgcatccaacacctttatgattgacatacatagggactcattaggtaggaataatcaacatgaaaatacaaaaaaagcaccactcattcagttggtgaggaaccatgttacctcatgggaagatgcccaggaaatgggttttcagaccttaccttactccaacataccagacaccactaatatatatgtttttattctttttacatgtgttgagggaagaagccttgagtttcaagaacctatggatttgaggtcaaatccttttcaaggggtagggaatgatgcaatcctaccgtccccaaaggcattggatagaagactccaagaagattgggccagagatgcaaaagaagaccctagggttctcatgagccttagggtagattttgagcccatgagctaa

SEQ ID NO: 12724 - DNA, 881 bp, Glycine max
  Peptide Sequence Number=SeqID_104409
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctttccaggaagaaggctgggttgtatgtagagtgttcaaaaaacgaatgacaacagtgaggaaaatgggggagtatgagtcaccatgttggtatgatgacccagctgtctcattcatgcaagagcttgaatccccaagcagaatttctaacccttatgcatcataccaccagcactaccctttcaagaaggagttggaattgcaattcaatataccccatgatgctttcctccaacttccacagctagagagtcccaaagttcctcaatcttcaaccagtttgaattgtagccaagttatcccatatggctatggtagcaataataatggcaatgctttgcagtcattgtcactcacgcaagaggaacacataaaacaacattgccagcaacaaagtctgcaatttccgtatggtagcaatgatcaagcagtgggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 12725 - DNA, 813 bp, Glycine max
  Peptide Sequence Number=SeqID_104410
gcgggcaaaattgtctcgctggcgccagacgacattgccgataaagtgttaaagaaagggcgcggaggctactgctatgaggtgaacgggctttttgccatggcgctggcggcgttaggtatcccttaccgtttcgtggcggcgcgcccgatgttctaccccgtgcggaggccgaaaacccatatggcgttaattgccgaagtggagaaccgacagtggctttgcgatcttggctttggcagctacggcatccgcgcgccgatggcgctggacacgcttgacgtggatatcacgcaggatttcgacacgtttcgcctcagccgtagtgcggagggcgaatatcttcttcaggcgaaggttgagggtgagtgggcccgtcagtacggcttcgaccttacccctcaggagtggattgatttcgttccggctaactaccttaactccacgcatcctgacgctatttttgtgcagaaactggtggtggtgcagcatcgcccggaagggcgccagattttgctgggcgatatgctgaaaaccatcacggcgaacggcactgaaacgcggcagttggcggaggaggacatacgccatgtcctgaaagaccgttttgcactgaccgccgcaaaagagagagcaggcagaggatttgtaccgtccgcaatgaccacagttgaaaacgccattgataccgctcccgggcatcggcttctgcgatcgggccagcggcgtcagaggcgcgttataaaacgtatcccagtagcagtggagggtatccaaggcttatatccttttcctgagccgcccatacggcag

SEQ ID NO: 12726 - DNA, 231 bp, Glycine max
  Peptide Sequence Number=SeqID_104411
atgggggtgcaaatagcaatcaggcccacttgggccctccagaagattcctccagaaggctgttgcttctggaggaagcaacctggctcacctgggcgagctgagctcgcctgggcgaccgaggcgcctccgaaacgtttccgtaacattttccgtgaggaacttcgcaaaggttttgaccgttcttcgacgttcttcattcgttcttcatcgttcttcgatcttcaacgg

SEQ ID NO: 12727 - DNA, 480 bp, Glycine max
  Peptide Sequence Number=SeqID_104412
atggatttcctacctctaatgtccaaatcttgtggatttgggatgaccggccctctcgatgagtcgatctcttgctttctcataagggtggacccttgggtacttgtacctatcacttttagaggactacacgtcctcgccaacagagggctgcacgccctcaccttgagaggactaaacgtcctcgccttgagaggactacacgtcctcaccatcagagggctgcacgccctcacctccagaggactacatgtcctcgccttgagagggctgcacgcccttacctccagaggactacatgtcctcgccttgagagggctacacgccctcaccttggttaccctcaccgttgagaggactacacgtcctcgctttgagaggactacacgtcctcaccatcagagggctgcatgccctcacctccagaggactacatgtcctcgccttgagagggctacacgccctcaccttgggtactag

SEQ ID NO: 12728 - DNA, 597 bp, Glycine max
  Peptide Sequence Number=SeqID_104413
atgttgaaaggaaacacatgtcaagaggatgccaccttgggtacctccaaccatttccacaccatcagcaaaccactctcatctccagtgaagaagaggccaccaggacctaactcaatcaatgccacatctttctttgataatgatagaaagaatttgaaaacagacttcattacaaaccatgttacttacaatagtaatatatttatcaaagcaggagaagattacatctgctgggaagaatataaaagaatgaaattgacaaataagtcatccttatcaccatctgcttcaagaggaaatagatgggataatacaactccaatgttgaaaggaaacacatgtcaagaggatgccaccttgggtacctccaaccatttccacaccatcagcaaaccactctcatctccagtgaagaagaggccaccaggacctaactcaatcaatgccacatctttctttgataatgatagaaagaatttgaaaacagacttcattacaaaccatgttacttacaatagtaatatatttatcaaagcaggagaagattacatctgctgggaagaatataaaagaatgaaattggtatttctataa

SEQ ID NO: 12729 - DNA, 131 bp, Glycine max
  Peptide Sequence Number=SeqID_104414
atggctgaaccatcaaagaagcgcaagggttcttcaagtcgaagccaacgacatttcgaggctcaagaaacgcagattccctcctccatttcctcttcctcattgttttcattagaagaacaacagatacg

SEQ ID NO: 12730 - DNA, 306 bp, Glycine max
  Peptide Sequence Number=SeqID_104415
atggaattgggaatctgtttcgagacttcgtcattgagagctactaactgccattattccgagatcgaattcctgcagcccgggggatccactagttctagagcggccgccaccgcgggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12731 - DNA, 137 bp, Glycine max
  Peptide Sequence Number=SeqID_104416
atggctccgaaaaagctttccgcgaagagatctaggagggacgccgcgactgaaggaaccagtgccgcccccaagtttgatagccaccatttcaggagcgtcgagcaccagcagcacttcgagaccatcaaaggatg

SEQ ID NO: 12732 - DNA, 537 bp, Glycine max
  Peptide Sequence Number=SeqID_104417
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttgggtcgggcgcgtccgaagccggccaaagctctcctaggctcagcatgaaagggtcctggtgggcaggccggaccgggaagggcggggcgcatggcgccgccgcacgtgccccggcgtgtcgcgccccagagggaccgctcgccgggaatgaagatgatgcagacacccgcggaacgggtaccgagctcgaattcgtaatcatggtcatagctgtttcctgtgtgaaattgttatccgctcacaattccacacaacatacgagccggaagcataaagtgtaa

SEQ ID NO: 12733 - DNA, 102 bp, Glycine max
  Peptide Sequence Number=SeqID_104418
atggcagaaatcgaccaaggtaagacgatgaccggtcacgattggccgcatattgtttgtctcctacttgcaggttcaagtaggcaaaacgctaacccgtaa

SEQ ID NO: 12734 - DNA, 183 bp, Glycine max
  Peptide Sequence Number=SeqID_104419
atggtggttgtgggtgatggagaaagtgcttgggacgttagaaatgactttggaagaaagaaagaagaaatggtgtttttcctaagctacacgaaagcaaaggctgaaaatgctcaagtgagaaatggtctcggacacggaaacatcgcgcacactccagaaatcttctcgaagatcccaaag

SEQ ID NO: 12735 - DNA, 3736 bp, Glycine max
  Peptide Sequence Number=SeqID_104420
atgacgccgggactggtcatttacgccggacagcgatttggcggatgtccggaaaccggggcgtatccaattgatatcgatacctccgcgccagaagccagcaaaggtaatcagctgattgacgacgttggcctggtgcagggtccgattaacagcggcgacatcaccgatgacgcgacgcccacctttaaaggtaaaaccgagccgggcgccacagtaatcgtgcgcgataacggtaatgaactgggtcgcgcggtagctgataaagacggtaactggagcttcacgccggatcagccgctggcggatggcgaccacagctttaccgttcagccggtggataaggccggaaacaaagggccggaaactgatgccattgacttcaccgtagacacctccaaagtggtgattgctatcactcaggtgtatgacgatgcgggcagcattaccggtaatctcacgtccggtcaggtgacagatgacaccacgccgaccctgaaaggcaccgcaaccggcaacgcgctggtgaaaatttacgacaatggccagctgattggcagcacggtggcagccaaagacggcagctggagctttacgcctggcgttgcgctgagcgaagggccgcacagcctgacggcgaccgccaccacgccggcacacggcgagagtgaggccacagccgccttcgatatcactattgatatcacggcaccaaacaacgcgggtattgaggatgtccgtgatgacgtgggtacagagcagggcaccgtggacaacggcggcgcgactgacgataccacgccaacgctgactggcggcggtaagccgggcgacgtggtaaccattatcgataacggtgaaaccatcggcagcgcggtaattggcgagaatggcaagtggaccttcacgccggaaactccgctcaacgacggtgagcacaaatttgaaaccgtgatcaccgacccggcgggcaacagcagtaagccgtcggatccttatgtagtgaatgtggatacgcaggcaccgaataagccagcgatcactgaagtgtatgacgatcagggcgatcgccgtggaccaatcgctgcaggcgacaccaccgatgacgcgacgccgacggtacgcggtaccgccgaagccgacagtctggtgaatatttatgacaatggcgtgctgataggctcaacccgcactgacggcaaaggcaactggagcttcgagccaccgttaccgctggccaacggtgcccatgcgctgacagcggaagcggtagatgccgctggtaacgtcagcgagtcgtcagacaagtttgagtttggcctgatcagcggcggtgtgccgaatgcgccggcgattaccagcgtaatggataacgtaggagacattcagggcctggtgcagaagggaagcgtcaccgacgatgcacgaccgaccataaacggtaccgcacagccgggcagcctcgttacgctgtacgcagacggtattaagctgggcatggtaacggctgacgccaacggtaactggagctatacgccagccagcgatctgcgtgatggcgtgcataacatcagcgcgacttccaccaatgctgccggcaacgtcagcccggaaaccggcgtctatccgattgaagtggataccacggcgccaggcaacatcatcaatccggtactgaccgatgatgtcggccaggtacaggggccgattcgcagcggcgagaccaccgacgatgccacgccgacctttagcggtaaaactgagccgggcgctacggtaatcgtgcgcgacaatggcaaagagctgggcagagcggtcgccgatgacagcggtaactggacgtttaccccgggcacgccgctggcggatggcaagcacagcttcaccgcgcagccggtcgatctcgccggtaaccagggcccgattggcggggcgattgactttaccgtcgacacttctgcggtggtggtagcgctgacccgcgtggaagacaacgctggcagtgtcacaggcgatctgagttccggtcaggccaccgatgacaccacgccaacgctgtacggcaccgcgacgccgaacgcgctggtgaaaatttatgacaacggcaagctgattggtcaggtaagcgctaacgcgcagggccagtggaacttcacgccgggcacagcgctcagcgaaggttcgcacgccctgaccgtgacggcgaccactgaagcacacggcgaaagtgagccaaccagtcagttcgatctgctgattgacctcaccgcgccgaacaagggcgtgattgattccgtcagtgacgacgtcggcacggttcagggaccaattggcaaaggcggctacaccgatgacaccacgccaaccctgtccggccgcggtacgccaggtgataaggtcaccatcatcgataacggtacgccgattggtgaagccaccgttggcaacgacgggcgctggagctttaccccgactacgccgcttaacgatggtacgcacaacttcaccgtggtgatgaccgatccggtgggcaacagctcggcaccgtctgagatctggccggtgattgtcgatacccaggcgccgaatccggtggtgatcaccagcatcattgataacgtcggcagcgtgaccggtgagattaagcgcgacggcgtgaccgacgacaagcggccaacgctgaatggtactgccgaggccaatagcatagtaacgatttacgttagcggcgtgctgatgggctcggtgaaggctgacgccagcggtaactggcaacacacgctgacgcgcgatctggctgacggcaggcacgagatcagcgccaccgccaccgacgcggccggtaacatcagcgcgccgacgccagtgtggtcgatcactgtcgacaccgtggcaccgaacctgccagcgattgttcgcgtctacgatgacgccggcagcatcaccggtgatgtgctgaacaatggtattaccgatgataagcggccgaccatcagcggcaccgccgaggtcaacagtatcgttaccgtatacatcgacggcacgcctgccggtaccgtacgcaccgatggcagcggcaactggagctttaccccgggcagcgatctggccgacggcctgcaccgcatcaccgccaccgccaccgataccgcgggcaacaccagcggccagaccgcggcgtggaacattaccgtagacaccgtggcaccaaacgcaccggtcattgtcaccattgaagatgatgtcggcagcattaagggcaacatcgacaaaaatggcgttactgacgacaaacgcccgaccctcaacggtaccgccgaggccaacagtctggtgacggtgtacattgatggcattgccatgggcagcacccgcgccaatggcagcggcaactggagcttcatcccagccagtgacctgacggacggactgcaccacatcagcgccaaagccagcgatagcgccggcaacagcagcggtgaggctcagacgtgggatatcaccgtcgatacggtgatcagcaccccgaccatcgatacagtgtatgacaacgccggcagcaaaaccggtaacgtggctaacggcggcaaaaccgacgataccacgccgacgctgtcaggcaaggcggaagccaacagtgtggtgaccatttatgatggcagcacgaagctgggttcggtgaccgcgggggcagatggcaagtggacgtttacgccgtcaccggcgctgagcaatg

SEQ ID NO: 12736 - DNA, 1569 bp, Glycine max
  Peptide Sequence Number=SeqID_104421
atgctacatctgtttgctggtcttgacctaagcaccggcctgttattggttcttgctctgctgtttgtgttgttttacgaagcaatcaacggctttcacgacactgccaacgcggtcgctacagtcatttacacccgtgcgatgcgggcgcaactggcggttgtgatggccggtgtgttcaacttcttaggtgtgctgctcggcggtttgagcgtggcttatgccatcgtgcatatgctgccaaccgatttgctgttgaatgtcggttcggcgcatgggctcgccatggtgttctccatgctgctggcggcgattatctggaacctcggtacctggtatctcggcttaccggcgtccagttcgcacacgctgatcggcgccatcatcggtattggtctcaccaatgcgctgatgaccggcacgtcggtggtggatgcgctgaacctgccaaaagtcatcaatattttcctctccctgattctgtcgccgattgttggtctgatcattgcgggtggcctgattttcctgctgcgtcgctactggagcagcaccaaaaaacgggctcgcatccacatgacgcccgctgaccgcgaaaagatcgacggcaagaaaaagccgccgttctggacgcgtatcgcgctgattgtctccgccattggcgtgagctattcgcacggtgccaacgacggtcagaaaggcatcggcctgatcatgctggttctgatcggtgtcgcgccggcgggctttgtggtgaatatgaatgcctccggttatgacatcacccgtacgcgcgacgcggtgaaccatctggaacagtattaccagcagcacggccagtcgctgacgcacatcgtgcagatggcgccaccggcagtgccgacgccggaagagtcgctcggcggcccgcaggagttccattgtgatagctcccgtgcgcttgatgcgattaaccgtgcgcagggtctgctggcgcggtcagatgcgtcgtctgctgcttgcatctccgacaccgcggacaaagccgctaagctgccggagaccagcgccgacgataagcgcttcctcaataagctgaaaggcgatctgctcggcaccatcgagtatgcgccggtatggattatcgtggcggtcgcgctggcgctcggcatcggtaccatgattggctggcgccgcgtggcgaccaccatcggcgagaagatcggtaaaaaaggcatgacgtatgcgcagggcatgtcggcccaggtaacggcggcggtgtcgattggtatcgccagctacaccgggatgccggtttcgaccacgcacattctgtcatcgtcggttgccggtaccatgctggtggatggcggtgggctgcaaagccgcaccatcaaaaatatcgcaatggcctgggtattcaccctgccgggttttgtcgtggtgcgttgcgaatacaacacagcgcgccgcgacagaacccgctcccctctcagtgccaaatcgccaaggcgatcaggctcaccaccaccagaaaacacagcccgctggtcagaacaaactgaccacgcacccgctcgcagcgacgaataa

SEQ ID NO: 12737 - DNA, 2691 bp, Glycine max
  Peptide Sequence Number=SeqID_104422
ccggacgatgcgccgctgtggctgacggtaaaaccccaggccagctggatcgatagcgatcgcaaccacaacggcgcagcggataacaatgaatgtgtgtcgctggtgcaggtcggcggccaggcgcacgccgacagcgtccagctggccggcagctatgtggcgcgcggcgcctgggcttacggtctgtacgccttcgcaccgggccgcgccagtggcgatgagcgtctggggataaccgcgaaaccttatctgccggagccggagcctgaaccgcagcccgagccagaaccgcagccggaaccggaaaatccgcaggtgccgcagccagagccaaaaccggagccgggcaaggtgcgcgcggcggtgattccgcaggtgccggcctacatctcgctgcccgccgccttccacagcgtgacacacaacctgcaagcgctgttcagcagcagcgcgcagcaggcgtgcgcagagggccgtccggatctgtttgtgtccggctacaccggcgacgaccgctatcacagcgcgggcggctttatggattacggctacgatttccacagccgctatcagggctggatgattggcagccgcttcccgctgcagtccgcgctggcgctgagcgtcggcgtcaataagggcaacctgagcatcacgccggaagcgcgcgacggcaacagtcacgcccgcgtcgatacgctgggcgccagtgcgctactgagctggcagcccgatcagggcctgcagctggccgtgccggctggcgtgatgcagtaccgcggcagcgtcagcactgacctgcgcggtaacgtaacgcagctgaaagcgcgcggcgctaacctcgggctcgacagcggctggcgctggcagtccggcgcgcatgcgctaacgccggtggccggtgtgaatgcgcagtggctcgatatcaatgatttcaccgacagcgacggcgcacaggtcagctaccggaatccgctgcaatggcagctctccggcggcgtaaaatacgacttccgcaccaacgagaagctgaagctgggcgcagaaacgcgctacgtgcagcgcatcagccagcgcgatcgggtagcgattggtgacggccagcaggcagcgcacttcgccaccggacgcggcggcaatagcctgcaatacagcggttacgccggctggcaggtgctggacaatctggagctcaacacccagcttcagggccagcagcgtctgacgcaggaaggcatcagcgactggaatctgcaggccggtttgcgattctcgctattttcatccatggaagagaatatgaaacttaccccgctgacgctggtgatcagtgcgttctgttatagccttcctgcattcgctgatgagcgctaccctgcattttccacatcacaaaataataacgttaacgctgcgaatattccgcatccaccggggccctttcatggtccatcaacccaggaaatccctgagctgccgctgcttgcgcaggtcagccgccagactggcgaagggattaaacagcttgggaaaattatcgcccgcggctcgtggtttgatgagatcaatccggcaacctcgggcctggtgcgatccaatgtgctggccggcaataacagccatcatctgtggtattaccggttacagaccatggtcctgaccggggagaaagatgaaggattgccgaatattaataatcctggcatcgtggctccgatacccgaccccggtaaaggcgaagctgtcatattgccgccgccaccgccgcctgagccggaaccgccacagctcacacctgcgccacaaatcccgacctacctcgccctgcccaacatgctgtatgccctcaacgacgccatgcaaacccgcttccacttcgctgcccaacagatgagcatggatgatcatcacaacctgtttgtgtatggctatagcggcggcgagcgttatcgcagtgcgcagggcgatagcgatgccaccagccgctatcagggctggatgctgggtgcgcgctggacgcctgaagcggaacagagcccgctggccttcagtgcgggcgtgcacaaaggcgtagcgactatgctttcgaatacggcggccgggcgcagccagctgcgtatgcaaacccagggtattaatgcgctgatcggcattcagccgcctgagggttggcagctggagataccgctggggctgacgcattatcgcggcaccttacgccatgaaacccagggtgaagtggcgcggatcagcgccgttagcggcaatatcggcgcagaagcgggctggcgctggctgcaggatgcgcatagcctgatgccgctggccgcagccggtgtgcagtggctgcatgttgcggatttcaccgagcaacagggggcacaggtgaactatcagctggcgccgcagttcagcctggctggcggggttaagtatgattatcagccgctgtcgtcagtgaagctggggctggaggcgcgttatgtctggcacagcggcaggcagaatacgctggatgccggcgatatgcgtggattgccgattgagcgcgcccgccacagcgcccagctgggcggttacgtcagctggcagctgcatgagaacgtcgagatcggcacgcagttgcaggtgcagcagcggctggatcgccccggcgtgagcgactggaatgtgctgagcggagtgaaa

SEQ ID NO: 12738 - DNA, 978 bp, Glycine max
  Peptide Sequence Number=SeqID_104423
atgtctgatttcaatctcattcagcgcccaagaagactgcgcaaaagcgcgtcgatgcgcgaactgttccaggaatcccacctcagcctgaacgatctggccctgccgatcttcgttgaagaaggcgtggatgattacgtgccaatcaacgccatgccgggcgtgatgcgcattccggaaaaacgtctggcgtacgaaatcgaacgcatcgccaaagccgggatccgttcggtcatgacctttggtatctcgcaccacaccgatgccaccggcagcgatgcgtggaacgaaaacggcctcgtggcgcgcatgtcgcgcatctgcaaagacacggtgccggaaatgattgtcatgtccgatacctgcttctgtgaatacaccagtcacggccactgcggcgtgctgtgcgatcacggcgtcgacaacgaccagacgctgattaacctcggcaaacaggcggtggttgctgcgcaggccggtgccgacttcatcgcgccgtcagcagcaatggatggccaggtgaaagcgattcgccaggcgctggacgcggccggttttaccgataccgctatcatgtcctactccaccaaattcgcctcgtcgttctacggcccgttccgtgaagcggcgggcaccgcgctgaaaggcgaccgcaaaacctatcagatgaacccgatgaaccgccgtgaagcgattcgcgagtcgctgattgatgaagcggaaggtgcagattcgctgatggtcaaaccggcaggcgcttacctcgatatcctgcgtgatatccgcgagcgcaccacgctgccgctggcggcttaccaggtgagcggtgagtacgcgatgatcaaatttgccgctcaggcgggtgccattgatgaacgcaacgtagtgctggagagcttaggtgccataaaacgtgccggtgccgatctcattttcagctatttcgcccttgatcttgccgagcaaaaagtgctctga

SEQ ID NO: 12739 - DNA, 2448 bp, Glycine max
  Peptide Sequence Number=SeqID_104424
atgagcgacagcgcctgggacatggtgacccgcctgcgtcagtaccagaatcgtcgctgcgccgatattgatgaagatttgcagcgcgccggcacccttaacgcctacttccgctcgattggtaccctgcagggcagcgaaatcacctgctcgtcggcttacgggctgcagcacgacacgctggccgggatgatgatgcagtcgccgccggtgaccggcaaagcctggtggagcctgtcgattcgcggcacctccggcgtaccggatcgcccggcggtgattttcgtgcgtcacctgccggacagcagcggtttctgggcggtgattgatggtcagtatctgatggactttatgcgcgccatcggcgagtcgaaccgttatcagatgagcctgcgcttcaacggcggcagccccatcgccagcggtccggacgaccagccagagctgctgtacctcagcagtgcaaattatcaggcggagtccagccgctatccaatcagcgtcagcgtgacggtacccgctgccgagctgatcaaagcctggcgtcaggcgctgcttattttcctgccgatggccgccatcttttcgatattgctgatggtgctgaccgccaactggctgcgccgccgcctctcatgggcggatgaaattcgccgggcgatacgcaaccgtgagttcacggtgcactatcagccggtgtacagcaccgggattcagcgctgcaccggtgcggaagcgctgatgcgctggcagcggcccaacggcgaaatgatccgcccggatatcttcatcagccatgccgaagcggaaggcatgatcgtgccgctgacccagcatctgctggcgatgatggcggaagatatccagagctggcaggttgaaccgggcttccacattggctttaacctcgcagctgagcatctgcaacaccccgattttgtgcaggacatgatgcgttttgcccgcaacatccgtgacaaacagatgctgatcacgctggagcttaccgagcgcagcctgatcgaggacggcgacgcggtgtcgcgcaagctgcgctatctgcagtcgcacggcatgaaggtggcgattgacgacttcggcaccggccactgtgcgctctcctatctgatgaccttcccgctcgattacctgaagattgaccgcggctttatcaacgccattgaaggactggagatcgaaaccccggtgctggatgccatcatcaatctgtgccacaagctgcagctcgaggtattgggtgaaggggtagaaaccgcgttgcaatttcagtatctgcagcagcgggcgccaaccgctttcccgttgaggaccaccatgagcctgaactgcatcattcttgatgattatcaaaatgttgccctgtcgctggccgactgggcatcgctgcaaccgcaggtacaaactaccgcgctgcaccgccactacgccaacgaagatgaactggtcgctcacatcgcgcacgccgacattctggtggtgatgcgcgaacgcacgccgctcagcgcccggctgataggccgcctgcccaatctgaagctgattgtcacctccggtatgcgcaatgcctcaattgatctgcacgcctgtgccgaacggctgattgcggtgtgcggcaccgccagtagcagcgcggcgccgctggaactgagctgggggctgctgctcggtctggcacgccacatcccggcggagagccaggcgttgcgcagcaacggtgcgtggcagcatacgctgggcatggcgctgcacggcaaaaccctcggcctgcttgggctgggcaagattggcggtgagatggctaacgtggcgcgcgcttttggcatgcgcgtgtgcgcctggagccagaacctgagcgaagcacgcgcagcggcgtgcggcgcagagaagatggcttcgctgccggcgctgctcggggcgagcgatgtggtatcgattcatctggtgctgagtgagcgcacccgtcatctgctggacggcgcggcactggcgcacatgaagccaggcgcgctgctgattaacacctcgcgcgccgggattgtcgatcagcaggcgatgatcagcgcgctgcagtctggccagctggcgggcgccgggctggatgtctttgaacaggagccgctcccggccgatcatccgctgcgtcagttgccgaaccgaggcggtggaagatattgctggctggctgcacggcgcgccgctgcgctcgctgctttaagccccggcgcgtcgatagcaccggggttagctgtggcagtacagccgcggcagcccggcataattaatcatctggtcgccattgggcagctggatacgtacgttgcgcgtggtgctgagcatgaaatcgccctggcggcgccaggtggtatcggatacgcgatgcaggcgatagtggcgctcgcgtaccgtgacggtgccggtcagcgttga

SEQ ID NO: 12740 - DNA, 2157 bp, Glycine max
  Peptide Sequence Number=SeqID_104425
atgtggttcccgggcgcagagcgcggacgcgcatcgtcgctgtttgcctcagcacaatactttgccgtggcgatattctcaccgctctccggctggctggtgtcgcgttatggctgggaatggccattctttgtgctcggcggcatcggcgtgctggcagtgtttgtctgggcgggctatatgcgcagcccgcgtcagcatccgcacgtttccgccagcgagttacattacattgaacagggcggcgcgctggtggatatcgacgccgcgcaaacgctgcgcgcacggccgccggtcagcaaagcgatgttcaaaacattgctcaccaaccgcatgctgtggtgcgcctacctcggccagtattgcaccatcgcgcttagctacttcttcattacctggttcccgatctatctggtgcaggcgcgcggcatgaacattctggatgccggtttcgccaccattgcaccggcgctgtttggctttctgggcggcatcagcggtggctacatctcagataagctgctggcgcgcggctggagcctgtcgtgggcgcgcaaaacgccgtacatcgttggcatgctgatggccgcctcgctgattctggcggcggtgatcccttccaacgccggcattatcgccatcatgtcgtttgccttcttcggcaaaggcgtggcggcgggcgcgggcacctggaccgtggtcagcgatacggcgcccaaagaggcggttggcctcgccggcgcgatcttcaacggcatcggtaacatggcgggctttatcacgccgctgttgtttggcgtgatcgttggcctgaccggcagctacagcattggcctggtgttcgtcggcgcgcactgtgtcgtcgcggcactgctgttcctgctggtgatgggcccgattgaacgcgtaggcgatcggcacaacgctgccgctgcaacagaagagaaaacggcgcaaaaggctggcattaaaattttttgctcagctgccgatatcactccttaccatccactgatattaaggagcgatatcgtgataaagctgattaccgttgacgagctgcggccaggcatgtttatccacaagcttgaggtctggtggatcaaggacaaacgcattcgcaaccagatgctgatcaccgataagcgtcagatcgccctgatccgtaacgaggggatccagcaggtatggatcgatcccgagcggtcggtgcgcgcgcctgccacgccgcagccgaagaaagacattccgcagacgccgtttttccgcgagatggatcaggcgcagtgcatcttcaaccagggcaagccgcaggtgctggcgatgttcaacgaagcgcgcatggggcagggcctcgatcttgcctttacccttgagctggtcgatgaaattgccggatcgattacccgcgagccgaccgcactgctcagcgtggcgcggctgaaaaaccatgatgattacacttacctgcactccatggcggtgtgcggtctgatgatttcgctgggcaagaaaatggggctggatgagcagcagctgcgtcgcgtgggcatgggcggattgctgcatgacgtcggtaaagccgcggtgccgctgaccatcctcaacaagccggataagctcaccgacgaagagtttacgattatgcgccagcatccgatcgtcggtgcgcaaatgctgatggaagcccatgcggatgaagatttgctggatattgcgctgcatcaccatgaaaaattcgatggcagcggctatccgcatcggctgcagggcgaagagatttcgctctacgcacgcatggcggcggtgtgtgacgtctacgacgcggtgacctccgatcgcccgtatcgcaaaggctggacgccggcggaggcgatgcacaatatgctgagctggcgcggccactttgacagtgcgctgctgcacgcgtttgtgcgcaccatcggtatttatccggtgggctcgctggccggggaaaaatcgctgctgaagcccaaagtgcatgtgttctggtcgctgcattcgcagcgcgaggtcaaaccggaagcgctggacctcggcgacagcttctgcaccgataccatcaccggcgctgaggacagcggcttgtggcacaacgttgacctgaatcgcatctgggcgctggaaagcgcctga

SEQ ID NO: 12741 - DNA, 1419 bp, Glycine max
  Peptide Sequence Number=SeqID_104426
atgctggaggcgcgggatttggcctgtgcaacctcctctgccagttccaagctgattcacggtggcctgcgctatctggaacattacgaattccgtctggtgggcgaagcgctggccgaacgtgaagtgctgctgaaaatggcgccgcacatcgccttcccgatgcgtttccgtctgccacaccgcccgcatctgcgtccggcgtggatgatccgcatgggcctgtttatgtacgatcgcctcggtaagcgcactacgctgccaggcagtaaaggtctgcgttttggcgcggaatcggccctgaagcctgaaattacgcgcggtttcgaatattccgactgctgggtggacgatgcgcgcatggtggtgcttaacgcgcaggaagtggtgaaacagggcggcgaagtgcgcacccgcacccgcgtaacccgcgcctggcgtgaagccggtctgtggatggtggaagcggaagacgtcgataccggcaagacctacacctggcgcgccaaagggctggttaacgctgccggtccctgggtgaagcagttctttgacgatggcctgaagctgaaatcgccgtacggtattcgcctgatcaaaggcagccatatcgtggtgccgcgcgtgcacaccgagaagcaggcttacattctgcagaacgaagataaccgtatcgtgtttgtgattccgtggatggatgagttttcaatcatcggtaccaccgacgtcgaatacaaaggcgatccgaaaaatgtcaaaatcgatgacaatgaaatcagctatctgctgaaggtttataacgcgcactttaaaaagcagctgaccagcgacgatatcgtctggacctactccggcgtgcgtccgctgtgcgatgatgaatccgattcaccgcaggcgatcacccgtgattacacgctggacgtgcacgatgacaacggtcaggcaccgctgctgtccgtgttcggcggcaagctgaccacctatcgcaagctggcggagcatgcgctggagaaactggcgaaatactaccctgatgccggtccggcgtggaccaaaaacgccgtgctgccaggcggtgatttctccggtacgcgtgaagattacgctgccagcctgcgccgtcgctatccgttcatcagcgaaggcatggcgcgtcacttcgcccgcacctacggcagccgtactgaagtgctgctggaaggcgcgaagagccgtgaagatctgggtgaaaactttggccacgaattctatgaagccgaactgcgttatctggtgaaacacgagtgggtgcgcgagctggacgacgccatctggcgccgtaccaaacagggtatgtggctgagcgaagccgaacaggcgcgcatccgcgactggctggcggaaaacggccagaaaccggcgctgtcgctggcttcgtaa

SEQ ID NO: 12742 - DNA, 729 bp, Glycine max
  Peptide Sequence Number=SeqID_104427
ctgcgcgataacccggacaatcccgacttcgtgccgcgcgtctttctgtttggcgctaaggcggcgcccggctatttgctggcaaaaaacattatctgtgccatcaataaagtcgcggaggtgatcaataacgacccgctggtgggcgatcgcctgaaagtcgtgtttgtgccggattaccggattaccgccgccgagctgatgattccggcagccgatctctcggagcagatctccacggccggttacgaagcctccggtaccggcaacatgaagctggcgctcaacggcgcgctgaccattggcacgctggacggggctaacgtggagattgccgaggcggtcggtgagaaaaatatctttatctttggcaacacggtggatgaggtaaaagcactgaaggccgacggttacagtccgaagaaactgcgcaagcacgatcgctatctcgacggtttgctgaaggagctggaaaagggcaaattcagcgacggcgaccggcaggtatttgcgccgctgctggagagcctgagcaaacagggcgatccgtggctggtgctggccgatttcgccgcttacatcgcggcgcagcagcgcgtcgaagcgctatggcgcgatccggaagcgtggaccaaagcggcgattctcaacacggcgcataccggccgcttcagtgccgatcgttcgattcgcgattatcaacagcgtatctgggaggcggcgcgctga

SEQ ID NO: 12743 - DNA, 1878 bp, Glycine max
  Peptide Sequence Number=SeqID_104428
atgagtcgtcaacaactggcgctgtttgatgcggcgctgacgcgcaccgcgatgctggatgcggtgaaaaaactcgatccgcgcgtacagtttcgcaacccggtgatgtttctggtgtggatcggcagcgtgctcacctcgctgctggccatcggtatggcggcggggcagctgaacggcagcgccggctttaccgcggcggtcgccatctggctgtggtttaccgtgctgttcgctaacttcgccgaagcgctggcggaagggcgcagcaaggcgcaggccaacagcctgaaaggggtgaacaagcacagcgatgcgaggaaactggcggaaccgtttcacggtgcgcagtggcggccggtggcggccgatacgctgcgcaaaggcgatgtggtgctggtggaagccggtgacatcatcccgtgcgacggtgaagtgctggagggcggcgcgtcagtggatgagagcgccattaccggcgaatcggcaccggtgattcgtgaatccggcggggattttgcctcggtaaccggcgggacgcgcatcctgtcggactggctggtgattcagtgcagcgtcaatccgggcgaaactttcctcgaccgcatgatcgccatggtggaaggcgcgaaacgccgcaaaacgcccaacgaaatcgccctgaccattctgctggtgtcgctgaccattgtgttcctgctggcgaccgccacgctgtggccgttttccgcctggggcggcacgccggttagcgtgacggtgctggtggcgctgctggtgtgcctgattcccaccaccatcggcggactgctgtcggcgattggcgtggcgggcatgagccgcatgctgggagccaatgtgattgccaccagcgggcgcgccgtggaggctgccggtgacgtggatgtgctgatgctggacaaaaccggcaccatcacgctcggtaaccgccaggcaacgcagttcctgcccgcgccgggcgtcagcgagcagcagttggccgacgcggcgcagctggcatcgctggccgatgagacgccggaagggcgcagcattgtggtgctggcgaagcagaaatttaacctgcgcgaacgcgatctcagcagcatgggcgccagctttatcccgttctccgcgcagacgcgcatgagcggcgtcaacgtgcaggatcgcctgatccgcaaaggcgcggtggacgcggtacgtcgtcatattgaagccagccacggcagcttcccggctgaggtcaatgcccgggtggaagaggtggcacgcgccggcggtacgccgctggtggtggccgaaggcgcgcaggtgctgggcgtagtggcgttaaaggacatcgttaaaggcggcatcaaggagcgtttcgccgagctgcgcaagatgggcatcaaaacggtgatgatcaccggtgataacccgttaaccgccgcggcgattgcggcggaagccggtgtcgatgacttcctgtcggaagcgacgccggaagccaagctggcgctgattcgccagtatcaggcggaagggcgcctggtggcgatgaccggcgatggcaccaacgatgcgcccgcgctggcgcaggctgacgtggcggtggcgatgaactccggtacccaggcggcgaaagaggcgggcaacatggtcgatcttgactccaacccgaccaaactgctggaagtggtgcacatcggcaaacagatgctgatgacgcgcggttcgcttaccaccttcagtatcgccaacgatgtggcgaaatacttcgccatcatcccggcggcgtttgccgtgacctatccgcagctcaatatgctgaacgtgatggcgctgcattcaccggcctcggcgatcctgtcggcggtgatcttcaacgcgctg

SEQ ID NO: 12744 - DNA, 1134 bp, Glycine max
  Peptide Sequence Number=SeqID_104429
atggcgaaatcgctcggcagcgcgctgacgccgcaggatatcgctgctaccagccagcgcgtcattgaggtgacgctgcaggcgcgcagccagctgctgctgcccgacgaacagggtgagctgcagtcggcgggtgaaagcaccatcgggacgccgcccgacctcggcatcgccaaatggagctacagcaaagggcaaccggctggagccggcaccgatacgttaccggcggtgccgtaccagattctgccgctgaaaagcggggcgcactgccgcggcctgctggtggttgagccggacaacctgcgccagctgatgattcccgaacagcagcggctggtggagacctttacggtgctgattgccaacgcgctggaacgcatggcgctgtcgcacagcgaagccgcgtcacggctggccgccgaacgcgagcagctgcgtaatgcgctgctgtcggcgttgtcccacgatctgcgcacgccgctgacggtgttgtttggccaggctgagatgctgatgctggacctcgccagcgagcagtcgaaatatgtcggccaggccaatcagatccgcgaacagacgctgagcaccatccggctggtgagtaacatgctggatatggcgcgtattcagtccggcgggctcaacctgcgcgaagagtgggtggcgctggacgaggtgattggcggcgcgctaagcagcatgggaccgtcgctgaaagggcacgacttcacgctggatttaccgccggagctggtgctgatcaaaggcgacagcgcgatgctggagcgggtatttactaacctgatcgaaaacagcctgaagtatgccggcaatgccgcgcagcacggcattcgtgcctggcgcgataaagcgcggctggagatcgcagtctgggataacggaccgggcattgcgccggagaatctgacgcgcatttttgacaagtttgcccgcggcgacaaggagtcggccgtgccgggcgtcgggctggggctggccatcagcaaaaccattattgagtcgcatcgcggacgcatctgggcggaaaaccggccgcagggcggggcggtgtttcgcctgtcgctgccgctgccggccgcgcctgaaatttctgaagaagcactgaaataa

SEQ ID NO: 12745 - DNA, 732 bp, Glycine max
  Peptide Sequence Number=SeqID_104430
cgctatcgtccggagaatcccaacggcgaagcggtgatcgttgcgactggtggcggctaccgttttatcggcatggggcgcgaagcctggccggtcgcgcgctggcttaatgccaacgagtataccgcctatgtactgagctaccgtctgccgggtgaaaagtggcagaccggcagacaggcgccgctgcaggatgcgcagcgcgcgattcgcatggtgcgcgcgatggaaaacaaggtgcacctgctgggcttttcggccggcggccatctgctcggcatggcggcagcgcggcctgacttcgtcacctattcaccgcaggattcgctggatgacatccggccatccgcggacagcgtcgggctgatttacccggttatcacccttgaagcaccgtatcagcacacccgtactcaccagatgatcgtgggcaatgacgccacgccgacccaggaagccaactggtcagtgcaaaattacgtcacccgcgcctacccgccaacctttctggcgcaggcggaggacgatcatacctccaacccccacaacactgagctgatgcgcgacgcctgccgccgtatgcgcgtgccggttgagctaatcgaactgagcagcggcggccacggctttggcctcggtaaagccggcacccccgccgcgctgtgggaccaggcggtgcgcattcatgcgcatctggatgctcgccagtccaccgttttttggtcgccatga

SEQ ID NO: 12746 - DNA, 495 bp, Glycine max
  Peptide Sequence Number=SeqID_104431
gcggaagcgccctttaaaatcagcgctccagacgtggttattcctcacgggtgtcgtgagactgcgcaggttgcccggcgttcgcttacgcggcgtccgcggctgcaccattcccgccgccttcagcaggtcgccgatggtgctggcggcgggcacgatgaagtcagcgccgttgctgaggaaccagtggcggattttttttggcccccagtcggggtgctgctggcggaactgaacaaggcgcgcggcgatgtcgggggcgattttatcgggctggagatggcgggcgcgggagagattttcaagcgaggagagctcgccggggttaaagcggctgagccacttgtagccggttttgcggctgatgccgtggcggtgacacagctgcgtcatggattccccgcctgcctggcaggcgaggatgaattcaaggcgttgcatggtaacagtctcagtccagggcatagtgagtctcctctgctatgccgtttataa

SEQ ID NO: 12747 - DNA, 402 bp, Glycine max
  Peptide Sequence Number=SeqID_104432
atgccgacctcgcaaatcatgttatgcatgggcgaatggctggcgcagcggcgtgatgagggattagtgacggatatccctgattctgcaccgcacggtgtatctgttctgcaccctgctgccgttcgcgctggtggcggatttgcacctgatgacgccgctggtgtcggtgtttatttcgtatacctttttgtcactggagtcgctggcggaggagctggaagatccgttcggcaccgcgcccaatcacctgccactggacgcgctgtgcgtgaatatcgaacgcaatctgaaagcgatgaacaacgatttcccgctgccggcagcgagccagccggaccggtgcgcatgaaggtacaaaccggccacatgggtaacactttagaccgggcacatgggtaa

SEQ ID NO: 12748 - DNA, 912 bp, Glycine max
  Peptide Sequence Number=SeqID_104433
atggagtcgggcaaagctgcggtcgacgtcgcgctttacaccctgattcccatcatggtggtgatgctattcatcatgaaatacctcgaagtgaaaggcgtgctggattttgtcgtgcgccacgccacgccgttactgaagccgctggggattaccggcctggcgctgttcgcactcatccagttaaattttgtcagttttgccgcaccgctcgccgcgctggcgatcatggagaagcgcggcacgtcagaccgccacatggcagccacgctggcgatgctgtttgcgatgggccaggccaacgccttttatccgctgattcctgacgggctcaactggagcgccgcgctgctgttctccatcagcggcggcgtgctggcggccgcctcaacctatcatttttttgcccgcaaactttccgacgtcgcgctgcgcgatgaagaccagggcgtggagaacagcgacacgaagccgggactgatcgccatcatcaacacctcgggtgccgacgccattcgcctcgcgctcggttcgctgccgatgctgatcctttccttgtcggtagtgggcatcctgaagagtgccggcgccattgagctgctgacgcagctgctggcaccgctgttacacaaactgcatatcgccgaggtgtatgtgctgcccgcgctgaccaaatgcctggccggcggtaccgcctattacggcgtggttgccggtctggtcgaacaggggcagtacagtgcgcacaacatcaacgcctcggcaggcctgctgattcagaccttcgatctgcccggcatcggcattttcctcgggctctccagccgttttccgcgtctgttccgcttcgccgtgcccggcattttgctgggcattgcgctgcgcgccacggcgcacagcctgctgttctga

SEQ ID NO: 12749 - DNA, 990 bp, Glycine max
  Peptide Sequence Number=SeqID_104434
atggaggcgataccgccgctgccgccgccaatggcgagggttgaatgccggcaaggggttggcttaaaggaacttatcatgcacctgacatttcttggtaccggcgcgggcgcgcccagcctgcagcgcaacgtcaccgccattgcgctgacgctgtcgaagcgcggcgagacctggctgttcgactgtggcgaagcgacgcagcatcagtttatgcgatcggcgcttaagcccggcaagctggaaaaaatctttattacccatttgcatggcgatcacatctttggcctgccgggtctgctcaccagccgttcgatggcgggcctgaccgagccgatgacgctgtacggtccgaaaggattgcgccagtttgtcgacaccgcgctcagcctgagtggctcttataccggctatccactggagattgtagagatcgaagccggtccggtgctggataacggtgagtttcgcgtcactgcttatgcgctgaatcacgtggttgagtgctatggctaccgcatcgaacagcatgataagccgggcttccttgacgcaccgcgcctgaaggcggaaggtgtgccgcgcggcccgtggtatcaggacctgaaacagggcaaacgcatcacgctggaagatggccgcgagatcaacggtgccgactatcttggcccggccaccaaaggcaaagtgctggcgatcttcggcgataccggccctaccgaggtggcgttgcagctggcggcgaacgccgatgtgatggtgcatgaaaccacgcttgaagcggcgatggcggaaaaagccaacgggcgcggccactccactacggtgcaggcggccagcgtggcacagcgcgctggcgcaaaacgcatgatcgctacgcactttagctcgcgctatttgtcacaggatcgggaaaggctactggctgagtgccagtcggtgtttccggccaccgaactggcgcatgattttgcgatatttgaggtgtag

SEQ ID NO: 12750 - DNA, 2938 bp, Glycine max
  Peptide Sequence Number=SeqID_104435
atgaacgccatccccgttaatgtcgccgttgtagacaaaaaaacggttgtcgaagcgcaggtgcttcgcaacggtaaaaatggaaaaccagtaaaaatcaaagccattgccaatgggaaatatatccttgctgaaggtgagaagggtgttgcacctgaaaacatcaccgtcaagcgcgtaggcaaaagtctctgggttatcctggaggatggcgatctggataaacccgacctcatcattgaggatttttttgtctaccctggtcagctggttggtaaagcagaagataacgctttccatgaatacatcgcctctgatgcgcgtgatgatcacgaagctgcagcgcttgctgatggcgattattcagcgctggtactcgggtcagattccgtcccggggctggataatctgctgattgccgaaaatggtctgattaatccgatgttgttaggcctgggtttactcagcgctattggtgcagcggcaggcatcatttatcacaatcacaaaaaagatcacggtaagtcaggtgagggtgaaggcgggaatctgcctgatccggtattcacgcgaggcgcaaccattgatgcggtgacggataacgtgggcgccattcagggaccgctggccagcggcgactataccgatgacgcgacgccaactctgagcggcaccggcaccaatcctggtaatactgttgagatctgggataacggcacaaaaattggtgaagccattgtcgatcaggatggtaactggacatttacgccaggcacggcgctggctgaaggcgaccatagcttacgccagccttccgaaccgtttgagctaattatcgatctcaaagcgccagcacaggctacgctggacagcgtattcgacgatcacggttcgctcaccgggttgattggcaacggcgaggccaccgatgacaatacgccgaccctctccggcaaagcggaaccgtacagtaccgtatcgatctacgacaacggtgaaaaaatcggtgaagcactgactgatgccaacggcaactggaccttcacccctgcaacggcactggctgatggtgagcacgcattcaccgtggtagctgccgaccgtgctggtaatatcggcctgccctctgctcctcacatcatcactattgatacgcaggcaccggtaaatccgggcattggtgaagtcactgacaacgtgggtagcattgtcggaccggtagacaacggcggcagcaccgacgacaggactcctaccatcggcggcggcggcacgcctggcgacgtggtaaccattattgatgacggcaagccgattggcagcactgtcgtgggtgatgacggcaagtgggagtttacgccggaacaacccctggaagatggtgagcacaacatcggtatcatcatcaccgatccggtcggcaacgagtctgcaccttcagatgattacaccattattgtcgatacccaggcaccggataagccgcgcattgttgcggttatcgacaatcagggtgaacagcagggtgaactgcagccgggcgatacgaccgatgatgcgctcccgaccataaaaggcgaggctgaagctggcagcattgttaacctgtatgacaatggcgtgctgattggctccgcgcgtgcagacgccgcaggcaactgggaatttactccgaacaaaccgttcagcaatggcggacactctctcacggcagaagcaactgacgcggcgggtaacgtcagcgaaacgtctgacagctttgatttcaccatgatcaccggtggtgtgccaagcgcgccggcgattattggtgtgctggacgatgtgggtgatattcagggcaacgtcgcgaaaaacggtgtcaccgatgacacccgcccaaccgtgcatggcacggcgcagccaggctataccgtttccgtttatgacggtgatgtgctgctgggcaccaccaccgctgatgaaaacggccgctggcgctttacaccggaagtggacctggctgaaggtgaacatcagctgtccgctactgctaccgatgcggcgggcaacatcagtccgcagaccggcgtgtatccgattatcattgacactaccccgccagaaaatagcggcgacaacaccctgactgatgatgtcggcgcgattcagggcccgattaacagtggcgataccactgatgatgccacacctacctttgacggtaaaactgagccgggcggtgtggtgattatccgtgataacggtgaagaaattggccgagtagtcgcggacaatgacggtaactggacattcaccccggaacaaccgctggcggaaggcgatcacagctttaccgtacaaccggtagataacgccggtaacaaaggtgaagaaagcgcgccagtcgacttcatcgtcgatacctctggtgttgaagtgacgattatcaacgtctatgacgacgcaggcgaagctggctacgtgcaaaaaggtggcgtgactaacgatgctacgccgaccatcaatggttcagcgacgccaggtgcgctgatccatatttatgacaacggtgagctgattggctccgcgctggcaaattacaagggcgagtggtcatttacaccagcggagccgctgaatgaaggcgaacacagctttaccgccacggcgacgaccgaagccaatggcgtcagcgcaccgaccgcaccgtttgatctgatcattgatatcactgccccgggcaacgacggcattgacgaggtgcaggatgacgtaggtagcgttcagggacccgtcgaaagcggcgaggtgactgatgacagcacgccaacgctggttggtggcggcacgccgggtgacgtggtgaccattattgataacggcgaaaccatcggtagtaccgtcatcggtgatgacggcaagtgggaattcacgccagaaacgccactcaacgacg

SEQ ID NO: 12751 - DNA, 757 bp, Glycine max
  Peptide Sequence Number=SeqID_104436
atgaggggagcaccggcggaagaaagcctgtctcctttccttgtgagagatttcggagcgcaaagttttaaggttatacaaagagtccataaggcgtgggaaagcccattaaggaaagataaagaacttaggggcattcgtaatggcatcatcggtggttatcatgaatggctgaaagttcgtacacgagggttagattggctctccaagttaatgattatcaacgaagagaacttcgaagctccagaagaggatgaagaaacgtccggaaagagtgtgccggattacgagaagaaaatacagctaccgcaagagctcttgaacaagaaaccaagagagctcgcaaggaagagcatggccgagacaaattccgtggagctttgtgggggcagcaacagtgagctcaagcttcgaagggaagagaaagaccaatcacgagcacatagcatggaacttgtctcagcgtttatgcgagacaagaccaacatgctagccatcgtcagcaggtaccgagaagaactaaatctagccatggcccacgagcatagagtggcggacgagtatgcccaagtgtacgtggaaaaggaggctataggaagggtgatcgactcattacatcaagaggcaacaatgtggatggaccggtttgctcttaccttgaacgggagtcaagaacttccccgattgctagccaaggccaaagcgatggcggacagctactcatcccccaaggagatccacggacttctcagctatt

SEQ ID NO: 12752 - DNA, 249 bp, Glycine max
  Peptide Sequence Number=SeqID_104437
atggagcgttatctacagcacttggttcgccagcaggcggccaaccaccgggggcaggggcagggtttcgctccttttgtgtgccctactccagagcagtttagggctgaggtcgcgtggcccggagattggcctgaggcccaggcaggggaggcgcctgcaggatccccgggtgatgcagaggaggcccgcatggatgagaagatgacggatttgctcggtttcttgggagggagcggagccacatga

SEQ ID NO: 12753 - DNA, 357 bp, Glycine max
  Peptide Sequence Number=SeqID_104438
ggccctggggtttccagcattgatcacgggcctctgccagtcgttcggggttcccgtcacccccaacgcaccgccaccacctcatcaggtcgatccagttggatcactaggcatggagcgttatctacagcacttggttcgccagcaggcggccaaccaccgggtgcaggggcagggtttcgctccttttgcaagccctactccagagcagtttggggctgagatcgcatggcccggagactggcctgaggcccaggcaggggaggagcacgtaggatcccccggtgaggtagaggaggcccgtatggatgaagaaatgattgacttgctcggtttcttgggaggaagcggagccac

SEQ ID NO: 12754 - DNA, 378 bp, Glycine max
  Peptide Sequence Number=SeqID_104439
atgaggattccttttttacaggccaaggttcaaaaaggtccgaggttgtgtttcaatggggtcttttatcgtgggaacccaatcttgatatctggggtgaaacaaatctgggtgacaaggtgtcggtctcgggccgaacttccacattattccataaggcacacgcatgacaatgatgatttgaaaacaacgtgcaaaattagtcatggctacaaccaggtgggccctcaagcatcccgtttatggcattgtgatactacggttgggaatttacacggacagacccaacgtttcccaattatgttctttcatcagttcaacgaattcatccatccttatctcggttcactaaaactatacacttgtggttctttatga

SEQ ID NO: 12755 - DNA, 237 bp, Glycine max
  Peptide Sequence Number=SeqID_104440
atgaagaacggtggaaaatcttcacgaaatcacccatggaaacgtctcagaagcgttacggaagcgcctcggcttcgatattcttcacggaaacaatttttatcactaatttttagtgaatctcagatactaggagggggaaaagagggaggtggttgctgcccagcttgcccaggcgagctgggttgcttccaccagaaggcaccgccttctgttggaacattctggaaggcccag

SEQ ID NO: 12756 - DNA, 267 bp, Glycine max
  Peptide Sequence Number=SeqID_104441
atggctgtgacaaatttcatggagctttatgaggcagcaacagtgagctcaagcttcgaagggaagagagagaccaatcacgagcacatagcatgtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12757 - DNA, 123 bp, Glycine max
  Peptide Sequence Number=SeqID_104442
atggcaaggattcctgacaagattaagtctattgatgggtcaagagagacacttaaacttgctgtgagaatcatggatctttggttcattgggactcccaacaagtctgagcaagcggaaatg

SEQ ID NO: 12758 - DNA, 315 bp, Glycine max
  Peptide Sequence Number=SeqID_104443
atgttgttaaattgtgcagcaaattttgcctattatgcagaaaaatggttgtgcattgctagtcacgggaaaggtagtacatctcgtgttctagcagatcacaacggtcaaaatttagatttctgtattaggaacctccaaaaacaatttcaaggtgatccaatggttaacgaatcgaaacgaagagaatgttactggggcattttcatgacaaatgaaattgaattgtttggatatggggaaaccttggaggggtttgatggggacccggtgccgagaggaacgaggataacgggctacgtaggaagtgcgtga

SEQ ID NO: 12759 - DNA, 548 bp, Glycine max
  Peptide Sequence Number=SeqID_104444
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttctccaagtgtgctactgttggcattcaaggcattgcttgggccttcggtggcatgatcttcgctctcgtttactgcactgctggcatctctgggggacacataaacccggctgtgacattcggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 12760 - DNA, 552 bp, Glycine max
  Peptide Sequence Number=SeqID_104445
atggaggtcatgttgagcatgaagaaagtaatggaaagcaatgcagttgcagttgccactacgagtgccacaactgaggtagacccgactcacccatcaggcctcaatcaagtaaatcctccagtctcggacatggttgtgcagagtaagaattctttcccaccatacggcttgcctcccaactatgcaccacccaatgctgtacagggggcatgtgaagaacctcatgaccatgctctagtcaactttgagctttaccctggacatgccactgaagttgggcaagcatttggtggtgtacccttaccaaacacctcgaggggccctcagtaccacccacaaccacaacctttgccttttccagtgggaagagtccctcttgccatggtggaaagggaaaaattcaatcatatagaggaaaggctgagggccattgaaagaggcagagatcatgcttttgctgacatggcagagttgtgcctagtgcctgacgtcgtcatccctccgaagttcaaggtgctgtatttcgataagtacaaggggactacttga

SEQ ID NO: 12761 - DNA, 213 bp, Glycine max
  Peptide Sequence Number=SeqID_104446
atgaaatttaaggtcccacgaagtagaggtaggctcctagactccgaaaatagtttttccttgcaatttggtgtggaaatgaaggggaatttggagcttcaagagagcaacaatggtggagaaggagaggaagaaaaagaaacatggagggagaaagaggggctgctagaagtttctgaaaaaaaaatgagagaggatttggcttttttataa

SEQ ID NO: 12762 - DNA, 291 bp, Glycine max
  Peptide Sequence Number=SeqID_104447
atgtcagtctctgcatgctatcaggcttttcgtcttacagatagcaaaaaggatgtttatacggataaccactcgggtatttccgcccgtcagcgtgactcaaatgtcagcttttcgtcttacagacagcaaaagaaagtttatacggataaccactcgggtatttccgcccgtcagcgtgactcaaatgtcagtatgacagatcttgtgtgcgtggaagatgacgtaaatctccgcgtgtcaacgggcttgtcggccgcgattgacgaaggatgcagaagacgacgttag

SEQ ID NO: 12763 - DNA, 243 bp, Glycine max
  Peptide Sequence Number=SeqID_104448
gggcagaatcgtcttaggcagtggtcagatgccgggacgaagctgaaggcagaaaccaatcaaggtaaaacggtgacgcggccacagtttgccacgcaatgtcgtttcctattttcaggagattggcctgaggcccaggcagggaaggcgcctgcaggagctcctggtgatgcagaggaggcccgtatggatgaggagatgacggacttgcttgatttcttgggaggaagcggagccccgtga

SEQ ID NO: 12764 - DNA, 531 bp, Glycine max
  Peptide Sequence Number=SeqID_104449
atggcggaagctgtccgtatagctcccgttcaactcaccgcaacggtgtccgaagcacagcttggacaacgcttagatcagactttggcggaattgttccctgattattcacgttcccgcataaaagagtggatccttgagcgtcgggtcagcgtcaacggcaccatcatcgataaaccgaaagagaaagtactcggcgatgaccacatcctggtgatcaacaaaccgcgcgacttagtggtccaccctggcgccggtaatccggacggcacggtactgaatgcgctgctttatcactatccggcgattgccgacgtgccgcgcgccggcatcgtgcaccgtctggataaagacaccaccggactaatggtgtggccaaaacggtaccggcgcagacgcatctggttgaaacgctgcagctgcgtgaaatcacccgctgaatatgaagcggtggcgattggcaccatgaccgccggcggtacggtgaatgagccaatggcgcgtcactctaccaagcgtacccatatggcg

SEQ ID NO: 12765 - DNA, 785 bp, Glycine max
  Peptide Sequence Number=SeqID_104450
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccccgcttccatccggctcttcagttgtaccaggtcctggctgctgctggtgaccctgccatcgagctgcccgacttcggtcttcaatgcattgaaggcactggatccgatcttgtcccccatcgtggcatcgaggctgtccacgcgccgccccagcgcggtgtcagcggtcaccatcgcctgctgcaggctgctgacactggcactggtggccagcgcgccggtgcctgccggcatgcgtgcctggagtgcctggatcgactgcgcgttgacctggtcgccactcagccgcgcggtcttctcggccgcaatcaggccctgactgacccctgccagatcaccgccctcgtagctgccacgcaactgcacggccagcgactcgcgccggcccgcttcgctgctgtctgccgcgacgcgcgcggtggcctcgtcctgcagcatggccaccgacgcgccgggcgtcgggcgaccgatcgccacccagtccagcaggaagtagtgggcgtcggtctgcgccttggacagatccaggcggatctggtcgacgacggagccgttccacggaatgttgtccacatccagcgtcgcgatgccgttgctgtcatagg

SEQ ID NO: 12766 - DNA, 335 bp, Glycine max
  Peptide Sequence Number=SeqID_104451
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttggccaaaagaaacatgcttctagcacttttgttgttgtcctatctccgctatggtgaccgccatatggtgaactatggtagtgccaaaggatgctctgtgcttcttccatcgtaa

SEQ ID NO: 12767 - DNA, 572 bp, Glycine max
  Peptide Sequence Number=SeqID_104452
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtgaagaaaaaggacctggttggcaaggtggagggcactgtggcagagaaggacgagcttgcaaaagtgcttgctgatttagagacccaacttaaggagtcgaaatccaaactggaggaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 12768 - DNA, 162 bp, Glycine max
  Peptide Sequence Number=SeqID_104453
atgaaggagaagattaaaggctcaaagagggtgacaatggatatcaatggaagcaattcgtatctaggcccgaagttgggttgcttaaggaggaagcaactaggtgacaagctcctccatgttgttgaaaaatggtttccggggcttccgtggcttctgtaa

SEQ ID NO: 12769 - DNA, 381 bp, Glycine max
  Peptide Sequence Number=SeqID_104454
atgaaagattgcagaaatacaagtaatggggatgtctcctccacctctaggacctcacaaactcatctcaagctctcaggacagcttcctcttcaagttctagtctttgcagatcttcacacaacaaaatctctcaaactctctagaacttggacctttctctctctagaaatctctagacatgcagaagtttcaagaaaaggccaaactccctttcaaaatctgatttcaggcttaaatagcgcggcttttctcgctcagcagatagaccgaagcggtgcgcttagcgggatggccctttgctcggtgaacaaacacagctcatccttcttccagattcttcctcgcgctaagccggggattgttgcgctcagcggatag

SEQ ID NO: 12770 - DNA, 204 bp, Glycine max
  Peptide Sequence Number=SeqID_104455
atggcaatgaagcatctcactcatgattctttgaagagaagttggtacattgatagcggatgctctaaacacatgatgggagatatatcaaattttactcatatttctcctaagaatagtggacatgtgacttatggagacaacaacaaaggtaaaattcttggactctggaaaaataggtatgaatccatttatctccattga

SEQ ID NO: 12771 - DNA, 264 bp, Glycine max
  Peptide Sequence Number=SeqID_104456
atggagttgtatcaactaaaaatggagatgggaggagatctccatgaccacatcaacaaatcaattttgaatttggatgaggtgactgccgctcttagagaaaatgagagaatgataataactttaaatgttgacgatgaagacaatgcaatagctgtggtggagtctgagcaagggagaaatcattcaaggaaacataatgagcgaagagaaagattaaaatctcaattgcatccgcaaggagatatgagtaacctacaatga

SEQ ID NO: 12772 - DNA, 429 bp, Glycine max
  Peptide Sequence Number=SeqID_104457
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggatttgggagagaggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 12773 - DNA, 324 bp, Glycine max
  Peptide Sequence Number=SeqID_104458
atgtaccctctactagaactgatccacaagagatgtaccctctcttgttctcagtcaacaacccaagtagacgtaccctctacttgtaccacaaaggatgtaccctccaatgtgttaagacaaagttctcaggcagttaaacctttgaaacattgtgaatggggatacaaaagaattctcaagcgggaagaatcaaaagaattcaagcggttagtccttcgttcttttggaaaagggagaagagagacacaaaaagaattcaggcggttagtccttggcgaattctttttggcaaagggagaagggaatgaaaaagatgaatag

SEQ ID NO: 12774 - DNA, 453 bp, Glycine max
  Peptide Sequence Number=SeqID_104459
atgcttcagagcattcatcagggacagatcattttattacagagtttacaggtggtggcgcctctaggatctactccttcagttaagcagttcagggagatggtagcttggcccgggacccaaccttctcttcacaggaaagatgaaggtcccacagcccaggtaccgcagcatgtggaggatgagtcatcagaggccatcatcccagagccatttgttataggggaggaggcaggtgagacacagagatctcttaaggccatttcggagcctcctgcaccagtggtgaacctaccctcacctcagcgtacaatagacccctccactcctattctagagataccagaagacccgaccatactagtcctagctatggacacttctcctccagctactctagtacttcatctgacagatgaggaggatgttcaaacacaggacactcaggactag

SEQ ID NO: 12775 - DNA, 285 bp, Glycine max
  Peptide Sequence Number=SeqID_104460
ggatcgcacctgcaagacacccagtggacccgaagaagtccaacagggtcttggagttgtcaagctctaattacgggtctctgtcagttctacagagtacctgtcacctccagcaagatcatcaggccccctactaatcgagctttcatcaagaagtactgtgtccccaggcaggcgcagggcgtaacaccacagcagcctgggatggccggcaacaggcaacaggcaacagacgcaccgccatcacctctagagttcacctcagctcatccacaaaaaggttag

SEQ ID NO: 12776 - DNA, 849 bp, Glycine max
  Peptide Sequence Number=SeqID_104461
atggctgccggaaaacatttcgcggaacccctgcatacccgccagcatcagcgcggcgctgtgcttgcggctgcgctcatagcggcgcaggtacaaatgctgaccgatatctttaccctgcgcatgcaggcgcttcagctcgtcgataagctcggcggcgtccataaagccaaggttcaccccctgcccggccagcggatggatggtatgggcggcatcgccaaccagcgccagacgatgggcggcgaactgacgcgcgtagcgtccggtcagcgggaaaacctgccgatcgctctcaagctggcaaaggccaaggcgattatcaaaagcgatattcagcgcctggttaaacgcggctgcatcggcctgctgcattcgctgcgcctcctccggcgacagcgaccagacgatcgagcacagatgcggatcgctaagcggcaggaaggccagaatgccttcaccgtggaacgcctgacgcgccacagcctgatgcggctcggtggtacgtatcgtcgccaccagcgcatgatggcgatagtcccagaaggtcagcggaatatcggctttattacgcagccacgaattggcgccatcggcgccgaccaccagccgcgcggtcagcatgctgccgtcctgcaggctcagaaaggcttcgttttcgccccacgctacctgctgcagttgcgcaggcgccagcagggtaacgtcagcacagcgctgcgccttctgccacagcgcgtgatgcaccacggcattttcaataatatggcccagatggctaaagcccatgctctggtcatcgaagctaatgcggccaaagctatcttgtcccacacttccatgccgtga

SEQ ID NO: 12777 - DNA, 601 bp, Glycine max
  Peptide Sequence Number=SeqID_104462
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctaatagtccccaggagagtcgccatctatcgcaacctaccctacgataggagtgcgaacactggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12778 - DNA, 891 bp, Glycine max
  misc_feature (830)..(830): n is a, c, g, or t
  Peptide Sequence Number=SeqID_104463
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagntatcgcatttcgctacgttcttcatcgatgcaagagccgagatatccgtgccgagagtcat

SEQ ID NO: 12779 - DNA, 1006 bp, Glycine max
  Peptide Sequence Number=SeqID_104464
cgcgcagcggttattattccgtggcttcgctggcatcacctgcggccggaaggcgtcattctcagtcatgatcacctcgaccatgcagggggcctggtatcgctgaaaaaagcctggcctgaaatgtggataagaagccccttacgtcaggcaggtcatcgcccttgtttccggggacaacgctggcaatggcagggacttaccatcaccgttcactggccaccagagaattatccctcccaggggaataacgcctcctgtgtggtaaaagttgatgacggtgagcagagtgttctgctgacaggagacattgaagcgcctgcggaacaggctatgcttagcaattactggcgtcatctgaggaccacgctcatacaagttccccatcatggcagcaatacgtcttcatcgttgccactggtacagcgggcggaagggcagattgcactggattcggcggcccgctacaacgcgtggcatttcccgtcggctaaagtcgtgcggcgttatcgaaaagaggggtatctctggcatgatacgcctcattctggacaaatatcgataacgggtagaatatgcggctatttcaacaatgctggcttgatcgtggcgggtgtagcgttaatcctcaacgcagccagcgatacttttatgctatcgcttcttaaaccgttactggacgacggttttggtaaaacggatcgctcagtgctgctatggatgcctctggtggtgatcggactgatgatcttacgcgtcgaccggaacgttgctgtcgcgtattacctacgactccgagcaggttgcctcttcctcttccagcgcgctgattaccgttgtgcgcgagggtgcgtcgattatcgggctgttcgtgatgatgttctactacagctggcagctgtcgctgatccttatcgtactggcaccggtcgtgtccgtggctattcgcgtcgtgtcaaagcgttttcgcaatatcagcaagaatatgcagaatacgatggggcag

SEQ ID NO: 12780 - DNA, 222 bp, Glycine max
  Peptide Sequence Number=SeqID_104465
atgtcgctaagtagcaacatcatctataactgtgtaagagtggtcatgttggtgcgcatgatccacactcgtctctttgcagcgacacgggggaaatcttgccccagtatgcatagtagctgcatgatagcctccctctctggttgtgctcgcacagttggtcgccctccaatatcagggggtggctcaggaactaataaaaggaaactactggcctcttaa

SEQ ID NO: 12781 - DNA, 735 bp, Glycine max
  Peptide Sequence Number=SeqID_104466
atggtgaagggtactacctcaggttcaggtaaatcccaaacatctgctacttctggtctggctggttgcttggatgttgtccaagcaaatcagaatgcttatactgcttcacaggataatcttgtaggcaaggtgctcgtaaaaaagacagggacaagttctgcaaaaactgatgatgtcgcacaccaagtgtttgataatttgtcgcaatgcagtgctgaatctgaatcttccccagagatttcttgcaccttaggggacaatgatttaaccactgatgatgattcatctcactcctgtggctctaagtcatcaccgcagttagatgacaataaggctcccactccttgggttaatctattcaaagataacagaagtccttccaaaggttttggaatgaagttctcccctccaccctctgatgatgaagtgctgttggaagaaacggatttgcaacccctggaagaggcttggggacatagccttattggctatgtggctggtcgattcccaggaaagaaagctctgctggattgttgccaaaaatggggagtcaagttttcatactcaactcatgaaagtggttggctggtgtttaaatttgagtctgaggacgatctgaaccaagtcctctctgcaggcccttacttcatatttcaaagacccctactgctgaaggttatgccagcattctttaactttggcaatgaagagctcatcaagatccctgtctgg

SEQ ID NO: 12782 - DNA, 571 bp, Glycine max
  Peptide Sequence Number=SeqID_104467
atggatgctggatggctgactttccaagaggatcggcccaatgtgagaaccaacccgctcgccaatcatggagggggagcagttaatgcagttgaatccgataggccgcacaggtctaaacctttaagggatgtggcaacccctaggaggtttatctttgaggccctacaaaagggagaggaattgttacagcggatgatagatcaaggtcgactggaagtcggaattgaaggaaaagaagagcagcatatatgcatgcaatctacggaggggagcggtgttgcgaagcccaaacccttggtgatatacttcactaaaagcgcaccttcgcaaaagcccggacaccccttaatggccaaacctgttcctttcccgtaccaaaatagtcacgcggtcccgtggagatatacacctccggggaagaaggaagaagaagtcactgacgtcagctcgctgtcagctaaagtaacaaatatcacgggactgagtggtgtgacccgtagtggtcgtgtgttcgcacctccggacctaccagtccaaacccgacgacgtcaagggaaaaggaacagtg

SEQ ID NO: 12783 - DNA, 447 bp, Glycine max
  Peptide Sequence Number=SeqID_104468
atggaacttgctagatcgataagctcttggcgtgatcagattgacattagccaagaacgtcacgttcaacatcgtaaacgagaagactactgtaggcttaatgaaggtgttatcagatatgtacgagaagccgtcggcaaccaacaaagtatacttgatgcaccggtttttcaacctcaagatgggagaagttgggctgcaactgttactgcagttagtagttctacaagggagaacgcattaaagcttagtgacattcgtgacttgatcttaagcgaagatgttcgcaagagagattcaggagaatctttcagtcatgtttccaattcagcattgaatactgaaggtaggggaaggactacccagaagggtcaaaatggtcgaggcagatcaaagtcaagagggaaagtttggatagtcttgttgattcatggatcatggactcag

SEQ ID NO: 12784 - DNA, 153 bp, Glycine max
  Peptide Sequence Number=SeqID_104469
atggaggctggatctttgagcttcaatgaagtccttcaatggcaaaggagaagaggagaggggaggcaccatccactagggaataagccaaggaagaaggagcctcaccaccaagaattaccttggataagaagcttgaagatgatgctttaa

SEQ ID NO: 12785 - DNA, 257 bp, Glycine max
  Peptide Sequence Number=SeqID_104470
atggcatcaagaaagagagcgagaactgaggacatcccttcatcatccaatccatttccttcgatagcagccatggaaccagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcg

SEQ ID NO: 12786 - DNA, 144 bp, Glycine max
  misc_feature (48)..(48): n is a, c, g, or t
  misc_feature (94)..(94): n is a, c, g, or t
  Peptide Sequence Number=SeqID_104471
atggttaaagcacgtcaaaaggggggacatgagggaggtggttgccgnccagctcgcccaggcgagctgggttgcttccaccagaaggcaccgncttctgttggaacaccctggaaggtccaagtgggcctggttgctatttga

SEQ ID NO: 12787 - DNA, 493 bp, Glycine max
  Peptide Sequence Number=SeqID_104472
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgtccattatgaaaccactggaccagagatctggaagggctctagtgggaaggttgatgctcttgtctctgggattgggactggaggtacagtaacaggtgctggaaaatatctgaaagagcagaatcctgatataaagctatatggcattgaaccagtagaaagtccaatactgtctggaggaaaacccggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12788 - DNA, 632 bp, Glycine max
  Peptide Sequence Number=SeqID_104473
atggggacaaatcaaaacggaaaaagattctatcaagtcaagattaagggcctagatgtcaccagccttaaggagttgggacggttgatgggacccctccaaagacaagccttccgcaaagtgtacggaaagattttagatttgaccacggcggaggtatttacggaagccgttgtatccctcgcccaatactatgaccagtcgttgagatgcttcacgtttggggacttccaaatagtgctgactattgaagaatttgaggagatattaggatgccctcttgggggaagaaaaccgtatcatttctccgggtttcttccctccttgagcaagattgcagctgtggtcgaagattcggcgagagagttggatcgtatgaagcaaactcgaaacgacgtagtgggcctaccgcggaaaaacttggaaggtaaggcaagggatatgacgagtcaagaagagtgggtcccgtttgaggatatactagctttgctaatctttggggttgttctctttccgaacgtgaacggtttggtggacctagccgcaattgatgatttccttgcatatcaccatagcaaggaaagcccagtggtagctatcttggtggacttatttgatacatttgaccgaag

SEQ ID NO: 12789 - DNA, 198 bp, Glycine max
  Peptide Sequence Number=SeqID_104474
atgggtagtaaatgtcctttcgctaagcgcaagcctcgcgctaagcgcatcttttgtcatgcgctaagcggagagtctctagcacttaacactcaacccttgcatctcaagctgatttggtccgctaagatggccaaggttgagctaagcccatttcaattcgatctaaatctggctaagcgatggctcgctcgctaa

SEQ ID NO: 12790 - DNA, 234 bp, Glycine max
  Peptide Sequence Number=SeqID_104475
atgaggtccttcaatggtgatttttcaccatggagatggagcggaaggaaaaggagaagaggagaggggaggttccatcctttagggaataagccatggaagaagaagcttcaccaccatgaatgtgtcttggataagaagcttgaagaggatgctttaatggaggaaaagaaagagagaaggggggagaacgaaattgaaggattaaaagagggagagaagtggaactttgaa

SEQ ID NO: 12791 - DNA, 516 bp, Glycine max
  Peptide Sequence Number=SeqID_104476
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccattccaagagaatgaaaacttgagattgttgccaaaatgcaaccatgcttttcatctcccttgcattgatacttggctcaagtctcatgctacttgccctttgtgtcgttcttctgtcaccgcttgtccaaatccgaatccaaattcttccatggaacccccaccaagagtcattgttaatgccttgggacaccaacttaggagtaaccatgttgttgttgttgagagttctgaggaacaacagaaagatggttag

SEQ ID NO: 12792 - DNA, 290 bp, Glycine max
  Peptide Sequence Number=SeqID_104477
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtggttgtcatcatcaaaaagggggagaatgtaaatcatgaagattttgatgatatcaagaagaatttgcttgagaaatag

SEQ ID NO: 12793 - DNA, 291 bp, Glycine max
  Peptide Sequence Number=SeqID_104478
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggccatgccaagcatatgatgatgctgaaggaggattaagtgctatgatgccattgccagctgatgtatcgtcacagtcacagccttccacggatgaagggttgcttggagatattgtacccccgggaatgcgcatcagatga

SEQ ID NO: 12794 - DNA, 58 bp, Glycine max
  Peptide Sequence Number=SeqID_104479
tgttaatggtgagggttctactcctaaggaccccttgtataggatattagatgagtag

SEQ ID NO: 12795 - DNA, 234 bp, Glycine max
  Peptide Sequence Number=SeqID_104480
atgaccaaagtgaaggcaagagccattcctaggcttgggaggattgatgtggacctggtgttgagaggaacgaggataagggctacgtgggagtacgtgagctcagttggaggtgggcaacaggggatggtgggtttatacgtgatttgtggatgtggagaattgttttgcaccatcgcccgaccgccacctagtaccacatgtgatgggtaccccataatcctacaagtttga

SEQ ID NO: 12796 - DNA, 405 bp, Glycine max
  Peptide Sequence Number=SeqID_104481
atgtctcttgccactctctttggaaaacttcaagaacatgaaatggaacttatgagacttcatcaacatgaagagaatgatataaagagaaaaggaatagcactcagagcctcatcatcttttattcaagaagaaagtgacaaagaggacttaactgaaacagaagaaaatgatgatgatttcagactctttgtgaaaaggttcaataaatttctgagaaacaaaagaaataaaagggaatcaaacatcaatacaaagaagaaagaagaagactcctccttagccccaacatgctatgaaagtaatcaacctaggcacgtgagattcgattatcttgtctttgaaagaaaaattgaaaaatccgacaagaggaatcttgaagaaaagaaagaaaagaaagcatag

SEQ ID NO: 12797 - DNA, 264 bp, Glycine max
  Peptide Sequence Number=SeqID_104482
atgtctcgaccgcatcacagctgtgcggaaactcttagtgctaggaacgtgatgtggagcctgcggagtaccgagggaccatggccattccgtgaaccacccgtcaaagttcagtggacccgactatatcccggaaggtcctctttatgcgacgtatttgctcaaggggaggccgagaattggttcggaagttcggctgaagcctcgagatttgttgacctggaggttggggttatgtgcgacggagttggtgggatcctctag

SEQ ID NO: 12798 - DNA, 300 bp, Glycine max
  Peptide Sequence Number=SeqID_104483
atggccgtcatcgaccctccatccccggtcagacgccacgtgaagtggaagatggcccgcaccaagaagacaagggagatgacgactgaggccgcaaaggaaatcactgagaagattgccacacagggatcgttcgtcccccatggacgtcaggatgttttggccgctgctattggacgtccagagcaccctggacgtgtctgtgctgctggagccggtgtcaccatcaagcaatactttggatcggctccacggacgtcccacagcgcttcctccctgcctcctgacgaattacagtag

SEQ ID NO: 12799 - DNA, 222 bp, Glycine max
  Peptide Sequence Number=SeqID_104484
atgtctacccttcagtggtatatgatgcaatcctaccccccaagggcattggataaaagactccaagaagattgggccagagatgcaagagaaggccctaggattctcatgagccttagagtagctctatgtggagcttgtaggccttggatcttcttcatcagtggagtcctttgcttcttgaagtttaatggaagcggaatgaagaaggaagaaagatga

SEQ ID NO: 12800 - DNA, 276 bp, Glycine max
  Peptide Sequence Number=SeqID_104485
atgatgctattgtccttagaggagtccatgatggccacggattcatcgtcatctgctgaaaataagaagcttgagggaaaacttgatgccttggtcaacctacaatttggagtcaatgagcaacctgaagcctatgctgcaaacatttataatagaccccctcaacaacaaaaccaacaacagcagaataattatgatctttcaagcaatagatacaatccaggttggaggaatcatccaaatctgagatgggcaaatcctccacaacaacaatag

SEQ ID NO: 12801 - DNA, 375 bp, Glycine max
  Peptide Sequence Number=SeqID_104486
atggatgattacaagtctttgcaaactgaatttgaaaatttcaaaaaggatcactatgctgaacgtatgaagttgcaaactgaactttcctatcttaaagatctttttagaaaattaaacaaaggaaagagtgatctcaatcacatgctcaatgtgcaaaagcatactaccgataagattggtttggggttgtgcctaaaagcaagggactcactatggtacttggatagtggctgctctaggcagatgacaggtgacaagtccaaactcatagattttgtgtcaaaagaaggaggatatgtcactttagagacaacaataaagggaaaattatgggagaaggaaatattggaaatcaatacaaaacatagataa

SEQ ID NO: 12802 - DNA, 459 bp, Glycine max
  Peptide Sequence Number=SeqID_104487
atggcgcctaccaggcaccctctggacccggataagtccaatagggccctgggatttcccgccttgatcacaggactctgccagtcgtttggagtccctgtcgcacctaacaaggccgcagacgcgccgccaccttatcaggccggtccagccggatcgtttgatacggagcagtatttgtggcatttggttcaccagcaggcggccaaccactgggcacatgtacggacccatgattgtctttatcagatgagtctcagcatgcagagccagggctttacttcttttccatgccctactccggaccagttcagggcagaggtcgcatggcctggagattcgcctgaggcccgggcaagagaggcaccagcagaggctcccgacggggcagatgaggcccgcgaggacgaggagatgaccgatttacttgatttcttaggaggaagaggggccacatga

SEQ ID NO: 12803 - DNA, 2046 bp, Glycine max
  Peptide Sequence Number=SeqID_104488
atgagtttcctgaacgcttcttcgccgcgctacgcggcggagagtgacatagaggccggtacctccgctcgccgctccgccgacctcgacgacggtgatttctccgatccctttgacattgccaggaccaagaacgcttcggttgagcgcctcagacgctggaggcaagctgcgcttgtgcttaatgcttctcgtcgatttcgttataccttggacttgaaaaaagaagaagagaagaagcaaatattgagaaagattagagcacacgcacaagccattagagcagcttatcttttcaaagcagctggtgtggggccagggagtgaacccattaaacctcctccgatccccactgctggtgaatttccaattggacaagagcaacttgcttcaatttcaagggagcatgacactgctgctctgcaacaatatggaggggttgtaggactatcaaatttgttgaaaaccaattcggagaagggtattcatggtgatgatgctgacttactaaaacgaaggaatgcatttggttccaacaattatcctcggaagaaaggaagaaattttctgatgtttatgtgggatgcttgcaaggacctgaccttggttattttaatggtagctgcagcggcttcattggcacttgggataaaatctgagggtatcaaggaaggatggtatgatgggggaagcattgcttttgcagttattcttgttattgttgttacagctataagtgattataagcagtctcttcagttccgagacctaaatgaagagaagagaaatatacacctggaggttgttagaggtggtagaagggttgagatctctatatatgatattgttgttggggatgttataccccttaatattggtaaccaggtccctgctgatggaattctgatcactggccactctcttgcaattgatgaatcaagtatgactggggagagcaaaattgtccataaggattctaaggatccttttctgatgtctggatgtaaagttgcagatggcagtggcactatgctggtcactggtgttggtatcaatactgagtgggggcttctaatggctagcatctcagaagatacgggtgaagaaacaccattgcaggttcgcttaaatggtgtagctactttcatcggtattgtaggacttactgttgctgttattgtcctaattgtgctactggctagatatttctctgggcatactaaaaacccagatgggtcggttcaatttatagcaggcaagactaaagttggtgatgctattgatggtgcaataaagataataactgttgcggtaaggaggctttctgcctgcgagaccatgggctctgccacaaccatatgcagtgataagactggtacattgactatgaatcagatgactgtggttgaggcttacgcggggggtaagaaaattgatcctcctcacaagttggagtcctatcctatgcttcgctctctgctcattgaaggtgttgcacagaacactaatggcagtgtttatgcacctgagggtgccaatgatgtcgaggtttctggatcaccaacagaaaaggcaattttacaatggggaatacaggctgactgtaacatccatatacactggaaaggtgctgctgagatagtcctagcctgctgtacaggctatgttgatgtgaatgaccagctggtggggatggatgaggaaaagatgacatttttcaaaaaagctattgaagacatggctgcagatagtctacgttgtgttgccattgcatatagatcatatgaaaaggagaaagttccaactaatgaagaactactttctcactggtctttaccagaggatgatcttattttactagccattgttggtcttaaggatccttgtcgacctggtgtcaaacaggctgtggaactttgccaaaaagctggggttaagatgtacaaaaagtgtatcgatgtcaggatggctaatggtagtttgcatggaggctatgttaactggggtcatttgtttcaacttgaatctaacatgactaaggcctga

SEQ ID NO: 12804 - DNA, 322 bp, Glycine max
  Peptide Sequence Number=SeqID_104489
atggctgaaaatgttgacccaattgcgaacaatgttattatcaataatgcaactcttacaaacttgctgaatccctattatgctcatccaaatgagaatcctggtgtggcgattgttgctcaggttctcaatggtggaaattaccactcatggtcgcgtgatatgctccttgctttgaagaccaagaaaaagaaatcttgcaaaccatcatgtggatggagaatgcattggatatctggaatactctcaaaaaacgttattatcaaggagatgtatttcgaatcagcgacttacaagaagaaatttatctgctttaaacaag

SEQ ID NO: 12805 - DNA, 162 bp, Glycine max
  Peptide Sequence Number=SeqID_104490
atgtctcataacacaagatccaccaagtctatcttaggtggtactcaggactcaggtaacaccgattatagagacattggagcagagaaagtagcctcagtgtccttggatgaaaagtcagatatgacaaaggacattgtatcgtccacatgcaatgaatag

SEQ ID NO: 12806 - DNA, 450 bp, Glycine max
  Peptide Sequence Number=SeqID_104491
atggcggtgtgctccacggcatggattgaggtcaatggcagcggcggtgtgaaagcacaatgcaaggtgactaagggctccatggcaacagctagccgaagagaggccaaatgcttcgccctctcacaatcaacacgccttcttctagctccatcaggccaaactactcttcaagttcaagcccaaaaagtgctgaagcagagtccaacaccaagagcaagagaaggagaagctttggatcaaaacctagcaggagaaaaatgtggttcatgcatgtgtttgatgaggaaaagaaggaactgggtaggcaacaagccccgggttcatgcccttattgccaaggcaaggttgaggccatggatgttgagatccagtggagactttgcttcttgcccatgtgcttcaagatcaagaggaagtatttttgtacttcatgtgctagacgtttag

SEQ ID NO: 12807 - DNA, 316 bp, Glycine max
  misc_feature (265)..(265): n is a, c, g, or t
  Peptide Sequence Number=SeqID_104492
atgagtattgtccaatgtttctactgcaaaggccatggacattttgcttcccattgtcctaaaaagttctgtaattactgcaaaaaaggtcatatcataaaagaatgtcaaatcagaccaccacggagaaatgcaacagccttcactgcaactaatggctcttctactactcctgtttatggggatcagaatccgcctgctttgggtctttcaggtaaagcttctttacccagctctccttggtattttgactctagcgcatccnatcatatgaccatcaatgttgctgcacttaccaatgtcacaaattactctg

SEQ ID NO: 12808 - DNA, 621 bp, Glycine max
  Peptide Sequence Number=SeqID_104493
atgcattgtaaacatggacagttatgtagtagttatgtgtctacgtatgaaggacattatcagttatatagcagctatgtattcctagtacatgatgtaattagtgctgtgccttgtagaattgctttcgaaaggggcaaagagcgccatttttgctttctagcaatctctgcaggaacttctgggtggcttgtgctagcagaagagttgccactgaagaagccctatggagttgttcgggttgctgcacctttggctgggtgcaatcccagaattgatgataaacacccaagatggttacatatgcggatccgaccgtcttctttacctgttctagatcctgcgaagttcaatgcccacgcccacgcccacgcccacgcccacgcccacgggaaattaaagacaaaagcttttgtcgatggtagatggacattggcgttcagggatgaggagtcttgcaagtctgctttatccatgattcttgaagagattaattttctgagtgacgaggttcacagaagactaaagcctttgctcaaccttgaaacggcattggatttatcaggcccagaggaggaggattcctcttcacattcaacaacacctcccaattctgtgtaa

SEQ ID NO: 12809 - DNA, 204 bp, Glycine max
  Peptide Sequence Number=SeqID_104494
atgcattggatctggaacatcataaccagtgacataaagagtgattggtccatgccctttgatgatgattatcgtagccatcatgggtgccttcatcctttcagaaaaaatatatcttggaggtcattagagcatgttaggaactgggctgatttagaggttcagctcctccagagaagagaaggaaaatcagagaagttctaa

SEQ ID NO: 12810 - DNA, 219 bp, Glycine max
  Peptide Sequence Number=SeqID_104495
atgcaactaaacttagcaggaaggcaacaaaagcaaaacctcatatgcagaacacaaagccgcacgtactggaatgaagatacctgcatgaaaaacaaagcaaagaaacgaaacaaattcaagagaggcaagagcaggaaccactgcttgactggaaagacgaaaggtggaaaaaggctccttaacccactcactctgaaacccagagaaagaaaatga

SEQ ID NO: 12811 - DNA, 741 bp, Glycine max
  Peptide Sequence Number=SeqID_104496
atggcacgcattgctgacaaggtaaaaaccattgatggatctaaagaaactctgaaacttgctgtaagaataactgagctctggtttgttgggatgccgggcaggtctgaacaagctgagatgggtgatcagatccatgtggtctgtaagcaagaccagttaaaggcatggaaaatggatttgaaggaaggttgtacttatgtgatgcacaattttagagtcaacatcattggtgtcgttgatgaggttgtctttcgtcatatttcacctagaagtaagagagttgtttttaagcttatgaatttgaggctttcagaattggacattgagatccgctcagttttgacacgtcgttcccagtggagttcgcagccttcaggttctgctcagttatcatcaagggagacattcatttccaagtcagaggcaaagagcatttctgagatgaataacctttgtgaagagtttgtttgtgttactgttggtacaatcacgaggattgttatggacaatcattcatggtgttatgcatcttgcattcagtgccataagaaaatagatgtctatacagaaccatttgtgtgcccatgtggcaaacataatgatcgagttgtgcttagatatagagttgaagtgatggtcaattacaaagatgaaagcacaaaatttctccagtggtatcgtgaatgcaccgaattgattgaacaattagctgatgaagtcaatacccttaaaatagaa

SEQ ID NO: 12812 - DNA, 225 bp, Glycine max
  Peptide Sequence Number=SeqID_104497
atgagcagggaaagttccatgtccttctctaggagcagggataggagcaatgatggcgcaaagagagggaggcaaaagaagattaagaacatcctaacaccaacccttaagggaagtataagcaaatgcatggaagttagcttcacgggaatggatggcatatgcaatcatgctttgaaaagaattaatcctagggatccaactatccaaccagaaatgggttaa

SEQ ID NO: 12813 - DNA, 171 bp, Glycine max
  Peptide Sequence Number=SeqID_104498
atgaggtgtggatgtttgttcggaattggatcagctacttcttcttcggttacggtgatgtcagagaatcttcgaagggaaaggaatttagggaaagagggagcatgtgctgagcctcggagtaatgtaaatggaggaggattctggtgggaatgggaaggagaagtttga

SEQ ID NO: 12814 - DNA, 60 bp, Glycine max
  Peptide Sequence Number=SeqID_104499
atggcggcctgtataagggatgcaagaggttactttggagtgaaagaaagctcagcctag

SEQ ID NO: 12815 - DNA, 3872 bp, Glycine max
  Peptide Sequence Number=SeqID_104500
atggaggctgggaagaagggtggtgggggttctagtaaccagaagaaattgttaaaggatgttgaaaccatgaacaaagctttgtacttggatagaacctcttcaaggagttcaatacctagtgcaaattctagatctaaattcacagggaaacctcagttgcctgatcccaaatccaagtctaaagccagtggtgataataatagtgagaatgttcagaaggataagaagtccatatggaattggaggccactaagggcactctcgcacatccgaaataagaggttcaattgtagtttttatctccaagttcatttgattgaggggttgcctccgagttttgatgatgctagccttgctgtgtactggaagaggcgcgatggggttcttgtgacccagccggccaaggtggttcagcgtgtggctgaatttgaggagaagttgacctacacttgctcggtgtatggaagcaggagcggacctcaccattctgcaaagtatgaagcaaagcattttttgctctatgcttcacttctcagtgtgccagagatggatttggggaagcaccgggtggatctgacgaggttgcttcctctcactctggaggagcttgaggaggagaagagctcggggaagtggactactagttttcgattaacgggagtggctaagggtgctgcgatgaatgtcagttttgggtatacggtggttggtgataatgctagtgctaccagagacagccttcctaaagcattgacctccaggcagcatagttttgctccgactccgacaaagttagatgttaaacccagacagtttgatggaagcagcaagatgagacgggccacaagtttgcaatactcatctcaagctgcagatgaggtgaaggatcttcatgaggtattgccattaactaagtcagcactagccagctcaatagacgtcttatatacaaaattggatgaagaaaaggcttgtagtcctctggatgatgaggcagaacttgattccttcaatcttgggccaatcaagccagatgcctatgcttctgatctaggaaaagaaaggcttgaagagcatgcaactaaggatgaaaatacatgtccagtggatgacaaacctgaaccctacgtatttcaagaaaagctggagacagttaaaccagatggctattctttaccagattttgaaaatgaaaaccccgaacattgtcttgataatgatttttttgttgttgataagggcatagaactttcatcaaacgaatctgttaaactagaggaatccatcataaaggctcctgacgatgcttctacagttgatagtgccagtacccttggtatatcaggtatacaaatatcttctgaagatagtgttaagcatgattttctggatgatgcaaatgatagttctaaggatcaagcagtggtagaggaatttgctagcataaaggctcctgaggatgcttctacagttgatgcttcctgtacccttggtatatcaggtatacatgtatcttctgaagatagtgttaaacacgattttctggatgaggcaaatggcttggacactaatgagctgctcatgcaagaactagaatctgctttaaatagtgtctacaaatttggagagacatctgttgccactgaatttttaagcatgttaggcttagaccatagtcaaatgggcttgagttctgaaagcgagcccgagtctccaagagagctacttttaagacaatttgagaaggaggctctgaatgggggcttctcttctttgttcgattttgacatgaactatgataatgaagcagatggtggctatgatgcttctgctgcttctgagcagtggaacttttctgaaggtgtcaagtcgtcatccttcttgcaagatgatctgcaggaggagcatccagttgagtctcaggatgtgaggagcaaacagagggctcaaatgctagaagacttggaaacagaagccttgatgcgtgaatggggtttgaatgagaaggcttttcatcattctccaccaaaagattttgccggttttggaagtccaattcatttaccacctgaagagcctcccacattgcctccacttgatgatgggttgggcccttttcttcagacaaaagacgggggttttctacgctctatgaatccctcaattttcaagaattctaaaagtggtgggagcttaatcatgcaggtatccaaccctgttgtggtacctgcagaaatgggttctgggataatggaggttttgcagtgtttggcttcagtgggtattgaaaagctctcaatgcaggcaaaggagttaatgccactggaagatatcacagggaagacaatgcaacaaatagcatgggaagctatgcctgtcttagagggtgcggagaggcaatgccatttgcagcatgatccaatagcatggccagacagtgcttatgtgcaaagggacttgaaaggaatgccatctaaacaaaagtctggcaagtttagttcaagaacagtggccaaccaaacaggctcagagtttgtttcagtagaagaccttgctccattggctatggataaaattgaagcactttcaatggagggtttgagaatccaatctgggatgtcagaagaggaagcaccgtcaaacatcattgctcagtccattggagatatttcagctctccaaggcaagggggttgatgttagtgggtcccttggcctggatggagctgctggtttgcagttgatggatgtaaaggacagtgatgatggtggtgatggtgttgatgggataatgagcctatcattaactcttgatgaatggatgaagctggattctggtgagattgatgatatagataatatcagtgagcacacttccaaacttcttgcagcccatcatgccaactcttttgacttcattcgtgggagttcaaagggagagaagagacgaggcaaaagcagaagatgtggtttgctaggaaacaatttcacagtagcattaatggtgcaactccgtgatcctctgagaaactatgagccggttggaacaccaatgcttgctcttatacaagttgagagagagttcatgcttccaaagcaaagaattttcgacagtgtgtctgagattaggaaaaactatgatgaggatgacgagagcgaaatagtagcaaaggtggaaatgaaggacactgagaaagaggagaaaagttctgaggaggacgagggcattcctcagttcagaatcactgaagtccatgtggcaggtctaaagcctgagcctcagaaaaagaagctctggggcacttcaagccagcaacagtctggttctcgctggttgctcgctaatggaatggggaagagcaataataagctttcactaatgaagtcaaaggctgcatcaaaatctaatgctccagttaccacaaaggggcaacctggtggtgactccttgtggagcatatcatctcgtattgatggcgctcgaggaaaatggaaggagttggcagcactaaatccacatataagaaaccccaatgggcaagaagctggttcattacctatattgccactccctgctcctccttctgatggaaatctaggtcctctccctgagtctcaagtgattgaggaggagcagaaccaatcaaattctgcttctgttccggcgccggtaacagttgccacccacaccagaacgattggaattatacatccgcctccggacattaggaccattgttgataaaaccgcccagttcgtcgctaagaatggtccagaatttgaaaagaggattgttgcaaataacacaggaaatgccaagttcaatttcttgaactcatcagatccatatcacgcatattatcaacacag

SEQ ID NO: 12816 - DNA, 4147 bp, Glycine max
  Peptide Sequence Number=SeqID_104501
tgtagtgctaaatctttgtcatgcaccaatctctgttctgtgtatttggctcaagagatgtgtgggaattagtgctatggcaacatccaccaagtttgacatatcttctagcagcccagatagaccattgtactctgggcagcgtggatcccacatagttccttcgttagatagatcaggtagcttccgtgaaagcatggaaagtccaattctgtcttctcttccaagcatgtcaagaagcagttcttcagcaacacaaggggatgtggtgagcttcttcagttgtgtgcgttttaatctaaagttggtggctccagagcataagtctaatcgtcaaatagattataaacgacttgtcagtgctgcttttggaatttctcctgatgattctccatctagttctgccaaaggcaagcaactatcatccccagtaccagaagatatcaaacgactcagggatagtttacacacaagttttaggagggcaagggatcgtgctaaaatgtttagtgaagccttgtctagattcaacaaagatttccaaaatataatttcaaagaaaaggtctcgagctgaaactttttctaatgaacgctctagtttcacgttaaatgatcgatcagtcttgggaacaagtacaggtaaggttggagttgaaggtcatgcagtcacaggtggttttgaacatgaccaaccgaagttggaagaaagaaccaaaaatgtttctaacaagcgcactcgaacttctttggttgatgtaaggatggatatacggactaattctcttgtcaggccatcggggactgtagatagagataaagaaatacggattgccaatagtggtgcaattcagggtgaggaacgaactttaccaattggaggtgatgggtgggaaaagtcaaaaatgaagaagaagcgttctggcatcaaaccagatgggtctccaaatgcagcattgacaaaacctgttaaccttttccaggaaactaaacatggaatgcaacaaagactagccactgatgctcgatcaaaattgagtaatgattctcattctttcaggtcgggggtttctaatggaactgttggagctggaaaatcagatgctgtctctcaacaatcagggttgggcatacgtgtctctacccctagaagtgacctagaaaataattctgctgtcaatgataggcgggatcgtcctgttaattcagacaaggaaagggtgaatttcagagctgttaacaaggcaactgttcgcgatgaatataattcagtgagccctaattcaagtgcaaaaatgaatacacctattcgggcgccacgatctggttcaggagttggcccaaagtcgtcacctggtgtccatagagcatcttttcctaatgattgggagccctcgcattgtatgaccaagccccctgccagtgttggcactaacaatcgcaagcgtgtggcatccgcacgatcatcttccccacctgttgtgcactggcagaggccacaaaagagctcccgtactgccagaagaacaaattttgtgcccaatgtatcaagtaatgatgattcccctgctttggattctgtatctgatgtgactggtaatgatcttgggttgggatttgttagacgtttggctggcaattctcctcagcaaattaaattaaaaggtgattctttaacttcagctaccttatctgaaagtgaagagtcaggggtagctgagattaaacccaaagagaaaggcaggaaaccagaggagatagatcagaaagctggacaaaatgttcaaaaggtttctaacttggtccttccaacaaggaaaaataagcttgtctctggggaagaacatggagatggtgttcggaggcaaggtaggacaggacgcaattttccctctgcaaggtcgccaacgccagtgacatctgagaagcttggaaatatagggactgtaaagcaacttagaagttcaagactaggacttgagaagagtgaaagggcaggtcgtccaccaaccaggaaactttctgatcgtaaggcatatgcacgtcagaaacattcagcaattagtgcatcagcagattttcttgttgggtcagaagatggacatgaagaattattggctgctgtcaagggtgttatcaactctgctcgtgctttttccagccaattctggaggcagatggagcctttctttggtttgatgagtgaggaggatcttgcttactggaaacagaagatttgtgctggtgtccataatcttatagccccgatgaatcctttggttgattattctggaataaatcttgaaccaagtggattgatgccaactccagttccttcatatatagatgattgtgaagctgtggctaatgggtttgggttaactggctctgaaagagattttgaacctggtgatcaaacgggtgctggaattgtagcagaacagttacaactagctaaaggagattctaatggaattcccttctgtcaaaggctaatatctgctctgatttcagaggagtgtaacagtgaaagtgaagatatcatgtttgatgcatgtgatactgaatctgaggctgacggagagttggatttgagaagtttggatcaccattctcgatctaattctcatcttgcttgtcgttctccttacaacggttataggataactaggaagtcaggacatgatgagactgaaagtgatatagttgatatcccatcaactaggttaaattcaagccagaacatgcctaccttgatctgttctgagttgcaatatgccaccttgggtatgaatgaaaagcttctcttggagcttcaaagtattggaatttcctcagaatcagtgcctgaaatgctgcaaacagatgatgaaggaatttgtaaggatatcactaggttagaggagcattaccaaggacagatgtccaagaggaaatgcttgctagatggattattgaaatcggcttcagtgacaaaagaacttcaagaaaaggattttgaacaaaatgctcttgacaaacttgtcatgatggcttatgagaaatacatggttgtgtggctgagtgagttgacaataactgattggcaggcttgctggggtcctagctcatcaggtgggaaaaatgcaagcaacaaaatcgctaagcaagctgcattgggatttgttaaacgaacattggaacgatgccggcaatttgaagatatgggcaagagctgcttcaatgagcctttgtataaggatatgttccttgctgcttcttcacagctaagtgttgttcggaaattagatggcatagaggctgaatccacaaaaccttgtgcttcttccttttctctggaagcaagaactggttccatgggttcacagcagaacccttcacaatttagtcagaatatgaaaaatcatgatctcaattcatcagatattcttcctgctataaatggttcatctgaacaaactagtgggaaggaagatctgtggtcaaacaaggtgaagaaaagggcattgtccctagatgatgttggcggtagcattggaagttctctatcaaatagtacaaaagggaagaggagtgagagagacagagatggaaaaggacaatgcagagaagggctatctagaaatggaacttccaaagttggtaggccagcattatctagtgctaagggagaaaggaaactcaaaacaaagcctaagcagaaagcaactaagcattctgtttctgtaaatggcctccttggcaagctatcagagcaacctaaaacagctttgccttctgtttcgaagtttaacgaaatgtctactaacagaactgccaaggagaaagatgagtttgacatgggtgaattcgatgaccatgagcctattgatttgtccaacttgcaactgcctggaatggatgtgcttggtgttcctgatgatcttggtgaccaaggtgctgatcttggttcatggttgaatattgaggacgatggattgcaagatcatgatgactttatgggccttgaaattcccatggatgacctttcagacttgaatatgatggttcagttcctcaacatgatgctgttcaagttgtttactgagcttcatccagctataatgagtgctgctcttcactctggacagttgctgtcctgcttatga

SEQ ID NO: 12817 - DNA, 378 bp, Glycine max
  Peptide Sequence Number=SeqID_104502
atgttgagtttgtcaacaagaaagtcatgtttccaaggttctagaaaccaaggtggtgttattaagtggctcgattgccaaggcaacccgggcgctctacaaggagaaggtaggagccagaagacaatagtgtacaacctaatatgtgaaaaggtcaagatatgggctaacattctcaacaagagtgttttccacaaagtaggttcaaagatatcactatcagatctccacaagtttgtattcttccacttgatggagaatctgccctttgatctgcctcacattatctacatcaacatactgaggaattttaagggcttaggtggtctagatgacatctattatgctgccctcatcaacaagttgttttgggattaa

SEQ ID NO: 12818 - DNA, 468 bp, Glycine max
  Peptide Sequence Number=SeqID_104503
atgtctatcttattggcatattattgggttagagatgacattgccctattcgtttatagccttgttgacgtctcctcgagatttggacggtccaatcgaattcctgcgctccgggggccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12819 - DNA, 1236 bp, Glycine max
  Peptide Sequence Number=SeqID_104504
atggagtgcgttgcagcgaggaacttggcggcaatggcgttttgcgtgagtccttcgtcgtcgaggttgaggttgcgacggaagaagctgtggagaagacgagccgcgtcgtcctcgtcgtcgtgcggcggcggccgcggcgtgcggtggctgaaggtggaggcaaaggcggggagcgagagctgcgttgcgaccaaagaggacttcgccgatgaggaagattatgtgaaggccggtggctccgaactcgttttcgtacaaatgcaacagaagaaagccatggaaatgcagtccaagctcgcggataagttgccacctataggagatgatatactggatctagttgtgattggttgtggtccggctggtcttgctcttgctgctgaatcagccaagttaggactgaaagttgggcttattggtccggatctcccttttacaaacaattatggtgtgtgggaggacgaatttaaagatctcggacttgaaggttgcattgagcatgtttggaaggataccattgtctttcttgacaataaggaccccatttttattggtcgttcctatggacgtgccagtcggcatctgcttcatgaggaattgttaagaaggtgtgtcgagtcaggtgtctcgtatcttagctcaagagtagaaagtattattgaggcaaccaatggtcatagtcatgttgtctgtgaatatgacattgtagttcccagcaggcttgttactgttgcatcaggagctgcttcagggaaactgctgcaatatgaggtcgggggtccaaaggtttctgtccaaacagcttatggtgtggaagttgaggtggaaaacaatccttatgatccaaatctgatggttttcatggattacagagactacatgaagcaaaatgttcaatgtccagaagcaaattttccaacatttctttatgcaatgcccatgtcccgtacaagagtgttctttgaggaaacctgtttagcgtcaaaagatgccatgccttttgatttactaaagaagaagctcttttcaagattaaatacaatggggatcagaattacgaaaacttatgaagaggtaaggtattggaaatgccaggaatggtcttatatcccagttggtggatcgttaccgaacacagaacaaaagaaccttgcatttggtgcagctgccagcatggtgcatccagccacaggcatgacttcaacacattttgatttaagggatacggtttaa

SEQ ID NO: 12820 - DNA, 3660 bp, Glycine max
  Peptide Sequence Number=SeqID_104505
atggatttggaagaggagcaggagtacgacgagcaaatgatggaggaagacgacgacgaggaagagatcacacaggaagacgcgtgggccgttatctccgcgtacttcgaagagaagggcctcgttcgccagcaactcgattccttcgacgagttcatccaaaacaccatgcaggaaatcgtcgacgagtccgcggacatcgaaattcgacccgagtcgcagcacaatcccggtcaccaatccgatttcgccgaaaccatttacaaaatcagcttcggtcagatttacttgagtaagcctatgatgacggaatctgatggtgaaaccgccacgttgttccccaaggctgctaggttaaggaaccttacttattctgctcctttgtatgttgatgtctccaaaagggtcgtcaagaaggggcacgacggggaagaggtcaccgagactcaggatttaaccaaagttttcattggcaaggttcctataatgcttcggtctagttattgcacgttgtaccagaattcggagaaggatttgactgagcttggggagtgtccttatgatcaaggcgggtatttcattattaatgggagtgagaaggttctgattgctcaggagaagatgagcaccaaccatgtctatgtgttcaagaagaggcagcccaacaagtacgcctatgtggccgaagttcggtccatggcagagtcacagaacagacctcctagtactatgttcgtgcgcatgctctctcggactagctccaaagggggttcttcaggacaatatatacgtgccactcttccttacattcgaactgaaattcccatcattattgtgtttcgagcattgggttttgttgccgataaagatattctagagcatatatgttatgacttctcagatactctaatgatggagctgctacgtccttccctggaagaagcgtttgtaattcaaaatcaacagcaatatgtttctcttccttactgcactccctttccatatgccatcatcttattttgcagtggaatggttgcacttgactacattgggaaaagaggagcaactgtaggtgtaaccaaggaaaagagaattaagtatgctaaggagatccttcaaaaggagatgctccctcatgttggcgttggagaatattgtgagaccaagaaagcctactattttggatatatcattcatcggctactgctgtgtgcacttgggcggagggctgaggatgatagggatcattatggaaacaagaggctggatctggctggtcctttacttggtggtctttttagaatgctattcagaaagctaacgagagatgtcaggggatatgtacagaagtgtgttgataatgggaaagatgttaatctgcaatttgctatcaaagcaaaaaccatcacaagtggacttaaatactcacttgccactggtaattgggggcaagcaaatgctgcagggactagagctggtgtgtcacaggtgctgaatcgtttaacttatgcatccactttatctcacttgcgaagattgaattccccaataggtcgtgaagggaagttggccaaaccaagacagctgcataattcacaatggggaatgatgtgtccagcagaaacacctgaaggacaagcctgtggactggtgaagaatctggcattgatggtctacataacagttggttcagcagcatatcctattctggagtttttggaagaatggggcacagaaaatttcgaggaaatctctcctgcagtaattccccaagccacaaaaatttttgtaaatggttgctggatggggatccatcgtgaccctgatatgttggtgagaacattgagaaagctgagacgtcgggttgatgtgaacactgaagttggggttgtcagagatatcattcttaaagaattgcgtatatatacagattatggtcgttgcagtcgtcctttattcatcgtggataagcaaaggcttctcataaagaagaaggatattcatgccttacaacagagggaatcccccgaagatggcggatggcatgatctagtgtccaagggctttatagaatatattgacacggaagaagaagagactacaatgatttccatgaccattaatgatcttgtacaagctaggatcaatccagaagatgcgtatgctggtacttacactcattgtgaaatccacccatcactgattttgggtgtatgtgcttccatcataccatttcctgatcacaatcaggataccttggcctatgttttatattatccacaaaagccactggtcactacaagagccatggagcatcttcatttccgtcaactcccagctggaattaatgccattgtagccattgcctgttactctggttataatcaagaagattccgtcatcatgaaccaatcgtcaatagaccgtggattctttcggtctctgtttttccgttcatatagagatgaagagaagaagatgggaaccctggtcaaagaagattttggccgtcctgatagagctaacaccatgggaatgagacatggttcttatgataagctggatgatgatggtcttgccccaccaggcacacgagtatctggtgaggatgttatcattggaaagaccaccccaatatctcaggaggaggcacagggacaagctttacgttacacaaggcgtgatcacagcataagcttacgtcacagtgaaactggaattgttgatcaagttttgctgaccacaaatgctgatggattgagatttgtgaaagtaagagtgagatctgttcgtataccacagattggtgataaattcagtagtagacatggtcagaaggggacagttggtatgacttatacacaagaagacatgccctggactgtggaaggcattacccctgatattattgtcaatccacatgctattccttctcgaatgacaattggtcagcttattgagtgtatcatggggaaggtggcagcccacatgggaaaagaaggagatgcaactccttttacagatgttactgtggacaatatcagtaaagctctacacaaatgtgggtaccaaatgcgtggttttgagactatgtacaatggtcatacagggagacgtctaagtgcaatgattttccttggccctacatattaccaaagactgaagcatatggttgacgacaagatccattctcgtggaaggggtcctgtgcagatcctcactaggcaacctgctgagggacgctcacgagatggaggtctccgatttggagagatggaacgagattgcatgatagctcatggagctgctcacttcttaaaggaaaggttgtttgatcaaagtgatgcatacagggtccatgtatgtgagcgttgtgggttgatagctattgcaaatctcaagaagaattcttttgagtgcaggggatgcaagaacaaaactgacattgttcaggtttacattccttatgcttgtaagctcctcttccaagagttaatggctatggcaatagctccaagaatgcttacaaaggagagatgggttagcagaagtttctgtcgcgtaattctagtgagccccgtcttaaatgctgtgaaaggtcttatacccaatcaaccgagaattccagctccaattttggaaatccttttgttggtttag

SEQ ID NO: 12821 - DNA, 1834 bp, Glycine max
  Peptide Sequence Number=SeqID_104506
atgggtgatagcagtgttcaatctgggtctccaaatgcaaaaccagatcttgttgacggagactcggcggtttccaataacgcgacattggaaaccattgttcaaagtttccaagattcaatgtctcttggtaagagacacaagttctgggaaactcagcctgtggggcaatacaaggatgttggggactccagtttgcccgagggcccgattgagcccccaactcctttatctgaggtcaagcaggagccttacaaccttcctaatgcttatgagtggacaacatgtgacatggactctgaggaaatctgtgatgaagtttatgtcctgctcaagaataactatgttgaggatgatgagaacatgttcaggttcaactattccaaggaatttctaagttgggctttgcgggttcctggctattaccagagttggcacattggcgtgagagccaagacatcgaagaagttggttgctttcatcagtggcatccccgccaggatcagggttaatgaggaggttgtgaagatggctgagatcaatttcttgtgtgttcataagaagctcaggtcaaagagacttgcgcctgttatgatcaaggaagtcaccaggagggttcatttggagaatatttggcaggcggcttatacggcaggagttgttcttccaacgccgatcacaacttgtcagtattggcaccgatcgttgaatccgaagaagctaattgatgttggattttcaaggcttggggctaggatgacgatgagccgcactataaaactttacaaattgcctgattcaacggttactcctggattcaggaaaatggagcttcgggatgtccctgctgttactcggctgcttaggaactacttgagccagtttgttgttgcacctgattttgatgaaaatgatgttgaacattggcttcttcccaatgagaatgtggtggatagtttcttggtggagagtccagagaatcatgagatcacagacttctgcagcttctatactctcccttcttccatccttggaaatcaaaattactcaattttgaaagctgcttattcttattataatgtctccaccaaaactccactgactcagttgatgaatgatgtgctgattgtagcaaagcaaaaggattttgatgttttcaatgcattggatgtaatgcacaatgagagtttcctcaaagagctcaagtttggaccgggagatggacagctccattactacttgtacaattataggattcgtagtgccttgaaaccatctggacttggacttggttgtgatggttcagttctgctggatggaggccaagatagcgagaaatttgctactcctaatttgaattatgctagaggatttgaagttatagatacaatcaaaagttcagtggagcgtgcatgtagtggagttgtgtcctgtgctgatatattagccatagctgccagagattctgttctcctttgcacttttttcagtgttagattgttcaacttctcagggacacaagcaccagacagtacaatagaaaccactatgctgagtgagttgcaaaatttgtgcttacaaaacggtgatgggaacacaaccagtgtgctagaccaagggtcagtggatctatttgttaaccactacttcaagaacttgctcgatgggaagggtcttcttagctctgaccagattctcttttccagtgaaaatgccacggcaactactaagcctttggtccaattttatagtgttaatgagagagttttctttgtagaatttgcctatgccatgatcaagatggggaatataaatcctctaactggttatgagg

SEQ ID NO: 12822 - DNA, 819 bp, Glycine max
  Peptide Sequence Number=SeqID_104507
atgggtttcggctgttacagggagttgagggactttggatgtcaccttaaagggcaagtgagcaatgatgaatacggagaagaagggcttaaagggcaagtgccacctccagatgccggtggccatacattcttccaaactggagatggcccaacaacgttcaggttcaatccaagaaacgcagatgacatttttgccgagtttttcgggttctcaagcccgtttggtggtggtggctgcggcaatggcatgaggggtggaaggaccatgagtcagcaaggtccacgcaagccacatcccatcgaaaagacattgccttgcacccttgaggaactctataagggcactgcgaaaaaaatgaagatctctagggaaattgctgatgctagcgggaaaactttgccggtggaagaaatcttgaccattgacattaaacccgggtgtaaaaaggggacaaagatcacattccctgaaaaaggaaatgagcagccaaatgttattgcttcggatcttgtgtttgtcattgacgagaaaccccaccctgtgtttaccagagatggtaatgatttggttgtgacacaaaaggtgtcacttgaggaagctctaacgggctatattatccatcttacaacacttgatggcagggttctcaaaattcccataaacaatgttattcatccaacctatgaagaggtggtccccagagaaggtatgccaattccaaaagaccctttgaagagaggtaatcttaggatcaaattcccagcaaagttgaagtcagagcagcaagccggatttaagaaacttttgccgcattga

SEQ ID NO: 12823 - DNA, 373 bp, Glycine max
  Peptide Sequence Number=SeqID_104508
atgtcaagacaaagcatcctcagttgctatatgagtccaagttgtacagagttctccagggaggaaggagattacaatgttctagtgatggatctgcttggacctagtcttgaagatctatttaacttctgcagtagaaagctctcactaaagacagttctcatgcttgctgatcacatgatcaaccgtgttgagtttgttcattctaaatcatttcttcatcgggatatcaaaccagataatttcctcatgggcttgggaaggcgggcaaaccaggtttactgtattgattttggtttggccaagaaatatagagatagttcaacccatcaacacattccttacaggtacaaggattcagatactaatctag

SEQ ID NO: 12824 - DNA, 405 bp, Glycine max
  Peptide Sequence Number=SeqID_104509
atgggggcatttaggtgtttattctgcataaaaggaatgctcagggagggagatttgaacgcagatggggttggggtcacagatggatctttgtggaaggttggggttacgtatgttgatgcattgaggaatcaaaacaagaaaatatggaaaccgaaggagaagatcgcttgtaacaagaatggcgatgaggagtggaagggaagaaatatgatgcttattgaaaccggaggatggggaaaatgtggaagagctggtgaaagagacgaaggacatcatggaaaatattttccatcaaattacaccatggtcaccaacggaacttccgagggaacgtttggtgagttcatatcactggatgtagacactcaattgatgaagcggttgtatgttgcaagagtaggg

SEQ ID NO: 12825 - DNA, 615 bp, Glycine max
  Peptide Sequence Number=SeqID_104510
atggagaagtctgacaagaaaaatttcaaagacaagaaagcaaagaaagcttacatcacttgggaagataacaatatagattcatcaagagattcagaaaatgaagttgtgaatctgagtctcatggccaaaaactatgatagcgaagaagaggatttcttgaagaaaagctggtacatttacaacagatgttgtaaacacatgacgggagatgcatcaaaatttactcatacatctcccaagaaaagtggacatgtgacttatggagacaacaacaaagataaaacatcaaatcatgctcaatgttttcttagtaaagatgatgattcttggttatggaaagacaacttaggtaagtttgatgcaaaatctaatgaagaatctatccatgttgtttttgatgggactaaccctataaggccaagaaatgagaaagggaacaaaggcaaaggaaatggaaatgaagaagactttcaaattgatgaaaataaaacaaatatagatcttccaagagagtggagaacttcaagatatcatcctcctgataatatcatcggtgacatctcaaaagggaattctctcaagatatgcaaaatgaatttgaaatgtccatga

SEQ ID NO: 12826 - DNA, 1716 bp, Glycine max
  Peptide Sequence Number=SeqID_104511
atggaaagtgtcttctctctctctgtagccgccagaactgattttatccaatttctggtgcagtctttgggctgcagttacatttgtctatgggcatatgattccatttcaccaaatcgtttgagcttcttggatggtatctacaatgtaaggaacaaccaagcaagctctagtttggggagtgtgcaggcacaacagcttttcagtcagttccggactttgacatttgatgtcaatgatgaccgtgttcctggactagcttttaggaatcaacgaccctacctagagctccaacaattggaacttctcagattagcatccacagaaatacaaatacaattctttcaggaggcaaggattaagactgctgttttcatggggtgtaacaagggagaaattgagcttggtttcttaaatatgtcccaagttgacattcaaacagcacttaggagtttgtttcctgaagatttttccactagagtacagtcccagcaaattgatcaaaaccctcctacatcatcttcatcttctctgagatcaatatccacaggtagccctgaatactcatcacttatattcagtattccaggcacatctcaaccccactttccacctgagactcttggagcatcatcatcaagagtagagccaacaatgcagccagtgccaaatagtcctcaccaacgagccattgatattcaagcattgacagaagtcccttctctaacccaattccccacaccagaaactgaacatgatgcaatcatgagagcaatcctccatgttatatctccaacaacttcttatcatcatgagcagcagcaccaccaaaacttgccttatagtaataattttcttcctgtggtgcgtcctgatgctagtgctttccagaggtatagacaagacttaggctccaacatggcctcaaatttcagaaggcaaagcctcatgaagaggtctcttgtgttctttagaaacatgaactttatgagaatgagagaacgcgttcaagcaacgtctcgtcccaccaatactcagcttcatcatatgatatcagagaggagaaggcgtgagaagctaaacgagaattttcaagcacttagagcacttcttcctccgggaacaaagaaagacaaagcgtctatactaatagcagcaaaggagacattgaggtctttgatggctgaagttgataaactaagcaacagaaatcagggattgacgtcacttttgccagccaaagaatctacagctgaagaaaccaaggtagctagtttatcaccaaatgaaagattaagtgtcagaatttcacatgtacccgaatcaagcacatcagaagagagaatggtggagttgcaagtgaatgtgagaggacaagtttctcaaactgatttattaatccggttattgaaattcttaaaactggctcaccacgtgagtttggtttccatggacgcaaacactcacattgcagaagggaacaatgcacttcatcaactaaccttcagattgaggattattcagttaagacgaaggaacttcgaaagtgcagttctgattgctaaggtggtttggtttggtgtgctttgtcaccatcctcagatgatacaaataacattcaattcaaaaaaaggaagtgaatgggacgagtctgccttcgaggaagcagtaagaagagtagttgctgacttggcacagtaccaaatggaccaataa

SEQ ID NO: 12827 - DNA, 534 bp, Glycine max
  Peptide Sequence Number=SeqID_104512
atgaagtacccatgtttcagaccactgcctacttcccaacatatggaaggaactcagttgcttggtgtaaaatgggtggttgatgatttacatgctgtagctcaacatttcccagaatctaaccgtgctatcagtgcaaatgttggaagtgacgtagtgcttctgtttgcttcaaaatatagtgacattaaaacaattgtcaacctctctgagcattatgatatgaaggcaggcattggagaaccctttggaaaagattatttggaaagaatcaggaaggacggtttcattgatgtgaagaagaggaggtctgaccacatcgtatatgacagggtctttactattcatggttcttccgatgaaattattcctgttgaagatgcatttgagtttgccaagatcatatcaaaccacaagttacatgtcattgaaggagctaatcatatcttcagtaatcatcaaggcgacttgtcctcagttgttgtgaactgcatagaagaaaccttgcaccaggtcaagggtactgctagctag

SEQ ID NO: 12828 - DNA, 630 bp, Glycine max
  Peptide Sequence Number=SeqID_104513
atggttaatggcatgatagtctccttgtgtttggtggaggagcctttgacgatggattcggtagagaaatacacaaacaacgatgaagagggggatccagaggaattcgaagaggagggacacaatttgagactaaaagagaatattccaatgacaacagggaagatatcagaggtggataataatcgctggccaaattctttcattgtacacaaggaggcaaatattgggaaatcttcatcatttatggaggacgagaataaagccataataacaggagaggaattggaaaaagtttcagaatttgaaattcacatgggaaaaggaaaaactaatatgggaagaccaataaatatagatgttgagaggggaaatgggtcgttgggtgagataaggaaagagaatgaggaatggaattgtttggagaaagaaacaattaggctcaatatggagagccaaagtggcaaacttaataggtctctggtgggtgaaaagatgaagaataagaaggttgttgtggttggtgtcttgctaagcgaggcactcagcccgcttagcgagttgggagaatctggaggagaatttgctcaagcaaatacgcgctcagcgcgtcatcagctcgctcagcaa

SEQ ID NO: 12829 - DNA, 465 bp, Glycine max
  Peptide Sequence Number=SeqID_104514
atgaagaactcagagatatattacgctgttcttggaggattaggtcaatttggggtgataacaagagcaagaatacctctaggacctgcacctactagggcaaattatgtagaaggtgtgcttctattgaatcagccaccactagatctttccttttatgcatcttctgatcaacaaaggataacttccctggatcttgcgaatctggtgaaagggttaaatttcgtgcctacatttatgtttgaaaaagatgcatcctacgaagagttcttgaacagaattcatgctgatgagctagttcttaggtcaaaaggactttgggaagttcctcatccatggttgaacatctgggttccaagatctcgaatctcggatttcaatgatggtgtcttcaaggatattattcttaagcaaaatattactgctggaatttctttagtctacccaatgaaccgaaacaagtga

SEQ ID NO: 12830 - DNA, 309 bp, Glycine max
  Peptide Sequence Number=SeqID_104515
atggaaactgcaaaagggaccaccgaaagaacagcaagcaaccggaagaaacaaagcagagaagaaagcgaaaggcaaagaaggttcttccggaaacttccggatgacgttcttccggaagtagtttgtgggtacttccggaattcacaaattcttcttccggaagatgtttttttccggaaactttctggaaaacctttttccgaaaagtttccggaaatacttcttccggaagaagaattattgaagggcaattttgccacttcactgtttgttgggtgccccagcaataatgctgggtgcacgtag

SEQ ID NO: 12831 - DNA, 816 bp, Glycine max
  Peptide Sequence Number=SeqID_104516
atgactgaaacagcagaatcttcagcttacggtgtgatggcaagttggttcacaccctcgtgtctattcctcttcatcaacctcgtcatcggcaccatcgccatcatctctcgtttcgccaacacgaccaaaagacaacaccaactcgtccgttctccctctttgctagaaaggcttgcgtctctcaacctttgttatcacaaacaatatgaaccaacaacaacaacattgcttcacagccatgtgaacccggtccagagtcgggatgaatccagacttgatagggttaggtctttcaatctcgatttttataacgtggataatattgaaagacctgacccaattgaaaattctgactcaccccaactagaccgggttccttcctcatctttgggtcaggtcaagtctttcaatcttaatatctataaatcagagattgaaagacttgacctagtccataggcctgactcatcccaaataggccgggtttcctccacgtctttgttggaccgagtcaggtcatttaatctcaactttaataaagttgagattgaaaagtctagccgggtccaacagcaagtgacccgtgctccctcgatactcgagcggcttaagtcgtccttgtcatttgacagatcgatgtcagtgaccgagcctgaatccgaagttacaggtggtggagagttggtggaggaaactgaagaagaaggggtggatgcaaaggctgatgatttcatcaataggtttaggcagcaactgaggttgcaaaggcttgactctattatacgttacagggatatgctcaaacgatactaa

SEQ ID NO: 12832 - DNA, 261 bp, Glycine max
  Peptide Sequence Number=SeqID_104517
atgcctgtggtgtcttcattagttgttggagaaatagctggtgaaggctctgcatcaaaagaagaagagggagaggacttgtcggcggtagctggagaagggatcactagaggtggagcgtttggagtggctcgggccctgacccgccttggtctcgagaagacattggaagggtctactggattcataattagcttgacctcatcttcttatagaaacacaaactttaggtgttgcccagcaaggtcaacttcttactga

SEQ ID NO: 12833 - DNA, 384 bp, Glycine max
  Peptide Sequence Number=SeqID_104518
atggacgaagatcaatggacgtatgacaatataatgtctgaaaaagttgatatggattatgaaaatgaacaagaatatagtgtgaatgaaccacatgttgattgttcggatgcttttaatatttctcaggtctttggtacccgagaagatgtcttgcagtgggctcgatcggttgcccatgaaaacagagttgcaatcattatgaggtctgatacacatactggtagtagaggaagaagttcatttgtgttaattggttgtgaaaggagcagtcagtataagtgtaggaagaaagaattttttagaagagacactgggagtaggaaatgtggttatcccttcaagcttagtgggaaaccaatgattggaggggaaggttggatg

SEQ ID NO: 12834 - DNA, 579 bp, Glycine max
  Peptide Sequence Number=SeqID_104519
atggttagaactagaggtttaggtcgtgcattaggtagggttatagccggagccctgggtagacaggatgatcatcatgcagatgatattccccaggggcgtaggccttccacatccgcatgtaggcaacgggaagctgcccctgttgctgaggatgttccagagatcactgaggacatacctgcacatggtgcagagggattagctggtgatggtgctaaaggatcagctgctgatgattctgagggattcccaagtgggccacatgactcattagtgctgacttcgtttgttgagcatgttatacataacatatggattggaaagattgaagggttagtcgttgccacaggattaactcctttgatcgtgtgttcagtagtcaccagcgatacgagagttatatccgcttttgtcgagaggtggcacaagaagactagaaacttctatctttcagtaggagagctgaccatcacactggatgatgtggcgtcactcctccatctgtcgatcacaagtgccttccacagcttcgagcctctacatgtggacgttcatcatgttggtggagttgcttga

SEQ ID NO: 12835 - DNA, 928 bp, Glycine max
  Peptide Sequence Number=SeqID_104520
atggggctagtagtggccagagaccatgaaaaactggttctgggagctgctaccataatggttacggtggtgtatatgaaccaaggactgcagaagctttatgctacaagtgggcgattcaagtggcaggcgagaacaatacaggactgcaaagtactcaacaagaataagcttcagtttatcaaaagggcaggcaatagagtggctaatgatttgactaatctagcttttgtagtaggagaaaaatattggatagagaaggtcccttaccaattggaccttctagttgcttctgatgaagaccgctgtgagaatgatacccatgtgacaaacacttgggtgcatttcgtgaatggtgatgacaatggtaatagtgatgatgatgtcagtaacaacaacagcggtagaaatactagtagtgctcacaatgataatgacagtggtgatgaaggtggcattggtggtgatagtgatgacatggtggtgatgacagtgttggtgatgtcaaacaatggtgctagtggtggcgacagaagtggtattagtagtggtggtgatggttgcgacgacattagtggtggtcatggtgacagtgacaaaaatggtggtggtggtgacaacacggtggtgctagcgatgacattgatggtggtggtggtggtagcaatgccaatggtgatggtgatatcagtggcaacgatggtggttgtgagtgtagcggtgttggtgatggcaccaagtgatagtgatggtgattgcgacaacattggtggtggttatggtgacgataacagaggtggtggtgacaatgatggtgttggtggcattgatggtggtggtggtgatagggatgttagtggagatggtggtggtggtatgctagtggtcgtggtggtaacgaccagttatggtagtgataatgatgatg

SEQ ID NO: 12836 - DNA, 2316 bp, Glycine max
  Peptide Sequence Number=SeqID_104521
atggggaagagagagtttcatggggtggtgttgatgtcgttgtgtttgtgggtttgtggtgtcacagcctctgtgacttatgaccacaaggccattgtggttgatggcaagagaagaattttgatctctggctccattcactaccctagaagcacacctcaaatgtggccagaccttattcaaaaggccaaagatggaggccttgatgtcattcagacctatgtgttttggaatggccatgaaccttctcctgggcaatactatttcgaagataggttcgacttggttaaattcgtgaagctcgtgcagcaagcaggcctctatgttcatctccgtattggtccctacatatgtgctgaatggaacttcgggggatttcctgtctggctcaagtatgttccaggcattgctttcagaaccgacaatgagccgttcaaggcggcaatgcaaaaattcactgcaaagattgttagcttgatgaaagaaaataggttgtttcaatcccagggtggtccaataattatgtcacagattgagaacgagtatggaccggttgaatgggaaattggtgctcctggaaaagcttatacgaaatgggctgcacaaatggctgttggtctagacactggtgttccatgggttatgtgcaagcaagaagatgctcctgatcctgttattgacacttgcaatggatactactgtgaaaacttcaagcccaacaagaacaccaaacccaaaatgtggactgagaattggactgggtggtacacagattttggtggtgcagtccctcgtagaccagcagaagacttggcattctcggttgcaagattcatacagaatggtggttcatttgttaactactatatgtaccatggaggaacgaactttggccggacatctggtggcctctttattgccactagctatgactatgatgcgccgcttgatgaatatggacttcaaaatgaaccaaagtatgagcatttgagaaatttgcataaagcaataaaacaatgtgaacctgctttagtggctacagatcccaaagttcaatcgcttggatataaccttgaggcacatgtgttctcgacccctggtgcttgtgctgcattcattgcaaattatgacaccaaatcttatgcaaaagctacatttggaaatgggcaatatgatctaccaccttggtctatcagtattcttcctgactgcaaaactgttgtttacaacacagcaaaggttggtaacagctggctgaaaaagatgactccagtaaacagtgcatttgcttggcagtcatacaatgaagaacctgcctcatccagtcaagctgattccattgcagcatatgcactttgggagcaggtcaacgtgacccgcgattcttcagattatttgtggtatatgacagatgtctacattaatgctaatgaaggattcttaaagaatggacaatctcctgttctcaccgcaatgtcagcaggccatgttctccatgttttcattaatgatcaacttgcaggaactgtgtgggggggattggcaaatcctaaattaacatttagtgacaatgtgaaactgagggttggcaataacaagctttctttacttagtgttgctgtcggtctcccgaatgttggtgtgcactttgaaacatggaatgcgggggtgttaggcccagtcactctgaagggtctaaatgaggggactcgggacttgtccagtcagaaatggtcttacaaggttggactgaaaggtgaatcgttgagccttcacactgaaagtgggagtagctctgttgaatggatacgaggatcattagtggctaaaaaacaacctttgacatggtacaagacaacttttagcgcaccggctggcaatgatccattggctctagatttgggaagcatgggaaagggtgaagtatgggtaaacggtcgcagcattggtcgccattggcctggatatatagcacatggtagttgcaatgcttgtaattatgctggattttatactgatacaaaatgccggacgaattgtggacaaccttctcagagatggtaccatgttcctcgctcatggctgagctcaggtggtaactccttggttgtgtttgaagaatggggaggtgaccctaatggaattgctttgagcagcattgacaagaaatgtatgtctaataacaaatgtctaggaaatgcaaagaagctgtcaatatacctcaaaagatttccaaggcctaatcatgcatcgcctggccaaaaacaaagaggatgcaaatatactgtacatagtcaagtcaggctattgtgctga

SEQ ID NO: 12837 - DNA, 504 bp, Glycine max
  Peptide Sequence Number=SeqID_104522
atgggcatacccacggttcaaggctgtcattatataatcctctgtacttatctgcaaagtcaagaacttaattccaaagaaaagttgcaagtgttgctgatatctctgctgaatagagctagggaagtccttgctaacaacaaaggttgttcttggggtgtccatgtcttcaggtctctcccaacaattgtgatcaatacatttagtactcaatttttgtcagagagcttgcttctgattgatcttgataacaatcaagtgaaaagtgtgactaatatagctgcttcaaagtaccaaaaaacaaaaaaggtagattcaaaagtaaccttgagagacatacaaggtatagataaatttgcagtcgcggtggagcttgacgtcgtggacaacgacacaaaagaagagtttgtcgatgtagtgactctagtgatcgtcctagatcatgaccatgttgggtgggtactgcggatggagcctatcgacaacgagctggccagaaaatga

SEQ ID NO: 12838 - DNA, 318 bp, Glycine max
  Peptide Sequence Number=SeqID_104523
atggagcagaaagtagaacttgaacaacaggaaacaagaagattaaggaaagagcttgagaacgaaaaggaacaattgaagtctatgcaaagaactctagaagatgatgaaaattatgagaatacttctgtagaaatggatggagtcattgttggaacctctagcagagaaaaagaagttcatggataccatggacaaaattgtgccaaggcaaggtcaactacttttgcacaaaggctcaacgtagttcacattgaaaggttgagcaatgaagcaagtgtcaactacttctgcattaaggcccaatgtagttggtga

SEQ ID NO: 12839 - DNA, 1011 bp, Glycine max
  Peptide Sequence Number=SeqID_104524
atggcaggtgttcaaataaagttgatattggagaaaggtgttttggaagacaactttccccttgggggtggccatctgcgtttgaagttgcaattcatccttagcgatgaagagcgcgacagaattcgttcattgagacaatctgcattaaagaaaaaacatgagcttcttagtagcggtagaagagctgaagaaagtgatagtagaaccatgattggcgatgctgcattacccttccgcagaaatgatgaggtctcagaatcaccaaagaaacaacctcaacaagaagcccaattgcaagatcctgctggttctggcgatggcaaagaatctgatactagaaatgtagttggggctcagcttgaccagaaaaaacagctaattaaacccaatcaatatagggagtcctcatccacaatacctgtgtcacaagcagttactctcactcgatcaccacagaagggtaaggagcctttctatcagtcaccaaatctcaatcgatcgtcatctgagaaacatcctcagagggatattggttcagaagaaattgcaattttgtttggctcagaaaaaaaggaagccctgacaagtaatctgatacaacctaatctagagcaaggtggtatacagtattctgagaagaggacctcactggggagaattcccagtaatgtgaagaaaatgataagtgcctttgaaggtggattggctcaggataagagacctcagattaaaccacctccaacaaaacaacaagaaagttcaattgaaagaagagattcttccaagactcagcttttggagcaagataagtcaaagaacacagaaccagcagacttgcatgaaagggtgaaaagagcctccctgaatgaagcaaatgctggaactggaactgaggagggcgagtatgaaaagatacgggaaactaaagaatcaaagcccaagacttctgataataatggagatgaaaattctggaggaccatttaatcaggttataatctacttttaa

SEQ ID NO: 12840 - DNA, 318 bp, Glycine max
  Peptide Sequence Number=SeqID_104525
atgaagtttggggcattcattaaccgctttttctttttgttttccttcgaggtgtttaggtactgtagaagggcaaaagctgttttcaaagagttgaaccaagttccacatgttgttgagctcgacgagagagaggatggttcaaagattcaggatatcatgattaatattgttgggaggcgtactgtgccacaagttttcattaatggaaaacaccttggaggctcagatgacaccgttgaagcttacgagagtggacatctgcataaacttctaggaattgagacaaaggatcatgatgatcacgatgatctctga

SEQ ID NO: 12841 - DNA, 585 bp, Glycine max
  Peptide Sequence Number=SeqID_104526
atggtcgttgatgcattcgacatcactgttgccgtcactgcatggatggttttgcttttaaaagaaaagagcatagagcaacatcaggagggtaattttattgttcattgcaagcatcaccaccaacctagacaggacaagcatttccagaacaagagtagggaatcattgaggttgcttgtcacaccaatgcagttaattagtgtagtcacaagaatagtaggttgtgcaggactgaagccaacagttgctatgataaaagcatggacagacatagctttagccaacaaagggacattgattgtgggaggtccttttgttcttcctcctcagcaacataacataaaattagttacaaatgattcagaacattatatcattttccaatgtatccaggggttaccaaagggtgcacttatgcaaataatcttaactgcatctgggggtgctttcggggattggccaattgataaactaaaagctgttaaagttgctaatgcagtaaaacattccaactgcaatatggggaacaagatagctgtggattttgctatactttttaataaaagatctagaagtaattga

SEQ ID NO: 12842 - DNA, 321 bp, Glycine max
  Peptide Sequence Number=SeqID_104527
atgaagagtatgcaaccaacctatgcctcatggaaggctcagaaaaagatgagtttaggcttcaataagaatcctaagaaagtttttcaaaagcctaacaaagttagaaggctgaaaggaaatgctccaagatggggacaccaaacctcaaaatgttatactaaaaggagcattccctttagaaaggtgactaacacacaaggacccaagaaacagtgggtacctaagaacttactactttttgatgcaggaatgtatgctccacaacaagagaaaagagttgtggttctaggaaaatggatgctccaggcatatgattga

SEQ ID NO: 12843 - DNA, 771 bp, Glycine max
  Peptide Sequence Number=SeqID_104528
atgagtgttaaccgcggtgttccgcatcacgcgccgagctcacgcagcttgttgagaaccatgttaatggggaaaacatacacttcttgtttagaaaacttgtatagagaactatgtcgagcatcgacggaggtggataaagttatgggtggttgtgccatactattacagtcatgggtttggtaccgcatgtcttttattgcactaagagtcccacgacccgaaacaacttatccattggataaaagatctttaagtgcagattttcaggaaagtgatagatctcatccagcacaagctgttgcagcccagatacgcacactgctatttaaacatgaaggctgcacgggtttgagtaccaagtccgggattgaagagttattttgtgagttttgggacttgagtgttttatggagtggtggtagattaaaatataggaccatatctcatggtgacttggtcggatatagatctcgtatagattatatggagagccatgagggacaagtgttgaacaaaaacattttgaaattccacatcctcagtcaatgtattgtactccttcacctattcatcaaacttttggccagactaacgagacaaagttcttcagctgcagcaaaccacattgaatatactgatatagaacaacaacatcatcatgacatggagaaccagtcatacaggaaagaagaaatccacgacgtaatcaatgtccaccgcttgtgggactggtcatcgtcttggtcattaaagtataaaacattgtga

SEQ ID NO: 12844 - DNA, 183 bp, Glycine max
  Peptide Sequence Number=SeqID_104529
atgggtggttgtgccatactattgcagtcatgggcttggtacctcatgtcttttattgcaccaagagtcccacgatccgaaacaacttatccattggctaaaagatggagtggtggtagattagaatatagggtcacacttcatggtgacttggtcagatatagatcatatggagagtcatga

SEQ ID NO: 12845 - DNA, 255 bp, Glycine max
  Peptide Sequence Number=SeqID_104530
atgggggtaataaaaacaaagcatatagagagaaaagggagagctcaggcttggaatgctgagagaagtgctctgaggcgagcgcgcttagcgcgtttagatcgtgcgcttagcgcgcgctgcaggcttagactgtgtttctgttggatcacgcgcttagcgtgtggctcgcgcttagcgcgtgtaacggattatgcatcttcgagcttaacgcctcgcttagcgcctgtgctgctttgctcgcttagtgcgtga

SEQ ID NO: 12846 - DNA, 1380 bp, Glycine max
  Peptide Sequence Number=SeqID_104531
atgttgtcattcctgatcagcgcacttatccttctcttttttcccacatttctaaatgataacgaggagtattttgagttagatcttgtagaggactacatgacccttaatgctcatgtacaagaagatgaagacgaaggtggtgagcagcataatgaccaagtggctgaggacatcaatgtgaagcagcataaagttaattggtttgaacaagaaatttattcagaagtcaaatggtgcctggctttagacagtgtggagtttcgaggggcaagtgagttccaaaatctgaccgttctttctacaaaacggtttggaaaggcactcgtcattgatggacatttgcaaaacacagaattggacgaatacatttaccatgaaaacttggtccatcccgctctgttaacacataataaccccaaaaccgtgtttattatgggaggaggtggaggttctgctgcaagagaggtactgaagcacagacacattgaaaaagtgataatatgtgacattgataggaacattgccggtttgatccgcgagcatatgacggcaaatcatgcggcctttaaagatgagaggcttcaaattgtatacaatgatgcaaagtatgaactagagatgtctgaagagaagtttgatgtgatcctaggagatcttcctgaactagatgaatcaaattcatcaggttctagccatctctacacaaaatccttttatgagaatgttgtcatacctaagctcaagggcaatggtctccttgttactcaagcttcgaacgaaccaatcaatcttgacggtgagcaactcaacaacaggattggtgaaagaatcaaggacgagttaagatatctcgatgggcctgtcattatagcgtccacagttctaaacaagactttgaaaaactcgcttatggaagagactcggatcttaacggatgaaaatgtgaacgtgggatttgttcgcaaacgtggagaggattacgagttagatcttttactgaacctttatgctcctattccattactagaagatgcagatgaagatgaagatgaagatgaaggtggtgagcagcataatgaccaagtggctgaggtcaccaatgtggagcagcataaagataattggtttgaacaagaaatttattataaagtcatatggtgcctggctttagacagtgtggcaagtgagttccaaaatctaaccattctttcaacaaaacggtttggaaagcctcctcacctttcgccctcatcttctgctccaccacactcgtgtccctcaccttctgcctccaccgctgtcacgtggcggaactcatgtagtcagagtctggttggtccgaccgtagtgcatggggttcctctcactcttcgatga

SEQ ID NO: 12847 - DNA, 153 bp, Glycine max
  Peptide Sequence Number=SeqID_104532
atgcggcaacgacgtttggttcttagaaccaccacaaaggcaaggcaagcagtgtctggtttgaagtccatcacgtctaaacacctggcattggcaagtcaagtcattagttttgtacatgttactattccaagtacaaatgccctcacctaa

SEQ ID NO: 12848 - DNA, 894 bp, Glycine max
  Peptide Sequence Number=SeqID_104533
atgatcaaaggaaaagacatttacgaagttgtggcagcacttgtgcctctctacgtggctttgatcttaggctatggctccgtccattggtggaagatattcaccccagaacatacccttccattccatttcatatcatccaacaacccttacaccatgaacttcaggttcttagctgcggactcacttcaaaagtttgtgattttggtcgcacttttcctatgcaccactttcacgaagtggggtgccaagcttttcatttcaaatcaattccctaagactgcagatgcaatttcaaccctaagggttgattcaaacgttggctctctcaatggtagagagccattgcaaactgatgcagaaattgcagaagatggacaacttcatgtgatagtgaggaacatgtcacgttccacgtcgatggtttcaccaaggacatcaaatcttaccggggttgagatattttcggtgacttcttctagagaagtaccaagccaaagagcttcaagtggtgcttctggttttgaagaatggatgatgttgaataacaacaagcatgagaagaggttttcaaggagcaagaatactgttagtgatgatttggtaatttctccgtctccaaaaccaataaagtttttagggtctaacagtggtggccaaagaaacaaagacatgaaaaacggtgcaactattaacaaggataaggggttacacgtgtttgtttggagctcaacttcgtcgccaacttctgatgttaattatacgaaacatggagtgaatagagttggttccgctgactttggcaccattgaatcttccaaggttgttgatttataccacacgaaactgcttcctcaaaagatatatgctcagaggacaaacactttcaaatag

SEQ ID NO: 12849 - DNA, 876 bp, Glycine max
  Peptide Sequence Number=SeqID_104534
tcttgttaggtcttcatactgaggggacaccattaattggtcaaactaatcttgattgtgctgaattgtgtgaagaattattgggagtcagaccacaggaaggtgaacttcaaggcagtggagttctatttgttgacaaaagcagcagtaaagtttccctaagagagatgtgcagcgccaccggttacaaaataaaatcaatcggaagtatgtgcatcttaatccaaatgtgggcatgggaacgctgcacgactttggctccaaagagaactcctcctataatggaaaacaaaccactcggacacagatggctgcgacgtggaaaccaacatattggcaatgatgatctaatagttttccgtcgcaaattagatatcatgaaacgacttgagtttctgagggagccttacccagcaactgttatgtcgatgttgcctcccatttgtttggttggtagtgtggcgtggtgcgcagtggtgccactcatttgtttccatgttgtagagtggcaccaaccgaataggtggaataatcgagctgagtttagggtcgacgtttatcctcgacaagagggcctattgagttttaactcggattacatggtctggtataggcgaaaaacaaaaatgtttgtcgacccaaacaatgcaaacacggctacattgggtgaagttgccgagacattgcagtatatggtgtcactacaagggcgaaacacatggacagttgatgatcttgtgccatatgttgaaaagttagcgattatatcccaagagcaagagaggatcactgagcatgtggcacatggtccggcatcagagcgtcgatttcccccacaacagtttcacatgcatcagtcaagtgttgaaactcgag

SEQ ID NO: 12850 - DNA, 693 bp, Glycine max
  Peptide Sequence Number=SeqID_104535
atggccatgccagaatttgataccaggaccaagcaatccccagagggacttagtgctaagagaaggcaaggaagcgagtcaactcattcatctaagatacgcggggatcttgatgcggatgaagagcatgctcatgacgtaggcgagaaccacggaggaaactccggcggaggcgtaggacaccttgacggatttcgcgcggttgcgatcgagggcgaggtcgaggagaatgatgccgacgccgccgaggacgaacatgaagccggaggagaggccctcgataatgtactggccgttgacacggccggacatgaagacgacggggcgaacggcgccggtgtaggggtcctgcgtggagccaatgccggggggctcgacgatgatgtcggagggaagcttcaggcggaggcgagggggacggaggaagctgaaggggaggacgcggaggaggtggaagattggatcgatggatgcgccggaggaggaatcgaagccgccggaggaggtggtaacaatggcgacaatgatgatggaagcaacggaatggcaatggcgataatagcagtggaatggtggcgcgatggcgacaacaatggaggcgacaaattgatagcagcgacaatgtggtggtggaggtggcaaaggcgacaacgacattgtggtggtggtagtggcgatggtgatggtgattag

SEQ ID NO: 12851 - DNA, 578 bp, Glycine max
  Peptide Sequence Number=SeqID_104536
atgcaaaaagcggtaaatcaggcgcgctgccgctataatcgcgcccagcaatttttgcccaccaatgcacaccgcaggagacgccggatgaatcagggtccgttaaccgaaaaagagctgaactggcttgatgacatgctggaaaaatatggcaacgaacactccgtggtggacaccgccgaactggacggcatgctgaccgccctgctctccggcccgaacgatatcgaaccgagcgaatggctggtggcgatctggggcggtgagaagaagattcctcagtgggcgaacgcgcgcgaaatggaccgcttcatggcgctcactttccagcacttcaacgacatcgccgagcggctggcggagtacccggagcagttcgatccgctgttcggcgagcaggagatggaaggccagctgtttaccgtggtggaagactggtgctatggctatatgcgtggcgtggcgctggatgcagactgggcccagctgccggcggcacagcaaccggcgctgcaggcgattgcgctgcacggcagtgaagagcagctggcgcagcgtgaagcctttacaccggacgc

SEQ ID NO: 12852 - DNA, 678 bp, Glycine max
  Peptide Sequence Number=SeqID_104537
atgctggaactgttcaaagccatcgggctcggcctggtggtgattttgccgcttgctaacccgttaaccaccgtggcgctgtttctcggcctcgcgggtgacatgaactttcaggaacgcaatcgccaggcgctgcaggcgtcaatctacgtgttcctgattatgatggtcgcctggtacgccggtaacgcggtgctgcacacctttggcatctccattcccggtctgcgcatggccggcgggctgattgtcgcctttattggctttcgcatgctgttccccgccaaaccggtcgggcattcggttgaggccaaacacaagctggatgaactcgacgccagcgacgatccgcgcgaaacggtgaatatcgcctttgtgccgctggcgatgccgagcaccgccggaccgggcaccatcgcgatgatcatcagttcggcctcgacggtgaaagccggcgtcgatttccccgcgtgggtggtggccatcgcgccggtgctgacgttcctggcggtggcagtgattttatggatttcgctgcgcagctccggcgccatcatgaagctggtcggcaaaggcggcatcgaagcgatttcgcgcctgatggggtttttactggtgtgtatgggcgtgcagtttgtcatcaacggcgtgctggaagtggcgcacacctttcattaa

SEQ ID NO: 12853 - DNA, 1899 bp, Glycine max
  Peptide Sequence Number=SeqID_104538
atggcacaacttatcctgcccctaagcttgtttctggcgattttaatgacccttgggcggctgtacaccgaaagtgaaattacggtgatgcacgcctgcgggctgggtaaaggcgtcctgattaaagcggcgatgatcctgatgctgttcacctcgctggtggcggcggtcaacgtgatctggcttggcccgtggtcctcgcgctatcaggatgaagtgacacaaaatgccaaagccaacccgggcgcggcggcgctggcggcggggcagttccagacctccagcgacggcaataccgtgctgttcgtcgaagacgtgaagggcaacaaattcggcagcgtgttcctggcgcagctgcgaccgaagggcaatgcacggccatcggtggtgctggccgacagcggccacatggagcagcacaaagatggctcgcagaccgtgacgctggacaaaggcacgcgcttcgaaggcacggcgctgctgcgtgacttccgtattaccgacttcgtcaattatcaggcgctggtggggtacaaagaggcggtgctcgatcctaacgatgccgatcaggccgatatcagcacgctgataaaaaccaaaacgccgcagttccaggcggagctgcactggcgtctgacgctggtgttcgctgtgctggtgatggcgctgatggtggtgccgctcagcgtggttaacccgcgtcagggccgcgtgctgtcgatgctgccagcaatgctgctctacctgatcttcttcctgctgcagagctcactgcgctccaacgcggcgaaaggccggtttgatccggcgatctggatgtgggtggtcaacctggcgtatctggcgctggcggtggcgctcaacgtccttgaccgctatatcggcaaaaccatcttcaacaccatcatgatgacgttgttcatgctggtgtcgctgtcgggcatcattaagtttgttgatcagctgcgtaaaaccgggcagggcgcgtataccgcgctggatgccggttactacacgctgctcagcgtgccgaaagatatcgagatcttcttcccgatggcggcgctgctgggcgcattgctggggctgggcacgctggcgcagcgcagcgaactggtggtgatgcaggcctccggctttacccgtctgcaggtggcgctggcggtaatgaaaactgcgattccgctggtgctgctgaccatggcggtgggcgaatttgtcgccccgcagggcgagcagatggcgcgtaactaccgggcgcagcagctgtacggcggctcgctggtttcgacgcaaaacggcctgtgggcgaaagacggcaacgactttatctacattgagcgcattaaaggcgacaacgagatcgacggcgtcagtatctatcgctttaccgaccagcggcgtctgctgagcgtgcgctatgccgccaccgcggtctggaataaagatcgcaaactgtgggagctatcgcaggtggatgagtcggacctgaaagatccgaagcagattaccggttcacagagcctgagcggcgaatggaaaaccaatctgacgccagacaagctgggcgtggtggcgctggacccggacgcgctgtcgatcagcgccgctgtcggtggcggtgatgatgctgatggcgctgtcgtttatctttggtccgctgagaagcgtatcgatgggcgtgcgcgtggtcaccggcatcagctttggcttcctgttctacgtgctggatcagatcttcgggccactgagtctggtgtacggtttaccgccggtgctgggcgcgattctgccaagcggcgcgttcttcgccatcagtttgtacctgttgctgaaacggcggtagtgagggttgcaggggcgcgattcagacgcccctgtcattcccgcaccgttacc

SEQ ID NO: 12854 - DNA, 1728 bp, Glycine max
  Peptide Sequence Number=SeqID_104539
atgctgaccgatcagtggtacgtgcgcacggccccgctggcgaaagtcgcggtggaagcggtagaaaacggcgacattcagtttgtgccgaagcagtacgaaaacatgtacttctcgtggatgcgcgacatccaggactggtgcatttcgcgtcagctgtggtggggccaccgtattccggcctggtacgacaacaacggtaacgtctatgtcggccgcagcgaagaagaagtgcgtcaggaaaacaatctggccgctggcgtgacgctgcgccaggatgacgacgtgctcgacacctggttctcttccggcctgtggacgttctcgactctcggctggccggagaacaccgaagcgctgcgcaccttccatcctaccagcgtgctggtgagcggcttcgacatcatcttcttctggattgcgcgcatgatcatgctgaccatgcacttcatcaaagatgagaacggcaagccgcaggtaccggttaaaaccgtctacatgaccggtttgatccgcgatgaagaaggccagaagatgtccaagtcgaaaggcaacgtcatcgatccgctggatatggtggacggtatttcgctggaagatctgctggagatacgcaccggcaacatgatgcagccgcagctggccgagaagattcgcaaacgcaccgagaagcagttcccggacggtatcgtgccttccggcaccgatgcgctgcgcttcaccctcgccgcgctggcgtccaccggtcgtgacatcaactgggatatgaagcgactggaaggctaccgcaacttctgtaacaagctgtggaacgccagccgcttcgtgctgatgaacaccgaagatcaggattgcggccagaacggcggcgagctgaagctgtcgctggcggatcgctggattctgacggaattcaacagcaccgtgaaagcgtaccgtgaagcgctggatagctatcgctttgatatcgctgccaacattctgtacgacttcacctggaaccagttctgtgactggtatctggagctgaccaagccggtgatgaacagcggcagcgaagcggagctgcgcggcacgcgcaacacgctggtgacggtactggaagcgttgctgcgcctggcgcatccgatcatcccgttcattaccgagaccatctggcagcgcgtaaaagtgctgaagaacatcgaccacgataccatcatgctgcagccgttcccgcagtatgacgcggcgaaggaagatgcggaggccaaagccgatatcgagtggatgaagcaggcgattgtggcggtgcgtaatatccgtgccgaaatgaatatcgcgccgagcaagccgctcgacgtgctgctgcgcgactgctcgccggcggcgcagcgtcgtgttgaagagaaccgcaacttcctgtcgcgcctggcgcgtctggagagcctgaccattctgccagccggcgagaaaggtccggtctcggtgaccaagattgttgatggcgcagagctgctgatcccgatggcagatctggtcaacaaggaagccgagctggagcgtctggcgaaagagctggtgaagctggatgtcgagatcgagaagattcagaccaaactggctaacgaaggctttgtatcgcgcgcaccggaagcggtggtggcgaaagagcgcgagcgcgtagccgagctggagcaatcaaaagcaaaactgattgaacagcagggcgtgattgcggcattgtaa

SEQ ID NO: 12855 - DNA, 1968 bp, Glycine max
  Peptide Sequence Number=SeqID_104540
atgagcacagcactcaccaacgcaaaacaactctggactaccgatccgcaacgcacttttagcggctcagcgccaaccgaagcaggcggcatcatggaaattgtgatggacagtaccgtctataccgtctccattgccgctaatggcagctggagctggcagccgccgtttccactggctgaaggcccgcataatctctccgtacgcaccattgaccgcgctggcaacgtcggagccccttcgctgtttatcgttaatgtcgaccttaccgcgccggaccagccgctgattattggtgtcgatgacaatgcggggaataaaaccggtccggtgagttccggtcagcagaccgatgaccgcacgccgaccctgaaaggcgtggccgagccggacagcatcgttcgcctgtacaatgcgcagaaccagttgattggcagcgttaaagccagcagcaacggatactgggaaattaccccgacgctggctgacggtgagcattcgttgtatgtgacggctaccgatgggcgtggctacgagagcgaggcgtcaaataaatttattcttaacattgccgatgagtaccgagctccagataaagttgaaattattcaggctgtggatgatgcaggtaattcaaaaggggagcttaaatctggcgatgtgaccgacgatacaactccaatattacgcggtaccggaatacccggcgcgattattgagattcagtaccgcacatctggtgggaattggaaagcagcgggtaacgccacagttgacgccaacggtcaatggcagattgaatctcctcagttagaaagcaatataaccatatcctatcaagcgcgcgagattaatagtatcgaacacggtgaatggtctgaagtttttacgttaaacattcaacctgaagtaccggtaattgtgggtgcacttgatgatttatccccctctggcggtctgatacaacacggtggttttacagatgatttaacgccgatattgaaaggtacgggttcaccgggacaaattattactattgagtatggccagtttggtgatccatggatagcaggcggcacagcggttgtagataaagatgcgtccggaaaagaatcaccaggctatttatgggattttaatgatggaacattgcaaggatggaaagctgcgggtaggtatagccaatcaggagagctgacagtaaaaaaatggagtggcaacgcaacaaatcagttgggtagtatgacgaatggtatccacaacgaatacaatggagaagtcgcttaccgtactatcattgtggaaaaagggaaaacttatgaggtttcttttgatgcccttcaacatacatcaggaggtaattacaaatcaaaactgggaatgagcattgatggaaaatcggtcattccggaaacacttcaaaaaacaagctggacacattacacaggctattacacggcaaccgaaacaacaaaagtcaaggtggctattaccaatggtaccgcgagtacaaatggtaacgatttcgcgatagacaacatcggcattaaacctgtcgaagaaaaaacagacaatcaccttactgatatgaaaaccagtaacgaggtaattagcttgggtgatgaacaaagtagtttcgatttagctaacctgctgacagaaaaagggtcagttaataccagtaacatgtctgacaaaatcgataacgatttgctggtcgatgtaaaaactattcttcagcatggcgagatgaatttatttatagaaaacggtaatacccagatgaaagtcaatggtgatatcggggatgtcgttaagctaaaagatctaatgcccgattcacaagatagcgttagctggatacaacaaaatggtaacgtcacccttgctggcattcattacagcgtctataaccacggcgatgctgagctactggtgcaggaaggggtgaaagtcgagctggtgtaa

SEQ ID NO: 12856 - DNA, 1560 bp, Glycine max
  Peptide Sequence Number=SeqID_104541
atgggggtggcgattgccggcatgcactacaccggcatggcggccgcgcagttcagcgcgcccggcagcatgcagcaccacggcatggggcaggaggggctggcggtgtgggtaaccatcatcacgctcaccattctcggtctgacgctgctgatctcgatgctggacgcccagctgcgcgcggcgcgtcttgccgcccggctgcggcgcgccaacagcgagctgcgccagctggcgctgcacgataatctcactgcactgcccaatcgcgtcatgctggaccagcagctcagcacgcaaatcaaacacgcgacgctgtatgaccagccctttgccctgatgtttatggatctcgacggcttcaaagcggtgaacgatacctgggggcatcatgtcggcgatcgtttactggtcgccgtggcggaacggctgcgcacccagctggaagcggacattttgctggcgcgcctcggcggcgatgagtttgtcatgctgtgtccgcagtacgcggcaacccaggctgaagcgctggcgcagcggctggtgcacagcattgatgcaccgtttgagctggatcgttactcgctgcgcgtctcgctcagcatcggcatcgtgatcttcccgcagcatggccgcagcccgcaggagatgatgtttaacgctgactcggccatgtatcacaccaagcacagcgggcgtaacggctggagcctgtttgagccggtgatgagcgcggtggcacagcatcagctggcgctggccaacgatttatggaacgcgctggagtgccaggagatgcgcctgttctaccagccgaagtttcgcgcgggcgggaccattctgatgggttttgaggcgttactgcgctggcagcatccgcgccgcggcttgctgatgccggatatgtttctggcgcgcgccgagaaaaccggccagattgtggcgctcggtaactgggtaatcaacgaagcctgccgtcagctgcggcagtggctggacgagggaaaccgcgactggagcgtctcggttaacctgtccgcactgcagtttcatcagcgcgatctgatcgacacgctgcgccagacgctgcaacgctatcagctgccggaaggcgcgctgatgctggaaatcacggaaaacatcgccatgcgcgatccgcagttcagccagcagcgcatcgccgaactgcagcggcttggcgtcaaagtggccatcgacaacttcggcattggctacgccaatctgctgcacctcaagcatcttgaggccagcgaactgaaaattgatcgcgccttcattaacagcctgcgtgccgacagtgaggatgcaaccgtggtgaccgccatgttgacgctggcgcaaagccttaacctgcgcatggtggcggagggcgtggagaccgaagagcagcagcgcctgctgaccggtcttggctttgacacgctgcaggggtatctgctgggcaaaccgacgccagcggagcgcatcggcgaattcaccgcatcaacgccgattgcgccgcactttcctgataacgtgctgccgctcaccggcgcctga

SEQ ID NO: 12857 - DNA, 510 bp, Glycine max
  Peptide Sequence Number=SeqID_104542
atgattaagccccagccccagcagcgcggcaaagattaccgctacctgctggctgcccgactgccagctgacgtaaaagcctttgcggcctttaggggccacttcagacagataaaccgagacgccacccagttccacgcccgccgagaagccctgcagcaggcggcccagcagaatcagaatcggtgccgccgcgcccagcgtggcgtagcctggcaccagcgcgatagtcagcgtaccgagcgccatcaggccgagcgtcagcagcagccctttacgccggccgtgatggtcaatgtaggcccccagtataatcgccccaagcggacgcatcaggaagccagcgccaaaggtcatcagtgtcagcatcagcgaggcgaacggatcgtcgcccgggaaaaaggtttttgcaatggcggtggcgtagtagccaaacaccataaaatcgtacatctcaagaaagttaccgctggtaacgctaaagatggttttggcaccgccctgcgatga

SEQ ID NO: 12858 - DNA, 1272 bp, Glycine max
  Peptide Sequence Number=SeqID_104543
atgattaagccccagccccagcagcgcggcaaagattaccgctacctgctgactgcccgactgccagctgacgtaaaaacctttacggcctttgggagccacttcagacagataaaccgaaacgccgcccagctccacgcccgccgagaagccctgcagcaggcgacccagcagaatcagaatcggagccgccgcgcccagcgtggcgtagcctggtaccagtgcgatagtcagcgtaccgagcgccatcaggccgagcgtcagcagcagccctttgcgccggccgtgatggtcaatataggcacccagtataatcgccccgagcgggcgcatcaggaagccggcaccaaaggtcatcagcgtcagcatcagcgaagcaaacggatcgtcgcccggaaaaaaggtttttgcaatggcggtggcgtagtagccaaacaccataaaatcgtacatctcaagaaagttaccgctgcctgccggcgcgcgaatagatgtgatcctgttcaccattgcactttacaaaagtacaaacaaagctttgaccccttttcatccattaataccttgcgagtgggcacaccttatccgctgctgagcggcagcctgccggcgcaggccggtgaagtcattgaattcattatcaacgatcaccgctacagcacgccgattgccgccgacggcagctggtcatttcagccgccgttctcgctgagcgaaggcagccatgacatggtggcgcgcatcggcaacagcggtgaaccgcatccgttctctgttgacgtcgcgctctcggtgccggacaaaccggcgatcaccgcgctgtttgacgacgttggcagcgaaaccggcccggtcgggcgcggtcacaccattgatgacaccacacccaaagtgcagggctatgcgctgccgggcagcacggtgcggctgtacgatcacgacaggctgattggcagcaccgtggccagtaaaagcggcgaatggtcgctggagccgctgctgggcgcgggcgggcatcagctaaccgtcaccgccaccgacgagtttggccgcgtcagcgaaccttctgaccactttgacatcactgtggttgacagcggaccggtgccaccgaccatcagctacgccattgacgatgtcggcaccgtacagggccagctcgccagcggttccaccaccgacgacttctcgccgctgatcgtgggccgcgcggagccgaacagcatcgtttatctgtcgcgcagaacgatcacggctggtcatcggctataa

SEQ ID NO: 12859 - DNA, 684 bp, Glycine max
  Peptide Sequence Number=SeqID_104544
atgaatcagggtccgttaaccgaaaaagagctgaactggcttgatgacatgctggaaaaatatggcaacgaacactccgtggtggacaccgccgaactggacggcatgctgaccgccctgctctccggcccgaacgatatcgaaccgagcgaatggctggtggcgatttggggcggtgagaagaagattcctcagtgggcgaacgcgcgcgaaatggaccgcttcatggcgctgaccttccagcactttaacgacatcgccgagcggctggcggagtacccggagcagttcgatccgctgttcggcgagcaggagatggaaggccagctgtttaccgtggtggaagactggtgctacggctacatgcgcggcgtggcgctcgatgcggactgggcgcagctgccggcggcacagcaaccggcgctgcaggcgattgcgctgcacggcagtgaagcgcagctggcgcagcgtgaagccttcaccccggacgcgtttgaggccagcatcgaggcgattcgtccggcggcgctggaactgcacgaatactggcaggaacagcgcatggcgcagcccgatccggccccgcagctgccgcattttgccggtgaaaaaaccggccgcaacgatccctgcccgtgcggcagcggcaaaaagtttaagcagtgctgcctgaataaagcctga

SEQ ID NO: 12860 - DNA, 1006 bp, Glycine max
  Peptide Sequence Number=SeqID_104545
cgtgagcacgccgttgtgggccgacgaaggcgtctcgtttagccataaagactgggagctggcttgtgataatacgctgacctgccgcgccgctggctacagcgccgaagagggcgcgggcggatcggtactgctgacgcgcgccggcgggccagacagcctgacgcacgggcgcgtggtgctggccgataccggcgacgatgatgcgcagcaggtgaatgcgctggcgctgtggattgacgatcgcgcgctgggcgaagtcagcaaagcggagaacgatgagtggacgctaagcgacgcgcagacccaggcgctgatcgccgccatcaaaggcagcgccagagtggagtttcgcggtgcggccgagccgtttgagctctccggcaacggggcctttgccacgctgttaaaaatggatgaggcgcagggacggctgaacacgccgggcgcgctggtgcgcaagggcaaccagccggaagccagcgtgccggcggcagtggcgatgccggtgattcagcaggtccatgtgctgaaagccgcgccgcgcccgctgacgccagatgaactggcacaggtcaagccaaagctgattgcctcgctgactgacgacgacagctgtgacaatctcgcgccgtccgacgatcagccagaagagggcgcagaaccgcctacgctgacgccggtagatgcgcagcaggtgctgatcgccgcgctgtgctggcgcggggcttacaacgaaggctatggtttctggctgctggataacgcgctgcagggcacgccgcagctgatcaccgattccggatctgattatcacgacggcgtgatcagcgaagcgcagaaagggcgcggcattggtgactgctggagcaccgctgcatgggtgtgggatggccgccagttcgtgcagagcagcgaggccaccaccggcatgtgccgtgccatccgcgccggcggcgcatggcagctgccaacgctggtcaccgaagtcaaaccggcggggtaa

SEQ ID NO: 12861 - DNA, 1266 bp, Glycine max
  Peptide Sequence Number=SeqID_104546
atggacgccggtgattcgaggaacaccacgcggttcgccgatttcactgccgatgcagtgatcgaaccaggtggtggtgacgttaagcttcgcgagaattttggtgcagaaatcctgagtgggttcgtacaccgcgccgctgaccagaatatgatcgccgctggtgacaaacgcgaggatggcattggcgactgcggccgcaccgcacggatagagcacgcagccggcgccgccttccagttcggtcatcgcatcctggaaggaaaaatgggtgagggtgccgcgccggccataaaacagttcaccgctggcgcgtccggcggtggcgcgttgtttgtccgcgacggagtcaaaaaccaagtgacgccagcacaatcgcggaaagaggctggttgtggcttttattacgtggcggaaaagcaaagcgcaataaattgcgccgctacgacccgtgcgggatgttcgtccgcgccagttgctccagtccgcaaaccgcacccaaccgtagcggcaagtcggagacgcagcgtggtagccagtgacttgatgcaaacggacctctccgtttggggcatgtatcagcatgccgatatcgtggtaaaaattgtgatgatcggcctgttgctggcctcggtcgtcacctgggcgattttctttggcaaatatgcggagctgagcggggcgaaacgtcgcctgaagcgcgaacagctggcgctgggcgaagcgcgttcactgaatgacgcgtatcgcgctgccgaaaacttcaaagccaacagccacagtgccgtgctgctcgccgacacgcgtaacgaactggaactctccgccggcagcgaagacctcgacggcatcaaagagcgcaccagcttccgccttgagcgtcgcgtcgcgggcttcagccgccatgccggtcgcggtaacggcttcctcgccaccatcggttccgtcgcgccgtttatcggtctgttcggcaccgtgtggggcatcatgaacagctttatcggtatcgcgaaaacccagaccaccaacctcgcggtggtggcaccgggcatcgcggaagcgctgctggcgacggcgattggcctggtggcggcaatcccggcggtggtgatctacaacgtcttcgcccgcatgattgccagctacaaagcttcgctcggcgacgtggcggcgcaggtgctgctgctgcagagccgcgatctggaccttggcaacgtcgataccgcaaaagaagttaaccgtccggcggcggcccagaaactgcgc

SEQ ID NO: 12862 - DNA, 828 bp, Glycine max
  Peptide Sequence Number=SeqID_104547
atggcagagcaaccccggattaaactgcacgacggcaacatgatgccgcaactcggccttggcgtctggcaggccagcattgatgaagcgcgcaacgccgtgctggaagcgctgaaggtcggctatcgttccatcgataccgccgccgcgtataaaaatgaagaggcgattggccaggcgctgcaggaaaccgacgtggcgcgcgatgagatctttatcaccaccaaactgtggaatgatgaccagcagaacgttgagcaggcgatggaaaccagcctgaagaagctgcagctggagcaggtggacctgtatctgatgcactggccgtgcccgcagaaagatcactacgtcgatgcgtggaagaaaatggtggaactgcaacagcagggcctggcgaaaagcatcggcgtgtgtaacttccatgaagcgcacctcaagcggctgattgatgaaaccggcgtgtcgccggtggtgaatcagattgaactacatccgatgctgcagcagcgcacgctgcatgcgtggaatgcgctgcatcagattcagaccgagtcgtggagcccactggcgcagggcggtgaaggcgtgtttgatcaggagatcattcgcgagctggcgaagaagtacagtaagacgccggcacagattgtaattcgctggcatctggacagcggcctggtggtgattccgaagtcggtgacgccggcacgcattcaggagaacttccaggtgtttgatttccggctggataagtcagaagtgagcgagatcgcgaagctggataaaggcaagcgactgggaccggatccggaagagtttaatgggtga

SEQ ID NO: 12863 - DNA, 2934 bp, Glycine max
  Peptide Sequence Number=SeqID_104548
atgacacaggatggcgcagagcgtcttgccctgcacaagtttactgaaaacgcgtacctgaactactccatgtacgtgatcatggaccgtgcgctgccgtacatcggtgacggtctcaagccggtgcagcgccgcattgtttatgccatgtccgagctggggcttaacgccagcgcaaaattcaagaaatcggcgcgtaccgtgggtgacgtgctgggtaaataccatccgcacggcgacagcgcctgctacgaagccatggtgctgatggcgcagccgttctcctaccgttatccgctggtggatggtcagggcaactggggtgcgccggacgatccaaaatcctttgcggcgatgcgttataccgaatcgcgcctgtcgaaatatgccgaagtgctgctcagcgagctggggcagggcacggtggattacatcccgaacttcgacggcacgctgcaggagccgaaaatgctgccggcgcgcctgccgaacatcctgctcaacggcaccaccggcatcgccgtgggtatggcgaccgacattccgccgcacaacctgcgcgaagtggccgaagccgccgtgcgcctgatcgacaagcccaacaccacgctggatgagctgctggagatcgtgcaggggccggacttcccgaccgaagctgagatcatcacgccgcgcgacgagatccgcaagatctaccagaacggccgtggttcaatccgccagcgtgcggtgtggaaaaaagaggatggcgaggtggtgatcaccgcgctgccgcatcaggtgtcgggtgcgcgcgtgctggagcagatcgccagccagatgcgcaataaaaagctgccgatggtggaggatctgcgcgatgaatcggatcacgaaaacccgacgcggctggtgattgtgccgcgctccaatcgggtggatctcgatcaggtaatgaaccacctgtttgccactaccgatctggagaagagctaccgcgttaacctcaacatgatcgggctggataaccgtccggcggtgaaaaacctgctggagatcctttcggaatggctggtgtaccgccgcgataccgtgacgcgccgtctcaatcatcgtctggaacgcgtgctgcgtcgtctgcatatcctcgaaggtttgctggtggcgttcctcaacattgatgaggtgattcacatcatccgcagcgaggatgagccgaagccggtgctgatgtcgcgctttgacatcagcgaaacccaggccgaagcgattctggaactgaaactgcgccatctcgccaaactggaagagatgaagattcgaggtgaacaggccgagctggaaaaagagcgcgatcagctgcaggcgatcctcgcctccgatcgcaaaatgagtaacctgctgaagaaagaactgctggccgatagccagacctacggcgacgatcgccgctcgccgctgcatgaacgtgaagaagcgaaagcgctgagcgagaacgagctggtgagcgctgagccggtcaccattgtgctgtcgcagatgggctgggtgcgcagcgccaaaggtcacgatatcgatccggcaggattaagttacaaagccggcgacagctaccgtgccgccgcgcgcggcaagagcaaccagccggtggcgtttattgactccaccggccgcagctatacgctggatccgacctcgctgccgtcggcacgcgggcagggcgagccgctcaccggcaagctgacgccaccgccgggtgcggtgattgagcaggtgctgatggaagcggacgatcagaagctgctgatggcctccgatgccggctacggtttcatctgtacctttgccgatctggtgtcgcgcaaccgcgctggtaaagcgctgctgacgctgccggaaaacgccaaagtgatgacgccgctggcggtgcactctggcgacgacatgctgctggccatcacccaggcggggcggatgctgatgttcccggtggccgatctgccgcagatgtcgaaaggcaagggcaacaagattatctcgattccgtccgcggatgccgccgcgggcgtggacaagctgcagtggctgctgattctgccgccgggcagttccattactatctatgtcggcaagcgtaagctgatcatgcgtgatgaagatctgcagaaagtgcgtgctgagcgcggccgtcgcggtagcgtatcgcgcggactgcaacggatcgatagcgtggaagtgaatgcgccagcgcggccaaaaagtgacgcgaatagcgaagacatctggtgtctgttttcaccgcgtaatccgcgccacgtggcgacctttggtcacatgtttggtcgtctgtcgacggtgtttggcgtcaaagtcgaactgcgtaaaccggcggatgccgaaagctacggtaacgcgatttacatcgctaaccatcagaacaactacgacatgattaccgctgccaatatcgtgcagccgaccacggtcacggtgggcaagaaaagcctgctgtggatcccgttcttcggccagctctactggctgaccggtaacctgctgatcgaccgcgataaccgcgccaaagcgcacggcaccatcggcgagctggtggcgcaatttaaaaagaagaaaatttccttctggatgttcccggaagggacgcgcagccgcggacgcggtctgctgccgttcaagaccggcgcgttccatgcggcggtggcggcgggcgtgccgatcatcccggtggtggtctctaacacccacggcaaaatcaaactgaatcgctggaacaatggcttagtgatcgtggaaatgctgccgccagtggataccacgcagtttgaaaccacgtcggtacgtaagctggcgacccactgccgtgaattaatgtctgctaagctggaagagttgaacgctgaagtcgccgaacgcgaaaaaaacggtaaaatctag

SEQ ID NO: 12864 - DNA, 768 bp, Glycine max
  Peptide Sequence Number=SeqID_104549
tggagctatgagctgccagaactgggcgagggcaaccataaagttgaagtacagccggtgagccagtccggtgtgaaaggcgacaaagaagccgccatcaactttgacgtggataccaccaagccggagccagtagaaggtggccctaaggctaacttcgaaggcgtgtttgcggataaaaccggcattgaaatcccggtgcgtccggacaccaacgatgacaccctgattttcaaaggtaaggggtcagaaaacggttctatcgtgatgatttgggccgacgaagcgcgtgagaatctgatcggctctaccgtggtgcaaaacggcgtgtggcgctatgagtctgacaaactggcagaaggcgattatgcctttaacgtcacgatacgcgatgcggccggtaacgagctggtcattgaccataccgttaagaccaacgtcgacgttaccccgccgccgccgccagaaatcaactcgatcttcgctgcgggtgccactgatgtagaaggactgatgagcatgtcgctcaacgacatcatggcgcagggccaggactctctgttcatcgacaacggcaagtcacagctggtggtgaatgctaaacagggcgaggcgctgacgctggaagacatcctgccagccggtgaagatgccagctcctggcagcaggcgaccggtaccgtcaccgtcggtggcaacgagtacaacgtctacagcaacggtgatgcggaactgctggtgcagaacctgcacaacgaacagcactga

SEQ ID NO: 12865 - DNA, 330 bp, Glycine max
  Peptide Sequence Number=SeqID_104550
atgacagagcaacgcgaacagcgtatctatgaactggtgcggcgctatgacggcgtgtatctgttcaagcagaaaacgctcacgccgcagattgatatcgacagcgatctcaacttcgagcgcgacgaagccgccgcgctgatggaggaatttttcagcgagttcgcggtcgatcgcgcgaatttcgctattgaaacctactacccggacgaaccgtcgctggcgcaaatcctcaacccgttcaacaaacgtgaagtgccggtggtaccggatttcacgctgggcatgctgattgcttcggcgcaggcggggcgctggctgtttgaataa

SEQ ID NO: 12866 - DNA, 234 bp, Glycine max
  Peptide Sequence Number=SeqID_104551
atgccgaaggcaataagtgacttttacgtgccgtgttgggcacataaggagaggcggtgcgaagcgacatcagcaacctgtttattcgctgcaacgtcatctcgacgtgttgcatcatggagcaccacacgaagcgcgagccacattgacaagggttatgggaaaaggattagagacgctggcggcgtcttccggcttcaaaggaaaagcgcaacggatagaccagtgacataa

SEQ ID NO: 12867 - DNA, 735 bp, Glycine max
  Peptide Sequence Number=SeqID_104552
atgtctgagcgaacagggccattacgcgtgaaaacagatttaccagcgcttccggcagcagattcttgccggacagctccggccgggcgaccgcgtaccggcgatccgcgtgctggcgggcgagctgcagggcgcgaagggcacgcgcgtcaatccgcagctgaagctggcgagcgcaactacgccaccgcgcgcaccggcgacgacgcccgcgctgctgccggtgaccgagggcaaaggcgagctgcggctcggcatcccggcgctggacgagtttccgcacaaaaagtggcggctgatgtcagcgaaagcggcgcgcagcctgcggccggacgagatgatgataccgccggtgatgggatatgcgccgctgcgggcggctatcgccagctacctgaacatttcgcgcggcctcaactgccagccggagcagatcttcatcaccagcggttaccgcgccaacctgcggctgattctggcggtgctggcgcagccgggcgacaaagtgctgttcgaagatcccggctacttcttcggccagcagctgctgaagcgcatcgcacccaacctgcactatgtgccggtggatgggcagggcgtcgacgtggattatctgctgcgctatcacgccgacgcgcgctttgcggtggtgacgccaacgcaccagagcccgctggcggtcagcctgtcgctgccgcgcaaacatcagctgctggcgtgggcgcagcagcatga

SEQ ID NO: 12868 - DNA, 547 bp, Glycine max
  Peptide Sequence Number=SeqID_104553
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctcaatcaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12869 - DNA, 426 bp, Glycine max
  Peptide Sequence Number=SeqID_104554
aacaacagcttgccagaattggccccatgtatggtgttgcttgtcaatgttatgattcaacaagcgattgctcctcaaaatttcagccagcccgtatcaattagaccttgcacctttatgccggggtcatacaatgctcaatggaatgccccagggctcccccatgataagcacatgttgcgtttgagtcatatcctcagaaaaatggaggttgaggaaccttggttggggctttttgctgcaaaattcctttttgttggtgtttttttggtttgtgctaaaggtggtcttcgtcattggaataatgacattgttgggtttggtgggaaacttggccgtataggaatgacagtcacaacatgggtttctccctctttctcaccctcttcatttgccccagttttctcagtcgtcctagtaggatga

SEQ ID NO: 12870 - DNA, 303 bp, Glycine max
  Peptide Sequence Number=SeqID_104555
atggttagcgtagctgagatcaggcaggcacaaagggcagaaggcccagcaaccatccttgccattggaactgcaaacccaccaaaccgtgttgatcagagcacctatcctgattactacttcagaatcaccaacagggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagccccgacgctgcgccttatccg

SEQ ID NO: 12871 - DNA, 402 bp, Glycine max
  Peptide Sequence Number=SeqID_104556
atggtaggttacataccttcacgctttgtcgatttagctttcgctggcgaaaggatcgaagtgggtttaagaagaggaaaatttgattatcctgctttaatgaataggaagcctagggcaaatggagagaatgagaagaagggaggaacccatgttgtgactatcgttcatacatggccaaatttcccaccaactcaacaatatcaatactcaactaatattagcctttctcattatccaccaccctatcaaccaagaacactcaatcatccacaaaggccacccttaaatcatccaataccaaacaccacccttaacacaaaccaaaacaccaaccaaggaaggaattttccaacaaagaagcctgtagaattcacccccaatttgggtgtcgtatactaa

SEQ ID NO: 12872 - DNA, 862 bp, Glycine max
  Peptide Sequence Number=SeqID_104557
atgcgttataccgaagtccgtatgacaaagttagcgcacgaacttcttgcagatctagaaaaagacactgttgactgggaagataactacgacggatctgagcgtattcctcaggtggttccgacacgtgttccaaacttgctaattaatggtgctgccggtattgctgttggtatggcaacaaacatggcaccacacaacatgacagaagttgtgaatgcatgtttagcctatgccgacaatccgaatatctcgattgaaggattgatggaatatattagtggtcctgatttccctacaggcggtattatttacggtaaatcaggtattgttgatgcttaccgtacaggtaaaggccgactacacattcgtggtaagtaccatttcgaagaagatgaaaagacaggtcgtataactatcgtctttactgaaattccatatcaagttaacaaagcaagagttattgagcgtattgccgagttagttaaagagaaaaaacttgaaggtatttcagagcttcgtgatgagtctgataaagacggtatgcgtattgcgattgacttgaaacgcggtgaaaatgcagaagtcattgtaaataacttattcttaaatacacagcttgaaaactcattcagcatcaacatggtttgtcttgacaatggacaaccaaaattgatgaatctgaaagatattattgcggcatttattcgtcaccgccaagaagtagtgacacgccgtaccatgttcgaattgcgtaaagcacgtgaacgtggtcatatcttggaaggcttaaccgttgccttagccaatattgatgaaattatcgaaaccattaaaacttctgctaacccagctgaagcgc

SEQ ID NO: 12873 - DNA, 93 bp, Glycine max
  Peptide Sequence Number=SeqID_104558
ccaaaggaaaaactagaggaatatcagggaatcactagagatgccgctatcactatcgaaagacacgtgagcccgcttagaggtaagggataa

SEQ ID NO: 12874 - DNA, 492 bp, Glycine max
  Peptide Sequence Number=SeqID_104559
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccaccaaagaatctagcagagaatcaatatcaaggtcgcacgttaagcacgagatcagtgcgctaa

SEQ ID NO: 12875 - DNA, 495 bp, Glycine max
  Peptide Sequence Number=SeqID_104560
atgagcattcacgtggctcagttaatcgctgatgccatctatctatttgcagtccccgtcgcacctagcaaggtgattcggccgcccatcacccgagctttcattgagaagtattgcacacagagacaggcccagggggatgctccgcaggccgcagacgcgtcgccacctcatcaggctagcctagctggatcgtttgatacggagcagtatttgcggcatttggttcgccagcaggcggccaaccaccgggcgtatgtacagacccatgattgtctttaccagttgaccctcatcctgcagagccagggttttacttctttttcgtgccctactccggaccagttcagggcagaggtcgcatggcctggagattggcctgaggcccaggtaggagaggcgccagcagaggctcccgacgaggcagatgaggcccgcaaggacgaggagatgaccgatttacttgatttcttaggagggagcggggccacatga

SEQ ID NO: 12876 - DNA, 348 bp, Glycine max
  Peptide Sequence Number=SeqID_104561
atgaggtttcactgtcatcaagcaagtcagagacttagcatgatcacagattcacgtccacttcctatgttcccacggacccagtccccaacagagtcaccaattgtcgcaacctacccttcggtgggagggcgacacgaggctcacgagtgcatcttccaagggaggagaacgtgcggagtcgccaccaacatttatttgagggaaacgttagaaaaaccaaaaatgggtctacgaacattaagaataaaaggttcaggagttgtttttatgcacggggaaggtattagcaccccacgcatttgtcacaagggacggcaacctttaatcaaatgtgcaaaatcatga

SEQ ID NO: 12877 - DNA, 342 bp, Glycine max
  Peptide Sequence Number=SeqID_104562
atgatcaggacagtaacctatgaaaataggcgtatcacgaggccctttcgtctcgcgcgtttcggtgatgacggtgaaacctctgacacatgcagctcccggagacggtcacagcttgtctgtaaacggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 12878 - DNA, 240 bp, Glycine max
  Peptide Sequence Number=SeqID_104563
atggtgctcaacatagttctctatacaggcaatgatgtgtgcaacatgcttagcaaccatgtcagcttcagtgcaactcctttacgtgcatactcgggagggacttaccctagtaactcatcgcataactcatcccaatgtaagaagctaggtccatccacaacacgaccatcgactctaatgcctagatgcagtgcaacatcttcgagtgtgatggtgcactctccccatggtaggtga

SEQ ID NO: 12879 - DNA, 162 bp, Glycine max
  Peptide Sequence Number=SeqID_104564
atgatgcaaggtaatatatggatatctccgaacacccttggtttggtgcaaggcatgacacttctcaagtttcagataagaccatctcttgaaaaatccatatttgcacctaaagattattcgagttcacagttcagaggccttaaggatttgagtgcctga

SEQ ID NO: 12880 - DNA, 828 bp, Glycine max
  Peptide Sequence Number=SeqID_104565
atgacgctcacggtgaacagcggcaaaacccagttcattattcagaaccacagccaaaaagcgctggagtgggagatcctgaaaggggttctggtggtggaagagcgcgaaaacatcgcccctggcttcagccagaagatgaccgctaacctgcagccgggcgaatatgagatgacctgcggcctgctgaccaacccgaaaggaaagctcatcgtcaaaggtgccgcaacggccgatgcagcgaaaggcgctgcggtgctgagcctgggtgaggccattaccgcgtataaagcgtatgtcacaaaagagacggcggacctggcggcagcaaccaaagcctttaccgatgcggtaaaagccggtgacatcgaaaaagcgaaatccctctatgcgccgacccgtcagcactacgagcgtatcgaaccgattgccgagctgttctccgatctggatggcagcattgatgcccgcgaagatgatttcgagcagaaagccgccgatccaaaattcaccggtttccaccgtctggagaaagccctgttcggcgataacaccaccaaagggatggagaagtatgccgaccagttgaacagcgacgtgctggagctgcaaaagcgcatcagcgagctggccttcccgccgtcaaaagtggtgggtggcgcggccggtctgattgaagaagtggccgcgagcaaaatcagcggtgaagaggatcgctacagccataccgatctgtgggacttccaggctaacgtcgacggcgcgcagaaaattgttaacctgctgcgtcctcagctgcagaaagagaacggcgaactgctggcgaaa

SEQ ID NO: 12881 - DNA, 492 bp, Glycine max
  Peptide Sequence Number=SeqID_104566
atgacggttcgacagcagatcatgcatgccgcgcggctgctgcgcggccagcagcaggaagatcagcaatgccgtactgctggcgacggagcgcaacagcaggtcgtgcctgcgccgcccacgctccggccacaacgacaggccggcgaacagcaacggcagccacgccgagatggcatggaagcgcagcggtgtcagcgcgctgacatggccgctgcgcaggtagccgccgacatcctggtgcagcatcgcgaacatgactgccaccaccaacagcaggcagagcgcacgcacctggtggtagagaagggccaggccggcaccgaggcaggccagcagccagggcagaacgcgttgggccggactggccacgtcttcgttgcccaacgccgcccacagcaccacggcaaccagcacggcgggcagcacgaacaggtagtgcgcaggctggcggagcggatgcaggggcaatcaggaattccagcgcggtga

SEQ ID NO: 12882 - DNA, 518 bp, Glycine max
  Peptide Sequence Number=SeqID_104567
atggttatgggggatcccatcagcagactctccttccctgaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgcggggataccttacggttatccgcccccctttgccattcagacacagtcgtgttcgatggcaagcagagaccaaagaccaagtttggtcattctgcacacatgatacgcggagataccttacggttatccgcccccctttgccattcagacacagtcgtgttcgatggcaagcagagaccaaagaccaagtttggtcattctgcacacatgatacgcggagataccttacggttatccgcccccctttgccattcagacacagtcgtgttcgatgggcaagcagagaccaagtttggtcattctgcacacatgatacgcggagataccttacg

SEQ ID NO: 12883 - DNA, 207 bp, Glycine max
  Peptide Sequence Number=SeqID_104568
atgtcttacgcgctttggctttttgttgatgccgaagggggagagaaaatagggattaaatcaagaactcatggggagattgtagaagcaagcttcatagtgatgaatcaagttgattcaagtagttttgatgataacaaagatgatgacaaaaagctcaagagaatgatttcaagattgagtcaacaagttgaagatcaagattaa

SEQ ID NO: 12884 - DNA, 231 bp, Glycine max
  Peptide Sequence Number=SeqID_104569
atggcagtggaatggagaaggaagagagagaagagacgccacttcaaggagaagatgagtctagaagaagctcatcaccataggaggccatggataagagcttggaggaagaaagagatgaatgaaaggagaggaagagaagagcacgaaattttgtgttctaaaagagctctgaaatctgaacccactaatccaagatcaattccaagattcttcactaagtgtgcttag

SEQ ID NO: 12885 - DNA, 252 bp, Glycine max
  Peptide Sequence Number=SeqID_104570
atgataacaaaagattatgacaaaggtgatgacaaaaagatcaaaggtcaatcaaagaatgagttcaagatattcaagatagaatcaagagatcaagatttcaagaatcaagattcaagagatcaagattcaagaataaagagaaggcttaatcaagataagtatgaaaaggaatggtgggggcaagatacgcgggttaggctaattaaggaagagaaatccataactgggaggttatgggttaattcttaa

SEQ ID NO: 12886 - DNA, 153 bp, Glycine max
  Peptide Sequence Number=SeqID_104571
atggataccttagagccctacactggggcaatgaggggcatcgtgcatgaacctcaagtcatgacaaagacaacgattggtacctcaaagccttacagtggggcaatgaggggcactgtgcatgagcctcaagtaaacctaggggcagattag

SEQ ID NO: 12887 - DNA, 267 bp, Glycine max
  Peptide Sequence Number=SeqID_104572
atggcgtcgtgtgatcaacgtaaccaaccttacctagtggaacaaggcagcaaagaatatgcaatttgtcaattgctaaaccctccccgctcagcattgtctctttttagagtagaagattttagtgctggccaaaacgggttatttgtcaaaaacaagcatgtccaaacggccattacttgtttcttagtggttggtgatgaggatagcaaggaaaatcttaggaagatcctccaaaagaaaacttggattcatgttaaaggttag

SEQ ID NO: 12888 - DNA, 297 bp, Glycine max
  Peptide Sequence Number=SeqID_104573
atgggtgaacaattggggctgctaaaagtcattgttgtgcaagggaaaaggttggtgatccgggatttcaagaccagtgatccttatgttgtatgtgctcaagctagggaatcagcatattttaaccttgaaatgttattaaattgtaccaaaccgcaaagaccaagtgaaaataaaccagttctagattggcctactagagtcaaggttgttactggtgcagctcgtggaatggcttacttgggtaagacctattcggtattactatgccatgctgatagtttcaaattcccttag

SEQ ID NO: 12889 - DNA, 345 bp, Glycine max
  Peptide Sequence Number=SeqID_104574
atgagggttcactgttatcaagcaagccggagacccagcatgaccacagattcaccttcactccttatgttcccatggacccggtccccagtggagtcgccaactgtcgcaacctaccctttggcgggagggcaacgcgagactcatgggtgcgtcttccatgagaggaaaatgcgcggagttgccaccaacgtttatttgaggaaaacgtcagaaaaaccagaaaggtgtggtctacgacctttaatcgtgaaaggttcgggagttatttttatgcacggggaagggtgtttccctcgctcctacgtatcctcaatttgtgatgaggaaatcagacctacatag

SEQ ID NO: 12890 - DNA, 760 bp, Glycine max
  Peptide Sequence Number=SeqID_104575
agggctacacgccctcaccttcaaagggctgcacgccctcgccttcagagggcaacacgccctcaccttcaaagggctgcacatcctcgcctttagaggactacacgtcctcaccttcaaagggctacatgccctgaccatcagaggattgcacgtcctcgccatcagaagactacatgtccttgccttcagaggactacacgtcctcacctttagagggctacactcccttgccttcagaggactagacgtcctcaccttcatagggctacacgccctcaccttcataggtctacacaaccttaccttcatagggctacacgccgtcaccttcagaggactacacgtcctcgcctttagagggctacacgccctcgccttcaatggactacacgtcctccccttcataaagctacacgccctcacattcaaaggactacacatcctcaccttcagagggctacatgctctcgccatcagaggactacacgtcctccccttcagaggactagacgtcctcaccatcagaggactacacgtcctcgccttcatagggctacacaacctcaccatcataggactacacaacctcaccttcattgggctacacgccctcaccttcagaggactacatgtcatcgccttcagagggctacacgccatcgccttcagaggactacacgtcctcaccttcataaagctacacaccctcaccttcagagcgctacaccttgaaggaagaaaaagggagagaagttga

SEQ ID NO: 12891 - DNA, 274 bp, Glycine max
  Peptide Sequence Number=SeqID_104576
atggacgaagatcaatgggcatattacagtgcgatgttcgaagaagttgatatggattttcaagatgaacaagattgtggtgtgaatgaaggacatgttgattgttcagatgcttttaatacttctcaggtctttgcaacccgagaagatgttttgaagtgggctcgaacggttgcccatgaaaacagttttgttgcagtatttatgaggtctgatacatatactggtagcagaggaagaacttcctttgtgttaattgggtgtgaaaggagcg

SEQ ID NO: 12892 - DNA, 330 bp, Glycine max
  Peptide Sequence Number=SeqID_104577
atgcctgatcttccattccaagttggggatttggctgagtcaaaatgctttcaaggtggttatcgcggtgcatggtttagatgcaagaagctgcggaattgccattttctaacaatatactataatatggttatggcatcgtgtaattctcatggctgctgcagtgatagcaagaggtatggtggggaaagcagtacttattctttctttttgacacaacagattctgattgttcagacttcgatgactattcccttgcattcaatgttctttaaacatggttactacaagtgttctcacatcttttgcaaactcaaacccatgacttga

SEQ ID NO: 12893 - DNA, 119 bp, Glycine max
  Peptide Sequence Number=SeqID_104578
ctctagcttctcatctcaaggaggtgagcttagctattagagagcttctcaaggaagttttctcaaagaagcttctcaaggaagttttctcaagaaagcttcttaaggaagcatcctag

SEQ ID NO: 12894 - DNA, 351 bp, Glycine max
  Peptide Sequence Number=SeqID_104579
atgggaacaaagggttgtattaattataatcccatgctagccataagacaactagtctaccctatgagaggtgcaccgtcagaagagatcattgcacttttcatcgcacggggtttcaatgaaggcaatgcaaaaatacttcagagaatccataaagcgtgggacacagtggaaaggaaagataaggagcttaggggaagcagcaatggtgtcatcgacaactatcataagtgtttgaaggcaaggacacaagggataacttggctcccaaagctaaaaggtccaagtgggaaagaagctgaagtccccgaggaaagtgaaaaagtgcaagccttgaaagcagagctttaa

SEQ ID NO: 12895 - DNA, 549 bp, Glycine max
  Peptide Sequence Number=SeqID_104580
atgcgaccagagaagaaaccatggttgtcactcctctgtaacgaaatcatcgaggaaatcttgtctcgtcttcccgtgaaacctttgatccaattcatgtgtgtgtgcaaggaatggaactccttgatgtcagaaccctatttcatcaaactgcacctttgcaaatcagctgcgaaggaagatttggaacaccttcaattgataaaaaatgtatgcctcggatccatcccaaaaatccacatggaatcgtgtgatgtaagttcattattccattccctacaaattgaaatgttcttgatcaatttcgcaaacatgccaggttaccatctggtcagttcatgtaatgggttaaactgtggggttagcaaaataccagaaggataccgtgtttgtttctggaacaaggcgacaagggtgatatatagagaatcgccaatgctgtctttttcccagggcatcggtcgtagaacaatgtttgggtttggctatgatccgtcaagtgacaaatacaaggttgtagcaattgcgttgactatgctctcacttgaa

SEQ ID NO: 12896 - DNA, 402 bp, Glycine max
  Peptide Sequence Number=SeqID_104581
atgtgggcatgggaacaatgtccaaccttggctccaaagaggactccttcccaagtagaaaataaaccactggggcacaggtggctacgacgtggaaaccaacatatcggcaatgatgatgtgagagtttttcgtcgcaagttggatattatgaaacgtcatgagtttgtgtgggagccttacacagcaaccgttatatcattgttgcctcccatttgtgtactcagaagtgtcgcgtggtacgcggtggtgccactaatttgtttccaagttattgagtggcaccaaccggacaaagtattgagacaatttgggatgcagcaaccaattccagagtctccttctggaacaatcgccatgcttttagggtcgacgcttatccccgacaagaaggcctattga

SEQ ID NO: 12897 - DNA, 359 bp, Glycine max
  Peptide Sequence Number=SeqID_104582
ctctagcttctcatctcaaggaggtgagcttagctattagagaggtatgtgtagctaaggctagtatgcaagatgataaggggaaggcaatagaaaagcaagcccctaaggctagtatgcaagagaaaactagctctataaagtgctttaaatgtcttggaagaggacacattacttctcaatgccccaccacaaaaaccatgattatgaggggccaagacatttatagtagccaagatgaggctactacttcaccttcctctagtgaaagtgaagaagcaaaaggggaagaatctagtgaagaaatctacccccaagaagatggacaaccattagtggttaaagagaagtgtaaggag

SEQ ID NO: 12898 - DNA, 369 bp, Glycine max
  Peptide Sequence Number=SeqID_104583
atggaagaaaagaaagagagaaggggggagcatagtattgaaggaataaaagagggagagaagtggagctttgaagtgtgtctcataagactttcattcatcaaagttacaacaagtgttacacatgcttctatttatagactagcccatgggctcgaaatctaccctaaggctcatgagaaccctagggccttcccttggatctctggcccaatctacttggagtcttctatccaatgcccttgcggggtaggattgcatcagaagggtcgacaagggggctgcccttgcccttacatatcctcaggtgcgatgaggaatttagaactacgtagttctttaagtctgaatgtttgtgtgttaaattga

SEQ ID NO: 12899 - DNA, 198 bp, Glycine max
  Peptide Sequence Number=SeqID_104584
atgggggtgcaaatagcaaccaggcccacttgggccctccagaaggctgttgcttctggaggaagcaaccctgctcgcctggccgaggcgcttccgaaacgtttccgtaacgtttccgtaaggaatttcgcaaaggtttcgatcgttcttcgacgttcttcattcgttcttcatcgttcttcgatcttcaacgggtaa

SEQ ID NO: 12900 - DNA, 696 bp, Glycine max
  Peptide Sequence Number=SeqID_104585
atgaccttttcaatgattggcatccggtcgaaattcgatttttctgtgcatgatgcccgccggttggttttcaacaaccaagcggatatgaccgaaaggcttcttgccggatcattggcttttgaaagccacatcctccattaccttattgttcgcatcttactccctagatcttcaaaccttgctcaggtttctaaagaagatctcattgtcatgtggacctttcataaaggtttacaaattgattgggcacaccttgatagatatcgcatgcataaggcattgcgattgaatgcccctttgccttatcctcatcttattacccttttccttcaacacttcaacatccctcttgattctgaaccctatgttccaatcaagagatcattccttataggcgcttcagtcatagcatcctttggttatattaaggagcatgatggctcttgggtaaagaagggtactataaatgttggtgaagaaggacatgagggagaagattcatctcttcttttgaagattttggaaaggtttgatggtcttcaaacctttgttggtgagaggtttgatactttggaattgcaagtggatatgcgcttcaatgaaatggagtcaagaatgacaaaggttgaagaagatgtatcttacattcggtcaagcttcgatcttccaccaccgccgccaccatcatcttag

SEQ ID NO: 12901 - DNA, 565 bp, Glycine max
  Peptide Sequence Number=SeqID_104586
gggactacatgtcctcacctttaaagggctccatgcccttgccttcagagggctaaacgtcctcgccttcagacgaggactacacgtcctcgccttcaggggactacacgtcctcgccttccaaggactacacgtcctcgcctttagagggctgcacgccctcgccttcagtgggctgcacgctctcgccttcagagggctgcacaccctcgcctttagagggctacgcgtcctcactttcagtgggctccacatccgcaccttaagagaatgggccagtaattttctcttatcaattcctaggctactccctgatcttggaggagggccaactgtgcgagcacaaccagtggaggagactttcacgcagctactatgcataccggggcaagatttcacctctgccactgcaaagagacgagtgcggatcatgcgcaccaacatgaccactcttacacagatatggatgaaggatcgcgccaacaaggcacccagtggactcagaggtgtccaacagggcccgggggtttccagctttggttacaagcctctgtcattcctatag

SEQ ID NO: 12902 - DNA, 217 bp, Glycine max
  Peptide Sequence Number=SeqID_104587
atggaacttcaacgtctcaaccaaaatgaagagaccaacaaaaggaaaagaagcatgacactcaaagcctcctcctcaatacaagaagaagaagaagaagaagaatctgatgatgaagaggacttctcactctttgtgaagaagtttcataaattcgtcaaaaatagaagaacggagagacgccataacttcaacaatgggaagagatctcaagaag

SEQ ID NO: 12903 - DNA, 372 bp, Glycine max
  Peptide Sequence Number=SeqID_104588
atgaagtacttgttggagaaggctgaatcaaagcctagactgatcaggtggatgctttggctccaagagttagatttggagatccgtgatcggagtgtgaccaagttattaggagatgcattccagaccatgagattgactcagtcctattattctatcattcttccgcaccaggtggccatcttggcatacaaaggacagctcgcaaggtgcttgactgcgatttctattggcccaccatcttcaaggatgcgtggagaatatgttgcacttgtgagccttgtcagagagcaggcgactcactttcatggagacagcaaatgcctcaacaacccatgttgttctgtgaggtggttcatgtggcgtccctaa

SEQ ID NO: 12904 - DNA, 315 bp, Glycine max
  Peptide Sequence Number=SeqID_104589
atgggttatttgaggctccagtggcttctggtttctatcagctgtccctcctgttcagctactgacggggtggtgttacgtaacggcaaaagcaaccagccggacatcagcgctggcaagtgtaaagcggtgctgacgctgcgcgtaaccaccacacccgccggcttaatgcttgcgctacagggcgcgtcccattcgccattcaggaactgcggcaactgtaatgaggaagggcgatcgagtgcgggcctcttcgctattacgccagctggcgaaagggggatgtgctgcaaggcgattaatgttggcatgtaa

SEQ ID NO: 12905 - DNA, 165 bp, Glycine max
  Peptide Sequence Number=SeqID_104590
atggtgaaaacaccattgaggcatttcaccgagcacttggtgggcgcacttttgggtgtagaagcaaagcttcatggtgaatcaaagatgattcaaaggtgttttgatgataacaatgatgatgacaaaggtgatgacaaaaagctcaaagaacaactcaagtga

SEQ ID NO: 12906 - DNA, 497 bp, Glycine max
  Peptide Sequence Number=SeqID_104591
atgcaaatgaatcatccaacctcagatatggtaggcaaagatttgggaagtacggacggcccccattatgtgcaaattcaaaacaagcatgccttcccattatatggcttgcctcccaactatacaccacccaatgtggcatacattcccaataagaatgtcaataactccactcctatacccattgagagccaacaaccccaaactaatcatacacatccttgcctcggatatgccactaaagggcaagcagttggtggtatacccctacaaaaccctttggagggccctcagtatcatccccagctacacctcttgcattccacaacaagtaaaaaccctcatgctatgacagaaatgggaaagttggatcatctagaggaaaggctcagggccattgaaggaggtaaagattatgtctttgctaacctagaagagttgttcctagtacccaatatcatcacccctcccaagttcaaggtgctggactttgacaa

SEQ ID NO: 12907 - DNA, 65 bp, Glycine max
  Peptide Sequence Number=SeqID_104592
actttgtaaaggattttacaaaggtagtggaaatctcaagtgggatgcttgagtactggacgtag

SEQ ID NO: 12908 - DNA, 189 bp, Glycine max
  Peptide Sequence Number=SeqID_104593
atggacgctaggcccatgatcaacagatcgctgtctcgcattcagctccggacaatcgagaagcgctactgggaggaaatgactccgaaaaatctttccacgaagaggtctagaaaggacgccacgggagaaggctccagtgccgccttagagtttgatagtcaccggttccggagtgccgagcactag

SEQ ID NO: 12909 - DNA, 186 bp, Glycine max
  Peptide Sequence Number=SeqID_104594
atgacgaagaacgaacgaagaacgatgaagaatggtgaagaatcttcacgaaatcgctcacagaaacattccggaagagaaaagagggaggtggttgctgcccagctcgcccaggcgagttgggttgcttccaccagaaggcaccgccttctgttggaaccccctagaagactcaagtgggcctag

SEQ ID NO: 12910 - DNA, 933 bp, Glycine max
  Peptide Sequence Number=SeqID_104595
atggctccaaagaagcttctctctaagaggtcaaggaaggacatcgcgagagaaggatccagtgcagctccacaagcggacatagaatttgacgaacaccggtttcgaagtgaggaacaccaacaccgctttgaagcgatcaagagttggtctttcctcaaggagagacgggtccaactgagagaggaagaatacactgagttccagaggaagaaggagttagggataagcactcctaggtgcggggccaatgggttccctttgatgaagatgccattaatcaattcttggggcatccgctggtcctggaagaggggcaacattgtgagttcagtgagaggaagatccaggcttcggggtctaatgaggaggccatcggctagttgctatgcattccgggacaggactttgcgtgcagcatcggaaaggcagctaatctcggactccattttaccaatttgcagggatcacgcctccaagacacccaatggacccagaaaagtccaacagagcactggggttttggccttgatcacgggtctctgccagttctatgggctatcggaccatcagcaacggccagccgcagatgcaccaccaccccctctacaacaaccaccatccctagagtccatctctgctcacatgcagaggatggaactctatatgcagcatgtggctgaccagcaagtggccaatcataagggtcaggtgcatttgaatgagagcttttaccaatataccctggatcaaaagagccaggatcccagtccttactcatggcctactctcgagcagttcggagcaacagttgcatggcctggagataggcccagttttcaggtagaggcaggacccgcaggggccccaggagatgaagatggagctcaggaagactatgacatggccgatgtgatggacttcttcctttga

SEQ ID NO: 12911 - DNA, 180 bp, Glycine max
  Peptide Sequence Number=SeqID_104596
atggtggagagggagatgataacaatgatactagacacgttactagtgttctactatgagaagatggtgggttacatgccttcaagcttagccgatttcgtgttcgccggcgaaaggattgaactcggtttgagaagaggcaaatttcataatcctattttgatgaataggaagcctggg

SEQ ID NO: 12912 - DNA, 369 bp, Glycine max
  Peptide Sequence Number=SeqID_104597
atggcaagttcgtcatcatctaatcattataacgtggcatctggaccattagaggatgatttactgtggatgcaaaaaaaccatatatcacaacatatttggaatggtgctaatcaaaggacgttaaaaattcgacgagctacaccactgtataatcatagagaagcaccgcccgaggaaattattcctttattacaagtttcggtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 12913 - DNA, 1017 bp, Glycine max
  Peptide Sequence Number=SeqID_104598
atgcgtttaatcattgattgcgatcccggcaacggcgttcccggcgccaacgtcgacgacggcctggcgctagccctggcgctggcagccaaaccgcagctgcagctggagttgatcagcatcgtggccggcaacaccccgcgcgaagtgggcttcgccgtcgctaccgacctgctggcgcagagcggctatcaggtgccggtcgccctcggcgcggcgcgcgccctgagcgaaccgccggagccgtggcgcgcacacctggaccgcccgatcgccgatcctaagctggcggcgctgtggcgtgacctgcccgcgccctcgctggccaacgcgcccgcgccggacgccgccatcgccatcggcgaactgatctgccggcatcccggcgagatcacgctggcggcgatcggcccgctgaccaacgttgcgcacgccatgcagctttacccgcagatggcgcaggcggtgaaagagatcgtgatcatgggcggcgtgttcaacgttgagggatatatcaaggacaccaatttcggcctggatccggaagcggcgcggctggtgttgaacagcggcgccgctatcacgctggcgccgctggacgtcaccacccagaccatgctgacccaggcggatctggccgcgttgacccagccggataccccgctgggcgttgacgcgcggcagctcacgccgctggcggccggacagcctgcgcctgacggtcggcatgccggcgccgcagggcaagccggtgcgcgtcatgcagcaggtggacaacgcccgtctgctggcgttgatcggcgcaacgctggcccgcggatgaaaaaaggtgcgccaaagcgcaccaatcatcgagccagcatcggcagcgccgggtgttaccccttgcctttaacgctgctgataaacgttttacgcgcggtggtcgagcccagtttctcggcctcattcatcagcttcagcgccttgtcgatatcgcccgccttcaccgcctgcttgatgccgttattgaagtag

SEQ ID NO: 12914 - DNA, 597 bp, Glycine max
  Peptide Sequence Number=SeqID_104599
atggaccgtattggccgtaagatcaacatgatggaacaggttctggatattccttcccaggaagtgatctcgaaggataacgccaacgtcaccattgacgccgtctgctttattcaggtgattgatgcgccgaaagcagcgtatgaggtgagcaatctggagctggcgatcgtcaacctgacgatgaccaacatccgtaccgtgctcggctcgatggagctggatgaaatgctctcccagcgcgacagcatcaatacccgcctgctgcacattgttgatgaagcgacgaacccgtggggcattaaagtgacccgcatcgagatccgcgatgtgcgaccgcctgcggaactgatcgcctccatgaacgcgcagatgaaggctgagcgaaccaaacgagcctacattctggaagcggaaggggtacgtcaggctgagatcctgaaggcggaaggggaaaaacagtcgcagatcctgaaagcggaaggcgatcgtcagtccgcgttcttacaggcggaagcgcgtgaacgttctgccgaagcggaagcccgcgcaacgcaaatggtgtccgaggcgattgccgccggtgatatccaggcg

SEQ ID NO: 12915 - DNA, 361 bp, Glycine max
  Peptide Sequence Number=SeqID_104600
ttggaacctcttacgtgccgatcaacgtctcatttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 12916 - DNA, 519 bp, Glycine max
  Peptide Sequence Number=SeqID_104601
atggctgagaagacaaagaaaaaattggaggaagctactcaatctagaagcactaagggcgtgattgaccctccatctcccattagacgacacgtgaagtggaagatgacctgcaccaagaaaattgggcagatgacgtttgatgcaacaaaggaaatttctgagaagattgattctttggaggagcaggcgtcacagggttcctttgtcccctatggacgtcaggatctcctgactgctgccatttggcgaccagaacaccctagccgtgtgcgtgctgttggagccgctgctcgtgttagcacaaaggggagttgtgttgatccctcagcgactaatgcagacacagtggttcacgacatccttttgttgcatggccaagtgaaggttggtgttgaggaggttaaagatgcaaaggctctcgttcctgtacccactgatgaggttattttagtggggcaggcacttaacaccttccttgcttggccgacacatctcgtgaagcgtttatcagaaaag

SEQ ID NO: 12917 - DNA, 439 bp, Glycine max
  Peptide Sequence Number=SeqID_104602
gatcccaggatttcagaacaaccagcagtatcaacaacagagacagtggcaaaatcaccctggtaaccaattcaacagagaccagtgtggttcatctacaaggccacaacagcagatgccaaatcactatgaccgaaccactaagctggaagagactctagctcaattcatgcaagtgtcaatgtctaaccaaaagagcactgagtctgcaattaagagtctggaagtccaagtgggccaacttgcaaagcaattagctgaaagatcatcgaacaaatttacagcaaacacggagaaaaatcataaagaagagtgcaaagatgtgatgactagaagcaaaatggtgatccaagcagaggaaagtagagctgatcagaaggtggagggattgaaccaacagctgactgatgaagtggcactgaaacggttgatgatttag

SEQ ID NO: 12918 - DNA, 845 bp, Glycine max
  Peptide Sequence Number=SeqID_104603
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagaatcttactccttgcaccctgctcccacgaacaaggttcgcgatcatcacaggtatcaaccacacgatacaaaattgcaaggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12919 - DNA, 785 bp, Glycine max
  Peptide Sequence Number=SeqID_104604
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatactacgtctcggatcccggatgcggatacatggtggaagggaggagggaaccataatcgatcggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12920 - DNA, 393 bp, Glycine max
  Peptide Sequence Number=SeqID_104605
atggcccttggagatgaggattatagtcatttgaatcttctcttagctcctcagcacaatttctgcagctatttcatatgcagcaaaactcttactgctcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 12921 - DNA, 409 bp, Glycine max
  Peptide Sequence Number=SeqID_104606
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcgctccctcgtgcgctctcctgttcctgcattcggttaccggtgtcattccgctgttatggccgc

SEQ ID NO: 12922 - DNA, 129 bp, Glycine max
  Peptide Sequence Number=SeqID_104607
atgtggaaattcttcatcggtctttaccgttcttcgttcgttcttcgtcgttcttcagtcttcgaccgttttcttttcttccgctttaacgagcttttaaccgtttatttaagccgttttctcacctaa

SEQ ID NO: 12923 - DNA, 49 bp, Glycine max
  Peptide Sequence Number=SeqID_104608
atggtgttatctagctacaagttttactgggcatttttcgactacaaag

SEQ ID NO: 12924 - DNA, 399 bp, Glycine max
  Peptide Sequence Number=SeqID_104609
atgcaatctcagggacttgcagtgcctcctggccctctggttggtccctccggtcctcgagtgagcacaaaggggagttgtgttgatccctcaggaaacgatcctgagacgggtgactctgacaggtgcggcttgcacatagaagcagatcctgcccgcttggttgccatggggagagtttatgagggatccactcttgttcataacacttctttgttgcctggccaagtaaaggcacttcacaccttccttgcttggccgacacatctggtcaagtctttatcacaacaggtagctgtgcctccggcaaaaccacctccaaagcctgatccgaaggtcgatgatccgctttatctgatgacattgaccatcccagagcttttcttgaggccttatcag

SEQ ID NO: 12925 - DNA, 579 bp, Glycine max
  Peptide Sequence Number=SeqID_104610
atggtcattgaccaatcctttttccatgacttaacccaattgtccagtgacggtgtaccatttgaaggtacactgaatgacgattggaagtttgatttttctgcacatgatgcccgccaattggtttgcaccaacaatgcggatatgaccggacgccttcttgccggttcattggcttttgaaagccgcatcctacattatctgattgtgcggattttgcttccacgatcttccaatcttgcccaagtttctgaggaagatcttgttatcatgtgggcctttcataccgaccgtcaacttgactgggcacatcttagatcttttttaattggtgctgctgtgattgcttcttttggttaccgcaaagaccatgatggctcttgggtcaaaaagggcgctcaacccgctgatgaagaaggcaacctaccagttgaagataattctactcttcttcgaaggcttatggacaagtttgatggacttcagacttttgttggtgacaagtttgatgccatggaattgcaagtcgacatacggttcgatgccatggaatcaaggatcaccaaagttgaagaagat

SEQ ID NO: 12926 - DNA, 367 bp, Glycine max
  Peptide Sequence Number=SeqID_104611
atggaagaagcggaaaaggagatcttggagaccttcaggaaagtagaggagttgtgcacccacaaaaggaagctcaagggaaatgaaaggattagtatgggcagaaatgtgtcagcattgataggtaaatctgttcctcacattcctgggaaatgtaaggacccaggcagaccatttatgaaaacagcccgaaccaagatagatgtttatgctggcacattgtctatggaatttggtgatattgttgttcattttaacattcttgatgccatgaaacatccaactgaggatcattctatttttcgtgctgagataattgatcagattgttgatgattatatgtttgattttgattctgttcttcatg

SEQ ID NO: 12927 - DNA, 306 bp, Glycine max
  Peptide Sequence Number=SeqID_104612
cttgagaggattgatggggacccactgttgagagaaacgaggatatgggctacgtgggagtacgtgagctcagatggaggtgggcaacaggggatgagtggtacctggagatatgtcgcgggggtcaggagaccttggggacgtcaggcgagctcctggcagtcaacagataaaaggaacaaagaccacaaagcaaggaggcttgtggtggaggctaagatggtctctggtaatcgattaccacggggtgtaatcgattaccaggcttgcaaaatgaggtcaggaagccatgagggcttctggtaa

SEQ ID NO: 12928 - DNA, 389 bp, Glycine max
  Peptide Sequence Number=SeqID_104613
gtgcagccggggatgttcatttttcgctgtcgaagtgtccgcaatcacaggtcttattcgggcaataccgtgcgctcggggctgtccttcctgttcagctactgaaattcggggtggtatccgctcacaattcggcacacaagcatacacgccggagcatcagcgggcaagtggcgcgtccattcgccattcaggtgcgcaactgttcgggaaagggcctgatcggagtgtccatcactggcttacatgttggtaaaactgtgacggcggtcagaattctgactgcagcgctggcaacgctccgggtcgtcgaactgcggcgagcggaaatggcttacgaacggggcggagatttcctggaagatgccaggaagatacttaacagggaa

SEQ ID NO: 12929 - DNA, 845 bp, Glycine max
  Peptide Sequence Number=SeqID_104614
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatggtgtggtgactcaagtctgtaatcctagcacttcgggaggccgaggagggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12930 - DNA, 450 bp, Glycine max
  Peptide Sequence Number=SeqID_104615
atgtccaaatcttgtggatttgggatgaccggccctctcgatgagtcgatctcttgctttctcataagggtggacccttgggtacttgtacctatcgcctttagaggactacacaccctcgccatcagaggactacatgtcctcaccttcagagggctacacgccctctccatcagaggactgcatgtcctcaccttcagagggctacacgccctcgccatcagaggactgcatgtcctctccttcagaggaccacacgtcctcaccttcagagggctacacgccctcgccatcagaggactatatgtcctcaccttcagagggctacacgccctcgccatcagaggactacatgtcctcaccttcagagggctacacgccctcgccatcagaggactgcatgtcctcaccttcagagggctacacgccctcgccatcagaggactgcat

SEQ ID NO: 12931 - DNA, 1039 bp, Glycine max
  Peptide Sequence Number=SeqID_104616
cagaggactacatgtcctcccctacagaggactagacatcctcgtcattagagggctacacgtcctcactttcagtggactacacgtccccaccttcaaaggactacacgtcctccactttagaggactacatgtcctccccttcagaggactacacatcctcgtcttcagaggactacacgtcctcgccttcaatggctacacaccctcgccttcagaggactacacgtcctcaccttcagaggactacatgtcttctccttcagagggctacacgccctcgcctttagaggactacacgtcctcacctttagagagctacgcgccctctccttcagagggttgcacaccctcagcttcagaggaatacacgtcctcttcttcagaggactacatgtcctcgcctttagagggctgcacgccctcgcccatcctcaccttcaaaggactccatgtcctcacctttagagtactacatgtcctcaccttcagaaggctgcacaccctcgcctttagaggacttcaagtcctcaccttcagaggagtacacgtccccgccttcagagggctacacgccctcgccttcagaggactacacgtcctccccttcagaggactacacgtcctcgccattagagggctacacgtcctcactttcagaggactacacgcccccaccttcagaggactacatgtcctccacttcagaggactacacgtcctcccattcagaggactatacatcctcgccttcagaggactacacgtccttgcctttagagggctacacgtcctcaccttccgaggactagacgtcctcgccttcagagggctacacgtcctcaccttcagaggactacacatcctccccattggagggctacacgtcccccccttcagagggctacacgtcctgcccttcagaggacttcacgtcctttccttcagagggctacacgccctcgcctgccgaggactacacgccctcgatttcagagggctgcacatctgcaccttaagagaatttaaggtcctctga

SEQ ID NO: 12932 - DNA, 261 bp, Glycine max
  Peptide Sequence Number=SeqID_104617
atggaaatatggaagactaatgtcaacctcttgaggccttctgtcgcaacgtgcccttcacgggcgagcgagggcgaagctcacgggtgcgctttccaaaggaggaaagatgcgcggagtcgccaccaacgtttatttgtggaaaacgtcggaaaaaccgaaggaaaccggtcgacaaaagtggggcttttgctcctacgtaccctcctttggagaggaaatcagacctacgtagttctttcttatgcgtggatcaagtga

SEQ ID NO: 12933 - DNA, 333 bp, Glycine max
  Peptide Sequence Number=SeqID_104618
atgactggcgagtggattagtccttacatttggattgtcctcttgaaacatcagccatcccgcgtcaatcaagctttgcaccttatgcttaaaggccacacactgctctatagaatgccccggaacaccaccatgattggcgcatgttgcattgggattgtcccattgggggaaggagggctttctttctgggaagttcatgatgcaagctccattggagcttgtaggcctaggatcttcttcatcaatggattcctttgcttcttggaagataaatggcagcagaatggagaaggaagagagagaggagacgccacttcaaggagaagatga

SEQ ID NO: 12934 - DNA, 714 bp, Glycine max
  Peptide Sequence Number=SeqID_104619
atgtctttcgatcgagactattacagtctcctttgccatccaaagacaagcgagtccgttggcagccagagacaaattatggtcatctgcccccttttcgaagacttcgatgtctttcgatcaagactattacagtctccttttccttccaaagacaagcaatctcctttgccatccaaagacaagcaagtccgttggcatgcagagacaaatatggtcatctgctccctttgtcaaagacttaatgtctttcgactgagactattaaagtctcgccttcgtcatccagagacaatcaagtccaatggcacgcaaagacaaatatggtcatctgctccctttgtcgaaaacttcaatgtctttcgaccgagactattaaagtcttcccttcgtcatctgctccctttgttgaagactcaatgtctttcgaccaagactattgcaatctcccctttgccaaccagagacaagcgagttcattggcacacagagacaaattatggtcatccagagataatcaagtccgatggcatgcggagaccatcatggtcatctacccctttgtcaaaaacttcaatgtctttcgaccgagactattttagtctcctttaccatccaaagataatcaagtctaatggcatgcggagaccatcatggtcatccgttttcattgttttcaagactatttttgtctcctttgccatccagagataa

SEQ ID NO: 12935 - DNA, 303 bp, Glycine max
  Peptide Sequence Number=SeqID_104620
atgacaaaggatgcaatccacagtcacaactctacagcgcaacgccacttcctttctcttttttctctcctggcttcgagctttttctctagttctatggtgtctttgaatttgagccatgaggtgcagaccaactcgcccaagcgagtttcttgcttaatgttgaaggtattcacttgctcggtcatttcccatcaaatcaaagacaaagtccataatcatcatggatcattagggcttttacgccatggagttgtagcagaagataaaggagaagtggtgagaggaggtgccatctactag

SEQ ID NO: 12936 - DNA, 158 bp, Glycine max
  Peptide Sequence Number=SeqID_104621
agaataagccatggaaggagaagcttcaccaccaagagagtgccttgaataagaagcttagagaggaagtttcaatggaggaaaagaatgaaagagaggggggtagcttccttgagaagtatagcttccttgagaagctttctgagaagcttcattga

SEQ ID NO: 12937 - DNA, 276 bp, Glycine max
  Peptide Sequence Number=SeqID_104622
atggctccaaagaaactagccactaagagagccaggaagactgttgcaggaaaagatctagcacaactccacctgcagattttgaatttgatgaacatcaatttcgcagcgaggagcatcaacgccattttggaaccaatacccaaatatgaccttgaagttgtcttagagttttatgctaatgcttggcctaccgagaaaggagttcttgataagtactccaaagtgctaggccaatggattcttatgacacaaatgctatcgaccaatttttag

SEQ ID NO: 12938 - DNA, 791 bp, Glycine max
  Peptide Sequence Number=SeqID_104623
atgatgctggcgttgctgttggcgcgtgccggtatcgacgtcaccgtgctagagaagcaccccgacttcctgcgagacttccgcggtgacacggtgcacgccagcacgctgaacctgatcgacgagttggggctgggtcccaggttcgcggccatgccgcacaatctggtggagcaggtcacggtggacctgggcgaacagacattccggttgggcgatctgaaccggctgcccggaccgcacaaacacatcgcgatggcgccgcaatgggacttcctggaaatgctggccactgcggcggaaaccgagcccactttccatctgcggcgcagcacagaggtcaccggcctactgcgctcgggcgaccgcatcaccggaatcgaataccgcaccgcctcaggcgaaaccggtgcgctcaaggccgatctcaccgtcgcctgcgacggccgcggctcggcgctgcgcgccgcggcggggatgcgtccacggcagttcggcgtgccgatcgacatttggtggttccgcctccccaagcatcccgatgatccgcagggaccgcgcgcgcgggtcggtgccaaccggttcatggtgctactggaccgcggcgactacttccaatgcgggtacctcatcggcaagggcaccgactcgcagatgcgcagcggcgatgtacaggtgctgcgcgaccgggtcgccgaaatggtgccatggctggccgcccgcacggacgccatcgccagttgggacgacgtgaaactgcttgatatacaacttaataagctacgcaagtg

SEQ ID NO: 12939 - DNA, 591 bp, Glycine max
  Peptide Sequence Number=SeqID_104624
atggcgctgctgtatctggcgacctttggttcctttatcggtttctccgccgggtttgcgatgctgtcaaaaacccagttcccggacgtgcagatcctgcactatgccttcttcggtccgtttattggcgcgctggcgcgttcgatgggcggggcgatttccgaccgtctcggcgggacccgcgtgacgctggtgaacttcgtggtgatggctattttctgcgcgttactgttcctgaccctgccaaccaatggtcagggcggcaacttcatcgccttcttcgcggtatttatggtgctgttcctgaccgccgggctgggcagcgcctctaccttccagatgatttccgtgatcttccgtaagcttacgatggaccgcgtgaaagcgcagggcggcagcgaagcgcaagcgatgcgtgaagcggcgacggataccgccgcggcgttgggctttatttcggcgattggcgcgatcggtggtttctttattccgaaagcgttcggtatttcgctggatctgaccggctcgccggccggggcaatgaaagtcttcctcgttttctatattgcctgcgtagtaatcacctgggcg

SEQ ID NO: 12940 - DNA, 492 bp, Glycine max
  Peptide Sequence Number=SeqID_104625
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactattaagataccaggcgtttccccctggcggctccctcgtgcgctctcctttcgctccaagctggactgtatgcacgaaccccccgttcagtccgaccgctgcgccttatccggtactatcgtcttgagtccaacccggaaaagacgtgcaaaagcaccactggcagcacccactg

SEQ ID NO: 12941 - DNA, 779 bp, Glycine max
  Peptide Sequence Number=SeqID_104626
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatatagcctctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12942 - DNA, 463 bp, Glycine max
  Peptide Sequence Number=SeqID_104627
atggggacaaatcaaaacggcaaaaggttttatcaagtcaaggttaaaagtctagatgtcactagcctcaaggaattaggacgattgatgggacctctccaaaggcaagccttccgcaaagtgtacgggaagattctagatttgaccgcagcggaggtatttacggaagctgtcgtatccctcgcccaatactatgaccagtcgttgaggtgtttcacgtttggggacttccaaatggtaccaactattgaagagtttgaggagatattaggatgccctcttggggggagaaaaccgtatcttttctccggctttcttccttccttgagaaaaattgcagctatgattggagattcagcaaaagagttggatcacatgaaacaaactcgcaatggaatagtgggcctgccacggaaatacttggaaggcaaggcaagggatatggcgagccaagagaagtggg

SEQ ID NO: 12943 - DNA, 672 bp, Glycine max
  Peptide Sequence Number=SeqID_104628
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggcttttgtctttcgggtcaatgatgctgcaagttgatcaagacaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12944 - DNA, 881 bp, Glycine max
  Peptide Sequence Number=SeqID_104629
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaaattcgatcccttcaaactcattaacaaagccacagatttacagattaatatggtttgccagccgttcaacaaacagcagtgttgcgggggtataaagctcgatattgtccattctcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12945 - DNA, 503 bp, Glycine max
  Peptide Sequence Number=SeqID_104630
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataactaaagatagagtctctctgtcacccaagctgcagtgcagtgttgcagtgttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgtggcactgatgagg

SEQ ID NO: 12946 - DNA, 741 bp, Glycine max
  Peptide Sequence Number=SeqID_104631
atggtgaaagttggaacctcttacgtgccgaatgtcaacggtttttctccacatcaattcaccggttcccgatactatccaacagggacaccggttttttgcgcaaaaagatcttccatcacagcttttattggcgcaatacgtgcgacctcggggtgctccagtggcgtatctggtttctatcagctgttccctcctgttcagctactgaaacggggtggtgttatccgctcacaattcggcacacaagcactacagccggaagcatcagcgcggcaactaactcaccacacccgccgcgttaattgcgttgccgctacagggcgcgtcccatttcgccattcgggaaacctgcggcaactgcttaatgacggcaaccgggcgatcgagtgcgggcctcttcgcgtattacgccagctggcgcaaagggcggatgtgtgcatacggcgattactatgttgggtaactgtgccagggtgttcccagtcagaaggcgttcgtggcagaaaaaacgacggtgcgtcagtcagaatatgtgaatacaggactcatatggtccgcgaattcctcgctctgagctcgctaccgctcggtcgtcgatgcggcgacggaagctctagaactagggggatcccccggagctgcaggaattcgatctgttacagggacacgaatgtcaaaacggttttcaatctccacataggcaatcaccgtcccctgaccaagcatcacgaaatctga

SEQ ID NO: 12947 - DNA, 228 bp, Glycine max
  Peptide Sequence Number=SeqID_104632
atgatgacaatgatagtagacacattaccagtattctactatggaaagatggtgggctacacatcttcaagctttgatgatatggtcttcaccaatgaaaggatcaaagtgggactaaaaagaggaaaatctgatcatcatgctttgataaatgccaaaacaactagggcaaacgaagagggtgagaatgagggagaagcccatgctgtgactgccattcctatatga

SEQ ID NO: 12948 - DNA, 213 bp, Glycine max
  Peptide Sequence Number=SeqID_104633
atggccaaaaaacctacatcgaagtgtttctttacttcctcctttatctttagagacatctcaggtttcattctcctcaatttctgctttactggggagcactcgggattcaaaggtagcttgtgttgcacaatttctgagctcaaaccaggcatattgatggaagcttgcttgtggagcttctatggaggctggatctttgagcttcaatga

SEQ ID NO: 12949 - DNA, 225 bp, Glycine max
  Peptide Sequence Number=SeqID_104634
atgacatccttgtctaatatgtacaaagataattggacccaaccttggcccatgggctcagaaatctaccctaaggttcataagaaccctagggccttcttcaacagctctagcccaatcttcttggagcctcttgctcatggttctagtgattggtcccttcctagggaggattgcatcacggtcatcttctttttatcaatattttgtgggaaaaatagctag

SEQ ID NO: 12950 - DNA, 477 bp, Glycine max
  Peptide Sequence Number=SeqID_104635
caaaataagggagaagcttgccgcccagcttgcccaggcgagcaaggttgcttcctccagaagcaacagccttctggaggaatcttctggagggctcaactttcgaagaagttacggaaactcacggattgcgcaaaaacacctcttttcgattttcgccacattacggaatttcacgaaccacgcaagcctgctccctttcgatttctgagacgtctcgggacttcattcattgcatgtcatcaactagttgtcaatttttattcctcaaaatcagtggtacaatacaactcaccatgtgttagcagtaaagtgaggaaacagtgcacattaagtcaagtgctcagagaggtgatgacaaaaagctcaaaggtcaatcaaaggatgagttcaagatgttcaagaagaaatcaaaaacaaattcaagactcaagaggaaaagttgaagaacacttcaagattcaagaagaaggatga

SEQ ID NO: 12951 - DNA, 1251 bp, Glycine max
  Peptide Sequence Number=SeqID_104636
atgctggaacgccgccgggtgccgcgcatccttggggtgacgctgctggtgacagcggtgatcgtggtcgtgatgctgtttatcggcatgctgggcgcttcgctgaacgagttcgcccgctcgctgccgcagtaccgcggcatgatgatcgagaaactgcgcgagctgcagcattacgccgatcgcttcaatatcagcctctccagcgaagcgatgctgcagtatgtcgatcccagcgcggcgatgaatctggttacccgcatgctggggcacctgtctggcgccatgaccaacgtcttcctgctgctgatgaccgtggtgtttatgctgtttgaagtgcagctgttgccttataagctgcagcaggcgttggataagccgaacgaaggcctcgccgcgatgcggcgggcgctggacggccctggccaccggcgtgatcgtctggatcttcctggcggcggtcggggtgcgcttcgcctttatctgggggctgctggcgtttctgctcaactatatccccaatatcggctcggtattggccgccattccaccgttgattcaggcgctgctgttcaacggattgggcgatgcgctggtggtggcgggcggctttatcgctgtcaacatggtgatcggcaatatcctcgaaccgcgggtgatggggcgcgggctggggttgtcgacgctggtggtgttcctgtcgctgatcttttggggttggctgctcggcccggtgggcatgttgctgtcggtgccgctgacgatcgtggcgcgcattgcgctggagaccaccgagggcggctatcggctggcggttatcctgggggacggccgcccgccgcgccagcctccggcggcgccggagtgaggaagatttttccgctgacgccgggctgcgcggcgtgttgcagcgccgctgcgtggaacagcgaagcgcgcagctttaactcgtccactacgcgccgccagtccacctggcacccgcctaaaaggcccagcgccacgaaatcgccgccggagcgaaccgctcgcgccagctgcaatccgtcttctccgccgatgcagtcgatggcggcgcgggcgccaaaatgggtcattttcgccagctgcggcgcttcgataacgcgccaggcgccggcggccagcagcgcctggcgatgggcggcgttgcgcaccaccaccgccagacgaataccacgcagcgccgtcagctgcgccaacagcaggctaacggcggagccgccgccgtga

SEQ ID NO: 12952 - DNA, 270 bp, Glycine max
  Peptide Sequence Number=SeqID_104637
atgtgggccatcatcgatgagtgcaaagagaagctaaatctagcagcgactcacgagcaaaggctagaggatgagtacgccaagatatcagtagaaagggaagcaagggaaagggtaattgattcattgcaccaagaggcaacaatgtggatggaccaatttgctcttactttgaacaggagtcaagaacttccccgattgctagccaaggccaaagcaatggcggacacctactgtaacatcctggaaatttctacccggaatttttga

SEQ ID NO: 12953 - DNA, 349 bp, Glycine max
  Peptide Sequence Number=SeqID_104638
tgaaatcctggtgggaaagcctttggccgtcgccttgaagggatttttgtcccaaaattcaggttccatctgcaaaacagttgtggtgtttgagctttggctaaaggcaatctgggttgatgacccttctaaattggttttctgggtagattacccagcctgggttggtgacccagaagaggttgatgatttcttaatggttggctctggaagagccagtctggctcctttgcctacaaaggatcaagctgatgttttgatgatgccaaaggatcacatgcgtctcaaagctttattcaagacaaagaaattaaagatattcaagatggatgatcaagacagtctttag

SEQ ID NO: 12954 - DNA, 630 bp, Glycine max
  Peptide Sequence Number=SeqID_104639
atggacaaaaattctctctggctgcgctacgtcccgttagtgcgccacgaggcgttgcgcctgcaggtcaggttgcccgccagcgtggagcttgacgacctgctgcaggccgggggaatcgggctactgaacgccgttgagcgttatgacgccctacagggaaccgcctttaccacctatgcggtgcagcgcattcgcggcgcgatgctcgacgagctgcgcagccgcgactgggtgccgcgcagcgtgcggcgccatgcgcgcgaggtcgcgcaggtgatgcggctgctggaacagcgttacggccgcccggcgagcgagacggaagtggcgcagacgctgaatatctcgctggatgagtaccgtcaaattctgttggacaccaataacagccagcttttctcctacgacgaatggcgcgaggagcatggcgagaacgcggaaccgatgctggaagggcatgaagaggccaacccgctgcatcacctgttggaaggcagcctgcgccagcgagtgatcgacgccatcgaggcgttgccggagcgcgaaaaaatggtgctgacgctgtattaccaagaagagttgaatctcaaggagatcggcgccgtgctggacgtcggggaatcccgc

SEQ ID NO: 12955 - DNA, 833 bp, Glycine max
  Peptide Sequence Number=SeqID_104640
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatattcctgttcagtattgccacacatgccacaccaattaacagcaaggaagggtcccaccagcctggggagggaatgaggtggggaaaaggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12956 - DNA, 1108 bp, Glycine max
  Peptide Sequence Number=SeqID_104641
atggggacaagtcaaaacggcaaaaggttttatcaagtcaaggttaaaggtctagatgtcactagcctcaaggaattgggacgattgatgggacccctccaaaggcaagccttccgcaaagtgtacgggaagatcctagatttggccgcagcggaggtatttacggaagctgtcgtatccctcgcccaatactatgaccagccgttgaggtgtttcacgtttggggacttccaaatggtgccaactattgaggagtttgaagagatattaggatgccctctcggggggagaaaactgtatcttttctccgactttcttcctcccttgagcaaggttgcagctgtgattggagattcggcaaaagagttggatcgcatgaagcaaattcggaacggcgtagtgggcctgcctcggaaatacttggaagacaaggcaagggatatggcaagccaagagaagtgggggccgtttgcggatgttttagctttgctgatttttggggttgtcctctttccgaacgttgacggcttggtagacttagccgccattgatgctttcctcgcatatcaccatagcaaggaaagtccagtggtagctatcttggcggatttgttcgatacctttgaccggaggtgtgagaaaaacagtgtacggattttctgttgtttacccgctctctgtgtgtggttgacttcacaccttttccgacaagacacgagacacccgtgtccgcttcaaagctatcgctcatgcgccgaaaaaggaagagtcgattgggaccaacatttggcagggatagggggcagcacgatcaattggtttcctcattggatggaaggcaaggaaggagttcttttctcgtgtggggactatcctaatgttccattgatagggactaggggttgtattaattataatcccgcactcgccataagacagctagggtatcccatgaggggagcgccaaccgaagaaagtctctcgcctttccttgtgagagatctaggagcgcaaggtctcaaggttatacaaagagtccacaaggcgtggaggagtccgttgaggaaagacaaggagcttaggggcatccgaaacggcgtcattggag

SEQ ID NO: 12957 - DNA, 815 bp, Glycine max
  Peptide Sequence Number=SeqID_104642
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatttctgcaccctttgtcacccagaggcggcgggcccgatgacaaaagggtgcggataaccgtaaggtatctccgcgtatcatcgggcccgccgcctctggatgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12958 - DNA, 872 bp, Glycine max
  Peptide Sequence Number=SeqID_104643
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcagaaaaagcattttagaaaatccaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12959 - DNA, 920 bp, Glycine max
  Peptide Sequence Number=SeqID_104644
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgacgtagatggatctgggccgcgcgccacacgtcaggcatcgccgtcttcttccatcatcttgcgcagcaggaactgcagtgcgacccgttcgccgggattgagcgcgccgtacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 12960 - DNA, 806 bp, Glycine max
  Peptide Sequence Number=SeqID_104645
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12961 - DNA, 552 bp, Glycine max
  Peptide Sequence Number=SeqID_104646
atgaccatgattacgccaagctcgaaattaaccctcactaaagggaacaaaagctggtaccgggccccccctcgaggtcgacgacaattgcaatctcagattagtgaaatttctaacttaagttatgggcctcaatttgattcttttgggttcacagcttcatgcttagttcccctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 12962 - DNA, 393 bp, Glycine max
  Peptide Sequence Number=SeqID_104647
atgtcagagttggacgagtcttttgcagagatgaaaatagaaaatatcgtgaaatttgttgttgcatttagtcaagacaaacatgcatccaactcaccagtggacgatcaacctgaagaagtcagagaaccaactagatgtttgttgaggaaacatcatccaaagtctcatatcattggtgatcctaaggacaaagtgttcagaaacaagttggatgaaacaagtaaagttgtgaggaacaaggctaggcttatggccaaagtgcattccttaatggaattattaaggaagaagtctatgtggaacaaccccctaggtttgagagttctatcaattagagataaggagagcaacaacatgagcaacatggaacaacctaaggctaaagcttga

SEQ ID NO: 12963 - DNA, 165 bp, Glycine max
  Peptide Sequence Number=SeqID_104648
atggctgcgcaagaaggaagtgtcgctagaggaagcaagcgagtttctccgcattattcagcagagcgagttcaaggaattaatgaaacattgggcttaatccggattttggttgtggacttgaagagggcaaataaagcagcgcttaccttagttaatttttaa

SEQ ID NO: 12964 - DNA, 336 bp, Glycine max
  Peptide Sequence Number=SeqID_104649
atggaagtagaatggagaaggaagaaagatgattggatacaccacttcaaggagaagatgagtcaagaagaagctcaccaccataggaagccatggataagagctcaaaggaaggagaagatgagtggagggagatggagagaaggagcacgaaattttgtgcctcaaatgaggattgcatcacagattcatcctggcttggagtggatccttggattggttgagtgtttagccttccatgatcatcactggtggaagagccatggaacttgtgcaagaaaaaggaagaacagaagtgaaaagaggaagaagaatgaaaaacacttgagagaataa

SEQ ID NO: 12965 - DNA, 129 bp, Glycine max
  Peptide Sequence Number=SeqID_104650
atgggggaaacttcatcaagaagcaaccagctcacctgggcggcaaggttctgccctattttggatataaaaggggcgtgggaggctgagagaaggggccaacaccctgggtatccagaattcacttaa

SEQ ID NO: 12966 - DNA, 733 bp, Glycine max
  Peptide Sequence Number=SeqID_104651
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggatcaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12967 - DNA, 135 bp, Glycine max
  Peptide Sequence Number=SeqID_104652
atggatacttgtatgacgcagcttgaagaggatttatatttgattattattcttccgccttgtgttgattaccacgtactttggctttttgatgttgccaaagggggagagaaacagggtggtttagaagcttag

SEQ ID NO: 12968 - DNA, 159 bp, Glycine max
  Peptide Sequence Number=SeqID_104653
gctaacggtggtgttgaagagaaggtagaaaaacacattaaagttgcaatttttatctcaaaaacttcatgggttcagagaaggtggaaaaacacattaaagttgcgatttttatctcaaaaacttcatgggttcaggttcgtaaacacaaaggcttaa

SEQ ID NO: 12969 - DNA, 423 bp, Glycine max
  Peptide Sequence Number=SeqID_104654
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggtgcgcaacggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 12970 - DNA, 504 bp, Glycine max
  Peptide Sequence Number=SeqID_104655
atgttcgggatgaaaaaatcaggtgtgaatgcttatgcaagcgtggggttggaaaccggcgttgtggacgccagcccgctgaaattgatcgtgatgttatatgacggcgcgatcactgcctgtatcaaagcacaacaggccatggcacagcatgatattgccaaaaaaggcgaatacctgacccaggctgtgacgattgtagacagtggcttgcgtacctgcctggacaaacgtgctggtggtctcattgcccaaaatctggaccagctttaccaatacatgacacgtagcctgatggaagccagtgtgcgccaggacgtgaaaaaagtacaagagattcagcaattgctgatggaattaaaaggggcttgggaaacgctggaaaaatctgcggttacccgcccagcacaagcagacatgtcattgggccagatggttgcccagaaaacacatgaattgcaacatatggggcaagccaaccgtttggccactgccggagcttaa

SEQ ID NO: 12971 - DNA, 374 bp, Glycine max
  Peptide Sequence Number=SeqID_104656
atggtagacaccttgccagtgttttactatgagaagttggtaggatacatgccttccagcttcacggacttggtatttgccggggaaagaatcgaagtagggttgaaaagtgggaagttcgattacgtctcctccacaagtgccaatgctaaaagagtcggaccaactggggcaaaaaggaaggaaggagatacccatgccctcgcgctgggaactcctccaattcatcacccgtacagcctagagcgcccacccccatctccggctccaaccacaactcacccggccggcaatgcccactttggtgtcggttccaacgcgatgaggaactttcccccgatgccgattccagaattcaccccgatcccaatgac

SEQ ID NO: 12972 - DNA, 486 bp, Glycine max
  Peptide Sequence Number=SeqID_104657
atgtggtatgatgaaagaatttcaaaagatagaaatacaacaagtccaaaattcagcttatgttgtggagatgggaaagttgagcttccgttattacaaagttcaccgaaatatcttgaacgacttttgtttgatggtaaagcaagtgatagtaaaaattatcagtgtaacatacagacatacaacatgatgtttgcctttacgtatgctgtcaacatgttgaaattgctggatgagtacaatgtccatgcaaaaagttttagaatggtcagggacagattgacagatagtcaagtcgataatgtaaaattgagattgatagctgcacgtgagaaaaatggtcgtacatacaatctcccaaatgtttctgaagttgatgctttgattgttggcgattttgatccagactcaagaagggatattattgtagaaactcaaaatggagaattacaaagaatccatgaattacactctagttatctatga

SEQ ID NO: 12973 - DNA, 986 bp, Glycine max
  Peptide Sequence Number=SeqID_104658
ttgtcacgggagggttgttctactctgccgtcagtaacgatcgccataacttccagaattccggtgtgctcaacgctcagcaggaaagcctgagcgacagcgtgaacacgctggtgaaaacacgcgtcaccgtgacccgcgtggcgatccgctacctgaaaaatcagcgcgatccggcatcccttgcggcgatcaataaactgctcggcaccgcaggtgactcgctggcaaaagccgaagcctataacaaagcgtggcaaaaactgccgcaggttaacggccagaacgcggcattgaccgacgagatgcagaagtcctggaaccagatgcacgaagtgatgcgtttgtcgattgagtatctgcgtgccgacaactaccaggcctatggcgatctggacgcgcaacaggcgcaggacgatatggaagcggtctataaccgctggcgcgccgaaaacaacactctgctgaaagccgccgccgaagagaatcagagcagcttcacgcagatgcaatggacgctggcggctatcttgctggccgttatcgcggtactggtggtcatctggcagggtttacaacacctgttgttaaaaccactcaacaccattatgaaccatattcgcgcgattgccgggggcgatctgacgcaggaaatcaccctttctggccgcaatgagatgggccagctggccgccggtctgcatgaaatgcagcaatcgctggtgaccaccgtcagcgccgtacgcggcagcaccgattccatctacaccggtgcaggcgaaattgccgcaggaagtaacgatctttccgcccgtaccgagcagcaggcagcctcgctcgaagagaccgccgccagcatggaagagctgacggcgacggttaaacagaactccgataacgcccgtcagcgaccctgctggcgaagaatgcttcagaaacggcggcgcgcggcggtcacgtggtggataacgtggttcgcaccatga

SEQ ID NO: 12974 - DNA, 264 bp, Glycine max
  Peptide Sequence Number=SeqID_104659
atgccactgaagggaaagcagttggtggtataccctgcaaaacacttcggaaggccctcagtatcacccccaaccacaaccctcatgttccacagcgaggaaaggcttagggccattaaaggaggtgaagattatgcctttgctaacctagaagagttgttcctagtacctaatatcatcacccctcccaagttcatggtgctggactttgacaagtacaaggggactacttgtcccaagaaccatctaaagatgtattgttag

SEQ ID NO: 12975 - DNA, 221 bp, Glycine max
  Peptide Sequence Number=SeqID_104660
atgggaaacataggctcaaaagggctatcaaaggaattaattcaaggtaggctcatttggctagaagcttataagaataaaatgcctaaatcatctcccaacatgcatgtgaaccaagaggaagtatcaacaagagtcaagccaaggttgttgtgcaagcaatcaatggagcaaagcacactgaataaaaaaaacaatgatggctcaaaatctcaccaatg

SEQ ID NO: 12976 - DNA, 576 bp, Glycine max
  Peptide Sequence Number=SeqID_104661
atgatccaagagcccgcagacgtggccaccccctcaaaagaagtggatcccccggtggtgaaaggagctgaaaagaaagaaggtcttcaaggaaatttggcggtgcacccgggaagaggctctttcttcgtctccccaagtggatgcatggatcattcgtggtggagactaaagggtcatgaatgttgtttaaatgtgatgccaaagaccaccttggagaaacttccttttaatgcgtcgcgtctgaaagccaagttcgatggtattggagcctttgacggtagtcagcggagaggtgattggggaaatcgacatccccatttagataaaaggcccccacacttgcaatgtggtttttcaagtgatggacataaatcttgcctacagctttcttttggggagaccctggattcacgcgctaggagtggtcccttcgatgcttcaccaaaaatttggggtcctcaagcaatagagtcgacctgcaggcacaaatatacccctcccgcttttggagaaggggctgcaaccgaggttgactccttgtcagccaaggtgaccaacattacccggccttag

SEQ ID NO: 12977 - DNA, 435 bp, Glycine max
  Peptide Sequence Number=SeqID_104662
atggatcaactccaacgtcaagctttccgcaagacatatgggaagatctgggatctaactatgatagaagtctctgttgaagccattgcatccctcactcagtattacgatcagccgctaaggtgcttcacgtttggggactctcaattagtaccaaccgtagaagaatttgaagagatattgggatgcccactagaaggaagaaaaccgtatctcttttctggtttctacccctccatggcaagaatatccaaagtgaaatggggtggtcggaataccaaggaagcacttggaggagaaagcaaaggctttggcggatcaaggttgtcgcaacctacccttcagcgggagggcgacgcgagactcacggatgcgtcttccatggaaggaaaaacgcgcggagtgccatcaaagtttattagaggaaaacgttag

SEQ ID NO: 12978 - DNA, 624 bp, Glycine max
  Peptide Sequence Number=SeqID_104663
atggcccgcacgaagaaaacaggggagatgacgactgaggccgcaaaggaaatcgctgagaagattgattcctttgaggagcaagtgacacagggatccttcatcccccatggacgtcaggatgttctcgccgctgctattggacgtccagagcaccctggacgtgtccgtgctgctggagtcggtgtcaccatcaagcaatactttggatcggctccacggacatcccgcagctcttcctccatgcctcctgaagaattgcagcagctgacccagcaaatcagggaccagctaaaggagtccatcacagagagagtgacgcgcacaaaggggagttgtgttgatccctcaggaaacgatcctgagacgggtgactctgataggtgcggcttgtacgtagaagcagatcctgcccgcctggttgccatggggagagtttatgagggatccactattgttcataacactcctttgttgcctggccaagtaaaggtgagtgtggaggaggttacagatgcagatgttccagttcctgtacccattgatgaggtttccttagtggggcaggcacttcacaccttccttgcttggccgacacatctggtcaagtctttatcacaacag

SEQ ID NO: 12979 - DNA, 442 bp, Glycine max
  Peptide Sequence Number=SeqID_104664
atgatgttttcctccactatagggtcacaatcttacaaagatattagaacagtagaaaatgtggtctaccatacatttagagaagcatgctttggaaaaggttttctaggaagtgatcaagaatttgttggtgctttacgagaagctaacacttggggaactccacacttcgttagaaagttatttgtcaagctgctatttatgaataccatggatagaccagaatatgtgtggaaacaaacttggcaatggatggcaaatgatattgcatttaatcatagaagacaagccaataggaaaagcctacgagatttcccttcaatgacatacccaataggatatgctgccaacccacaccgaaataagctcatctacaatgaaatggcttatgataaggaaattttggctgctgaattcaacaaatgctatcactcactaatag

SEQ ID NO: 12980 - DNA, 339 bp, Glycine max
  Peptide Sequence Number=SeqID_104665
atggctcggctctacaaaatgcgaaaagccgtcgagcaagctcgacgccacagtaatgcgactaccggcaacgcgcgctcacctgcagcaccgccgcacgcagcatgtcgcggtcggcttcttcgacggcgttctggaaatagtccatgtcctgcttgcccagctcgcacgggtcgacgatgtaccccggtggccacaaccccagcagctgcgccacgccatgcacgatctgctcgggggtcatctgccgacggatccggaagtaattgcggcgcggcccgaacgcgggatggacctcgcgccgaccgatcaggcgtggcgccacgcccgccgcgctga

SEQ ID NO: 12981 - DNA, 444 bp, Glycine max
  Peptide Sequence Number=SeqID_104666
atgagggtggacagagtcaggggagaccttgagtctcttgatagttttctaatacacaatatcagtggaactaccctggtcaatgaggacttgggacaccatgaagtttgcaatgatgatggagacaaccacgaggtcgtcttggttgaaggcgttaatacccttgaagtctctattcgtgaaagtgataggagggagacttcgttgttgtcgctcacgctgttgttgctagtagtccgtcctgctagacaatgcatgtgggagatacttaagtcatttgcagtgttgattatgcatcaggggtgtcattccccttgggtgcgctcaggaaatcctccaactgattgtggtcatcctttagctttctcagctcctcctcgtggggtcgctccatctctgcaatgcggttttggagttgctaaagagtatctgtgtccgtcatag

SEQ ID NO: 12982 - DNA, 783 bp, Glycine max
  Peptide Sequence Number=SeqID_104667
atggaagatctttttaagaggtggactgagtatcttgacaacacacaattaagggtcagtcactcactactgataaattgtgatttttgtggaggagagcattgcaatgacaattgtcatctttactccatgaataaatcttggtggggacaggagttactccctaacaatcactatgaagaagaaagaactcctaatcttgaaggtttgttcacggaattcatggcataccatgctagctctaaagccaatcaaaactcaatgcaaaatcaggaaattcatgttggcaagagctactccatggaaaattatcagtgggagcaagagttacaaccctacaatcaatatgaagaaaaaagaagttataatttggataatttgttgatgcaattcaaggaaacaactgaatatgctcaacgagcatttaaaagtttagaaattcaagttggtaagctagcaaaagaaatggctaaatttgtggccacaagtgaaaaaaactttgtagaggttgaagctcatgaggaaagccttgtagaagagcatgattcacgagaaaaagatgaagaaaaaatgtgcgctcagcgcgcaagtgcaggctcagcgcgcatgggcaaccggctaagccaacatgtctcgctaagccaaaaaacgtctctattttgtaatatcttgaattgggctaagcgtgcaggcacaggctacgtgagtcatgcattctcgctaagcagattttgcaggaaatttccttctgtaaaactcgctaagcccaatgtggtgtgctaa

SEQ ID NO: 12983 - DNA, 142 bp, Glycine max
  Peptide Sequence Number=SeqID_104668
tggaactctcaagcgggttgcttggggactggacgtaggcacaagggtgtggccgaaccaatatctgaggccacttgtccaacagtgacccccaaggcctatactccgaagagtttgtcagggcctctccctcctgattcag

SEQ ID NO: 12984 - DNA, 671 bp, Glycine max
  Peptide Sequence Number=SeqID_104669
gcgtatcacgaggccctttcgtctcgcgcgttttcggtgatgacggtgaaaaccctctgacacatgcagctccccggagacggtcacagcttgtctgtaagcggatgcccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggccttttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccagtggcagtttggctaagatctggcacactaccatttgccacagtggctatttgagaacattatatagagctcaaaattataacactaacaagaagacattgagacctagaagaaaaaggttatttgaaggtcaaagtgaacggaggaagtcttacctaggctttcaagcatgccttcaacagtctcaggatttgcagtcacagtag

SEQ ID NO: 12985 - DNA, 399 bp, Glycine max
  Peptide Sequence Number=SeqID_104670
atgaggcgtactgcatcatcctctaagcaaccgaatcgaagaacaatgatgcccatgttggaccagcttcagccatttatgcacgacttcattgataagattgttgatgtcaaagctgatggtaactgtggatatcggtcggttgccggtttattagagagatttgaggaattaaggatgtcactacttgttgaagggttaaccaaggtgactacggataaggggatggatataacggacatgggacatgtcattgcatcaaggtataacgtaatcgttgtatccttgtctaaacaacaaagcacgacattctttcctcttagaaatcaatcgctggcaaattcttcatggcatcgtacattttgtatcggtcatgtgtatggaaatcattttgttgag

SEQ ID NO: 12986 - DNA, 155 bp, Glycine max
  Peptide Sequence Number=SeqID_104671
atggtggtggttacccaggagaggaagaaggggataaggggaagaaaaagagaaaggggttggacggcgcggtggtggtggtggtggtgcagtgtggttggagaagaggaagaaggtgatgacgtggcactgatatggaagcctgtgcttgcatg

SEQ ID NO: 12987 - DNA, 621 bp, Glycine max
  Peptide Sequence Number=SeqID_104672
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccaggatccgccttacgcgctgtggcgtctcgtttttccttctggctttacgatctcgcgccgccgggaaccgagtggaaaaatatcaccgggtaccgagctcgaattcgtaatcatggtcatagctgtttcctgtgtgaaattgttatccgctcacaattccacacaacatacgagccggaagcataaagtgtaa

SEQ ID NO: 12988 - DNA, 106 bp, Glycine max
  Peptide Sequence Number=SeqID_104673
atgagtgttggagcggtgctgcccggcggtggcaggggtactgcaggcggcggccggggtacgggtaccgagctcgaattcgtaatcatggtcatagctgtttcct

SEQ ID NO: 12989 - DNA, 153 bp, Glycine max
  Peptide Sequence Number=SeqID_104674
atgggtaaagcggaggaggtacaagagaagatgaaggccgacatggaggccatgaaagagcaaattgccacgatgatggaggccatgatgagcatgaagaagataatagaagccaatgcagttgcagttgccggtaccagcactgtcgctaag

SEQ ID NO: 12990 - DNA, 696 bp, Glycine max
  Peptide Sequence Number=SeqID_104675
atggagaggagtatgattgatgctgctagtggtggagctcttggagtccatgaggtggccacagattcatcttcatctactgaaaataaaaagcttgatggaaaacttgatgccttggtcaacctagtaactcaactttgcatgaatcagaaatctgcacctgttgccagagtctatggtctatgttcttctgcagatcaccatatagatctatgtccttctttgcagcaatctggagtcaatgagcaacctgaagcttatgctgtaaacatttataatagacttcctcagcagaaaaaccaacaacagcagaataattatgatctttcaagcaacagatacaatccaggttggaggaatcatattgattcaaggtgttccgatgataacaaagatgatgacaaaaagcccaagagaatgatttcaagattgagtcaagaacaattcaagaatcaagagaaagattcaagagaaagtttcatcaagaagattcaagattcaagaataatcaagatcaagattcaagactcaaagattcaagaatcaagagaagacttaatcaagataagtattaaaaggttttttaaaacattgagtagcacaagaagttttcacaaaatcattaccaaagagttttactctctggtaatcgattaccagattgtagtaatcgattaccagtgtttaaaacgttaa

SEQ ID NO: 12991 - DNA, 493 bp, Glycine max
  Peptide Sequence Number=SeqID_104676
gtcgactctagaggatcccgcaaaaggccagcaaaaggccaggaaccgtaaaaaggccgcgactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttgcagattacgcgcagaaaaaaggatctcaagaagatcctttgatcttttctacggggtctgacgctcagtggaacgaaactcac

SEQ ID NO: 12992 - DNA, 600 bp, Glycine max
  Peptide Sequence Number=SeqID_104677
atggcttcgaaaaagctttccgcgaagagatctaggagggacgccgcggctgaagggaccagtgctgcccccgagtttgatagccaccatttcaggagcgctgagcaccagcagcgcttcgaggccatcaaaggatggtcgttccacagagagagacgcgtccaactcagggacaatgagtacacagattttcaagaagagatagctccccaacgttggacgtcactcgtcactcccatggctaagtttgacacagatattgtcctggagttttatgctaatgcttggcccacagaagagggagtgcgggacatgcaatcatgggtgaggggtcagtggattccctttgacgcagatgcccacagccagttcttgggtgacccgctagtgttagaggaaggcctggagtgcgagtttagtcagaggaggaacagggccgatgggttcgacgaagaggccattgcccaactattatgcattccaggtatgccacccaccaggcaccctctagacccggataagtctaacagggccctagggtttctagcattgatcacgggcctttgccagtcattcagggttctcgtcacacctagtaag

SEQ ID NO: 12993 - DNA, 399 bp, Glycine max
  Peptide Sequence Number=SeqID_104678
atgcctgtacatggaaactacaaccaagcgggagacaacaaaccacaacaaagaccaattttgtgggatttcaccacaaagttggaagaagccttgaccaaactcatcgaggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 12994 - DNA, 138 bp, Glycine max
  Peptide Sequence Number=SeqID_104679
tataggccaggaaaggagaatatagtggctgatgcactatccaggcagttttcattttcagcaatttcaatgatgcaaaaggaggaatgggctgattgggaggaagaaataaaagttgaccctccctcaattatatga

SEQ ID NO: 12995 - DNA, 141 bp, Glycine max
  Peptide Sequence Number=SeqID_104680
atggcctatggtaatcgattaccaagggtaggctgtgtaatcgattacacagaggaacaagccactggtaatcgattaccagtcatgtgtaatcgattacacagtgcattttgcaggttttcacgtcctgaagctatgtaa

SEQ ID NO: 12996 - DNA, 210 bp, Glycine max
  Peptide Sequence Number=SeqID_104681
atgtgtgcaatttttggtagccaagaggctttgagcatgcatgaaatggccccgaggaagcttgcctcaaagaggtccaggaaggataaggcagccgaaggaactagtttcgctcctgagtatgacagtcaccgctttaggagcgttgtacaccagcagcgctttgaggccatcaagggatggtcgtttctccgggagcgacgcgtctag

SEQ ID NO: 12997 - DNA, 399 bp, Glycine max
  Peptide Sequence Number=SeqID_104682
atgtacaaagataagcgggctcaaactttagctcatgggtccgaagtctaccctaaggctcatgagaacccttgggccttctcttgcatctctggcccaatctacttggagtcttctatccaatgccctcatgtagtaggattgcatcagatggcttctaggaaaaaaaaaaggcaccctctacacctacccaacatcgatgttgccattgtgaatgagttctacgccaacctctatgacctcgaggacaaatcacctaagcaggtgagggtgagaggtcattcgattaagtttgatgaggacactcttaacactttcttgaagacccctgttattgtggaagaggcggaatcgctctgtgcttattctagatttgcactcctgaggcctgatccttag

SEQ ID NO: 12998 - DNA, 392 bp, Glycine max
  Peptide Sequence Number=SeqID_104683
agccatcagtgagataccactctggaagagctagaattctaacctttgtgccaggacctacgggccgagggacagtctcaggtagacagtttctatggggcgtaggcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 12999 - DNA, 485 bp, Glycine max
  Peptide Sequence Number=SeqID_104684
caatggcataactaatgagattaccttcacctatcttggcactaaatttgtgttgcatcctcaaacaccttcacaggtgaccaaagaccaactaactatgaaaaataagagggatgaggaagaaaaactagaaaaacaaaagaaaaagcatgatagtaaggccttgtcttcaaaggccaaggggaaggaaaaagagaaaaaggattcctccaagaagattgttaagaaggaaaatcattttgcaacaaaaagtgatatcaaaagagcacttcttcttaaacaatctttgtaccttctcctatcaagggaaacatcccttagcactgccatacttcttgagcttgaggttattccgcaagtaaaggagttattggatgagggtttggttcgtaagagcttaactcctcgtgctttgttggtgcccaaaataggtattatgaggcaccgaatcactatgataggtggtatgatgaatgtgttgagtg

SEQ ID NO: 13000 - DNA, 447 bp, Glycine max
  Peptide Sequence Number=SeqID_104685
atggcttcaaactcccagcaatttagtgctagaagtgatgctattgtcattagaggagtgcatgaagtagccacaaattcatcaggtgagactaagaagcttgaagactctgtggtttatgctcctctgccaaccaccacacagacctttgcccttctgtgcaacaatctgaagcaattgaatagcctgaagcttatgctgcaaacatctacaacaaacctcctcaacctcaacagcaaaaatcagccacaacagaataattatgacctctctagcaacaggtacaatcccggatggaggaatcatcccaaccttagatggtcaaatccttcacaacagcagcagcaacaacaacaacaaacttattttcaaaatgttgctggcccaagcaaaccatacgttcctccaacaatccagcagcaacaacagcaacagccccagaaatag

SEQ ID NO: 13001 - DNA, 456 bp, Glycine max
  Peptide Sequence Number=SeqID_104686
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcagattaattcttctacaatgcttggttataccaagacaaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 13002 - DNA, 339 bp, Glycine max
  Peptide Sequence Number=SeqID_104687
atgcttgttctttcctcctccctaaatccaactctcaaaaggagtagttccatctgtttgtctatattcttcaacactcatactcccttgtctaagcctttggagcttgtccataagctccctttcatagtgggagggaatgtgcctcttcctaagggcactcttaagatcattccaatactctactggaggatccctatgaatctttccttccctaacaagggaagtccaccaatagagggcatacccttgaaagctaagggtagccaatggagctcttcactcttgactaatatgatggcaagcaaagagttgttcaaccttcatttcccaatctag

SEQ ID NO: 13003 - DNA, 102 bp, Glycine max
  Peptide Sequence Number=SeqID_104688
atgggtttttctggaacaggaccattacagcaagtgagggatcatcaccaggaaacagctctcattttatttgattatgatattaacatgcctaggaaatga

SEQ ID NO: 13004 - DNA, 291 bp, Glycine max
  Peptide Sequence Number=SeqID_104689
atgatgcttcagaggcaaattaaagcctctgatgttccaagaggcaatgatcatggattcggacgaggaggaagcctcctcgaccctagttacagctttatgatttcttcctctttggacatcagcttgcatatcctcaatacggttgtcctcctattattcttcacggaagcgactttctattatggagttgcggtttttcttcttatgctagaccgtttaatgagacccaaacagttggatctttctgcaaacaacagtaatactctgagcctacaattggaacaatga

SEQ ID NO: 13005 - DNA, 264 bp, Glycine max
  Peptide Sequence Number=SeqID_104690
ggccctggggtttccagctctggttatgggcctctgtagtcctacagggtgcccgttccccccagcaaggtcacatcatcatagggatcgcgcctgcaagacacccagtggactcgaagaagtccaacagggtcttggagttgtcaagctctaattacgggtctctgtcaggcgaaacaccacagcagcctggggatggccagcagcgggcaacagacgcaccgccatcacctctagagttcacctcagctcatccacaaaaag

SEQ ID NO: 13006 - DNA, 381 bp, Glycine max
  Peptide Sequence Number=SeqID_104691
cacaaccgcggcacctgcgtcctggcagaaagcgccggaggaagcatcgaaggatttatctccgcttacgtgcttgccgacaggcccgacgtgttgttcgtctggcaggtcgccgtgcacacccgcgcacgcggccaacggttaggccgcgccatgctccgggcgctcttgcaacgcgagggcctcgtgcatgttcgtcatcttgaaaccacggtggcgcctgacaaccaggcctcgcgccgcaccttcgccggtctggccggcgagctgggcgcccacgtctccgagcagccgttcttcgaccggcagcttttcggcggcgcggaccatgacgacgagatgttgttgaggataggcccgttcaccttgcccgccccctag

SEQ ID NO: 13007 - DNA, 207 bp, Glycine max
  Peptide Sequence Number=SeqID_104692
atgcatgcacctgactcaacactcagatgcaatgtgcctaagcgtgtccacacgacacttgtggaagcaaagcttcatgatgaatcaacaatgattcaaaggtgttttgatgataacaatgatgacaacaaaagtgatgaacaaaaagctcaagtgaatcaaagaacatccatctcaagtgaatcaaagaacatccatctcaagtga

SEQ ID NO: 13008 - DNA, 147 bp, Glycine max
  Peptide Sequence Number=SeqID_104693
atggagtcaagaatcaccaaggtcgaagaagatagtcgtcatcatcaaaaaggaggagattgtaatcctactccccaagggcattggatagaagactccaagaagattgggacagagatgcaagagaaggccctagggttctcatga

SEQ ID NO: 13009 - DNA, 168 bp, Glycine max
  Peptide Sequence Number=SeqID_104694
atggggcttcgagcaatcaattcgtggggctccggactcaatggtggaggatgcatgaacgaaaatcaattcatggggttccgaataagatatgattgtggaggatgcgcgaacagtgctatgcaatcaattcgtggggcttcggactcagaggtggaggatgtatga

SEQ ID NO: 13010 - DNA, 570 bp, Glycine max
  Peptide Sequence Number=SeqID_104695
atgtcttggaagaggacacattacttctcaatgccccaccacaaaaaccatgattatgaggggccaagacatttatatgaaagtgaagaagcaaaaggggaagaatctagtgaagaaatctacccccaagaagaaggacaaccattagtgattatagagaagtgtaaggaggtaagtgtctcctccaagagtttagctaagaaggaaactcattttacaataaagacaaacattaaagaaactttccctcttagacaacctccacattttctcttttgtaaaaagacacttgctagcattgccacacctcttgggcttgaggttattcctcaagaaaaggagttgttggatgagggtttggttcgtaagagcttaaatcattgtgctttgttggtgcccaaaataggggttcccacggaccctaagagaataaaggtcattcctgaatggcctactccaccaagtgttgagggaaggaatccagagtatgaagaacctcgggatttgaggtcaaatcctctccaaggtggaggggatgatgcaatcctacctccagagggtattggatag

SEQ ID NO: 13011 - DNA, 449 bp, Glycine max
  Peptide Sequence Number=SeqID_104696
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagatgatcctaaggaatctcacttaacagctgtcaaaaggatcattgagtaccttaagggcacaaccaaggttggtttatggtatccccaaggacgcaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 13012 - DNA, 390 bp, Glycine max
  Peptide Sequence Number=SeqID_104697
atggcttcctttcgcgatttggagcagaaaaggtgtgcaaaggttggagcttcaatggtggaggaagaagagataatagcaacgagagagagagggagaaaagcttctgaattttctgaaaatttccaggatgtcacaacacctactccatatctactagtggagccaatccaagtggttgaggtgacgtcatctgaggaagaccccgaggaggacccagaggagctacctcctgagcctgctgtggatgctcttgactttctagagggtgatgaggacccactccctgaggtggattctcccgaggacgtcatgtcagcatctgaggcagactctacggaggagagcggtcccgaagggatagcgactagtggaggttcttcatcatag

SEQ ID NO: 13013 - DNA, 303 bp, Glycine max
  Peptide Sequence Number=SeqID_104698
atggagcataatatcccaaataatcaggcaccaagcaacactcacaagcaagctgatgaacaagatcctaaattcacctttttttatttcaatcgcaaaaataaaccattcatcaattgtctgccaaggatcttcttcatcaatggattcctttgcttcttggaaattaattgtttgcggaatggagaaaggaagagagagaggagacaccacttcaaggagaagatgagtctagaagaagctcaccatcataggaggccatggataagagcttggaggaagaaggagatgaatgaggggtga

SEQ ID NO: 13014 - DNA, 141 bp, Glycine max
  Peptide Sequence Number=SeqID_104699
atgaagggtaaaagaggaagaaagaaagggaagggcaaaagaggaagagagaaaggaaaagtcaagaacggtagtaaagcattgattggtgccaccgaagctccaccgtatataatcaacgctaacgacactcgtgcctaa

SEQ ID NO: 13015 - DNA, 279 bp, Glycine max
  Peptide Sequence Number=SeqID_104700
atgggcgccgtcaagtacttgaccatggatgaattaaagcgcctaagcatccccttagaaatgcttaaatcctttaaccactctattttccctcacaaggcacatccgacaagggttcctctcagtgtggggtttcaacggagaactacgacggttcgtggtggctattggtggttgtgggtggcgaagaagaagcttgggacgttggggaagggttttggaagaaagaaggagaaaggaatggttgttttccaaggctacatgaaaaataagacttga

SEQ ID NO: 13016 - DNA, 408 bp, Glycine max
  Peptide Sequence Number=SeqID_104701
tggaggggcactggtcatcgtgtcaggcgaggaagacatctgtggtcagcatttcctccgtggactctttctctgggcagcctgtctgtccagtgcagcagtaatgatggcccgagttatgttggggaacggttatgaacccggaatgggcggacatgaaaagaagcatcgtgggaaggaagagcagtggtcaaagctcgcgtggagacaagaaagtgaaggtagcccgccctgccacataagcagaagctttataagcgcaggtctggaagacaaaggtcaagtggtcgcaatatgcgaagatgatgttccgagtacattggatttgatacgaccatgccctcctgatttccagctgggaaattggcaagtggaggaacgcctcggcatttacgcaacgagcataat

SEQ ID NO: 13017 - DNA, 330 bp, Glycine max
  Peptide Sequence Number=SeqID_104702
atggtgacaggaaatattcttgatattcctgaagaaaattatatggcaactgagacagatgagggatacatggattcttcattgggggctgacattgatgatttgttagccaatcctatttgggatgaaattttgcaaacttcagttccagaggatatcgataccaatgtggctgaagcaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtga

SEQ ID NO: 13018 - DNA, 204 bp, Glycine max
  Peptide Sequence Number=SeqID_104703
atggtggaggatgcaggaatagcgctaggcaatcaattcatggggctccggataagatttgaggactcgatggcgagacgcagcatcaaagcgctagacaatcaattcatggggcaccagataagatttgagggtggaggatatacgaatagcgctaggcaatcaattcgtggggctccagactcgatggcggaggatgcatga

SEQ ID NO: 13019 - DNA, 255 bp, Glycine max
  Peptide Sequence Number=SeqID_104704
atgtccccttgggcacgcttccgagggtcttcgcgggcgcctcctgtgggatggggaggtttcccttcaaaggtaaggtggcataaagttgggggggtagaccgtaggggtaagcacttcggttgtaccccaaatgcgggctacggaaggaccgagtttgattcagcggcgatgctagcggtggccactgtggttgcattactctctattaatcttttcatacctagcatggcttccatcatggaagccatttga

SEQ ID NO: 13020 - DNA, 258 bp, Glycine max
  Peptide Sequence Number=SeqID_104705
atggcgcttacaaaagctgaaatgtcagaatatctgtttgataagcttgggcttagcaagcgggatgccaaagaactggtagagttgtttttcgaagagatccgtcgtgctctggaaaacggagaacagaaccaacgcccgggacgtaacccgaaaacgggggaagatattcccattacagcccggcgtgtggtgaccttcagacccggacagaagttaaaaagccgtgtcgaaaacgcttcacccagagagaaataa

SEQ ID NO: 13021 - DNA, 348 bp, Glycine max
  Peptide Sequence Number=SeqID_104706
atgaccactcttacatggatatggatgacgttgctatttagcaacactctacccagcgaccataatgccaatctccccctgcagatgtatcagttggaatcgcacccacaaagacacccagtggacccggagaagtccaacagggccttggggtttccagctctggttatgggtctctatagtcctatagggtgcccgttcccccaacaagggatcgcgcctgcaagacacccagtggacccgaagaagtccaacagggtcttgaagtttccaagctctaattacgagcctctatcagttctacggagtgcctgtcgcccccaaaaagatcatcaggccccctactaa

SEQ ID NO: 13022 - DNA, 129 bp, Glycine max
  Peptide Sequence Number=SeqID_104707
tgacgtctcctctctctcttccttctccattctgttgccattcatcttccaagaagcaaaggaatccattgatgaagaagatcctaggcctacaagctcaaatggagcttacataagtaaaactctttg

SEQ ID NO: 13023 - DNA, 423 bp, Glycine max
  Peptide Sequence Number=SeqID_104708
atgaattcattaactagcgcttttcaatcatactccaccaacgagtcgggagccgcgagaattgattgcctagcgctattcgccaattctccattctccacttttattcggagccccatgaattcattgcctagcgcttttcatgcatcctccaccaacgagtctggcggcccgagaattgattaccaagcactattcgccagttcttcattctccacttttattgggagccccatgaatttattgcctagcgctgttcatgtgtcctccaccttggagtcgggagccccacgaattcattgcttggcgaattcgccaattctccattctcctcttttattgggagccccaggaattcattgcctagcgctgttcatgtgtcctccaccttcgagtcgggagccccgggaattgatcgcctag

SEQ ID NO: 13024 - DNA, 117 bp, Glycine max
  Peptide Sequence Number=SeqID_104709
atggacccaatttggtcggagccgcagagacccttcgtgggaggatgtgcgaaagaaggcacaggacattcagaaacaaaacactgcccctcacgtgttgtctcgtgggggttatga

SEQ ID NO: 13025 - DNA, 330 bp, Glycine max
  Peptide Sequence Number=SeqID_104710
atgatacataatgaacatattgtggaagaaccacaagaagtagcattaaggaggtctcaagagaaaggagaccaactatttcgaatgactatgtggtatacctatatgaaacagaaagacttaagcattaatgataatgatctaatttcattttcacaagctggttgtaaaagagttggttgtaagtgggtcctcaagactaaacgtgactttcctgacaaacttgaacattacaaggttagacttattgctaaaggatttactcagaaagatgacattgagagacgttttcactggtctcatgaaaggattatttcaggattatcatga

SEQ ID NO: 13026 - DNA, 538 bp, Glycine max
  misc_feature (26)..(26): n is a, c, g, or t
  Peptide Sequence Number=SeqID_104711
cgccacgcttcccgaagggagaaagncggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagaagtgggtatcatcatggactccaagaccggggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13027 - DNA, 447 bp, Glycine max
  Peptide Sequence Number=SeqID_104712
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccacttttgatagcgactattgcgcttctttggattctcaccgacactatgcagcctgttatcaattatcaagcttcagccagaacatggccccctccccattcggttttctttgcttga

SEQ ID NO: 13028 - DNA, 237 bp, Glycine max
  Peptide Sequence Number=SeqID_104713
atgacaaccaaccaatccgctcagtccttacctggtaccggcgcgccgccgcaaaaagcgcgcacctcatttggcatcctgggggcaatcagcctttcccatctgctaaacgacatgatccagtcgctcatcctggcgatttatccgctgctgcaggcggaattctcgttaactttcgtgcagatcggcatgatcaccctcaccttccagctgacgtcatcgcggggatcctctaga

SEQ ID NO: 13029 - DNA, 495 bp, Glycine max
  Peptide Sequence Number=SeqID_104714
atggagacgcttgaaattgaacccaggaagatctcgagaaattcaaatggtcataacttttcacacagaggtccgattcaggagcatcatatatcgagaccctcgaaacttgaacaacggaagctctcgagaaatttaaatggtcataacttttcactcggatgtccgattcaggcgcataatatatcgagacgcacgaaattgaacaagggaagctgtctgagaaatttaaatggtcataactttgcacacggaggtcagattcaggctcataatatatcgagacgctcgaaaatggacaacttaagctctcgagaaattcaaatggtcatacctttaactcggaggtctgattcaggcgcatcacatattagactgtttgcgaaattgaacaacggaagctctcgagaaattcaaatggtcataactttttacacaggaggtccgattcaggcgcataatatatcgagaccctcgaaattgaacaacggataa

SEQ ID NO: 13030 - DNA, 732 bp, Glycine max
  Peptide Sequence Number=SeqID_104715
ttatatagtgtggagagtcaagaaatagaaagtagtatagttgatgcttcagctgcttcaagaaaacgtagaagagatgaagaggaggaagaagaacttgaacaagcatttttcattattgttagtgttgccactatgcttttgggtgcaatgacttggtatcataacaagtactttgttaaggaacctgctcaaaatttggaattagaaaggcatagcttcctcaatcgtctatatagaggaacaaaaactgattgcattgaacaattaagggtcaacctatgtgcaaaggataaagctactggatttagagcaaaaaatgcattagatgcagatgctatcatgagtaaagaagcaaatgaagaggaagcaattcacagcgtgagtattgacttagagggatcaagttctgccacaaggaaaaacattcacccaagtaagagtggagagaaagaagggatgatttcctcaatgaaagaagtagtcgagtcattgaaagaatttgttgaagtgattaagaagaagatggagaacaaaaaaaagatggagataaaagaagctcaagaagtgatacatgaagtggtgaatgagctagataatatacctaattttaatggtgcacttcgacatagagaaatcgattggttgacagaaaatcccattaagtttgagattataaaagctcttccattgtatgagaaggaggatcacatctcgtcttttatgccttga

SEQ ID NO: 13031 - DNA, 144 bp, Glycine max
  Peptide Sequence Number=SeqID_104716
gagaaagggagctcagcggcaagaggattgtaacatgagagaagcaaggaggtcaaccctttttcaaatatacaacatgggttctggcaatgcaatgtggttggactctcatgtcgatctgaatgaatcatcctttccacggag

SEQ ID NO: 13032 - DNA, 348 bp, Glycine max
  Peptide Sequence Number=SeqID_104717
atggtagggaggccattgcaaatcatgcgcaccaacatgatgactttccttctcagtaatatccttccaagtgaccacaaatttgatcttaccctacctaaatatcagctggtctacaacattacggagcagatcaatgttcatgtggcccaactcatttcagatgctatccatcattttgttggtattgagcctcctaggcacctaccagagcaagatcagcaacattatttcattgaggaggcaggacctgcaagcgctcaaggagatgcccaaggagatggagggagagttgaggatgatgaagacatggcagatctggttgattatttcattggaggagactga

SEQ ID NO: 13033 - DNA, 207 bp, Glycine max
  Peptide Sequence Number=SeqID_104718
atggatgttgtgggaaaaggtatcattcgtatgcaagtgagtgaacttactcagacaattgctgatgtctattatgttcttgaacttaagaataatcttgtggaagcaatgtcttctaaggttattttgatgatgccaaagaatcaagagttaagcaaattccaaagattcaagaatcaagtttcaagaatcaagattcaaggataa

SEQ ID NO: 13034 - DNA, 288 bp, Glycine max
  Peptide Sequence Number=SeqID_104719
atggtccttacttttcactctgaggtccgattcaggcgcataattgtcgcaacctacccttcagcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtatttctcaatttgggatgagaaaatcagacctacgtag

SEQ ID NO: 13035 - DNA, 408 bp, Glycine max
  Peptide Sequence Number=SeqID_104720
atggcttcgaggaaacgcaaaagtattggttcaagatccacaacacaatatgatacaaggagattttcctctttagatgctgggaaccggtacacagataatgtcttggggagaaacatcttgcctgagaggaaggtagagctctatcacactgagctagatgattttaagactgaattggagaggcgtaatttccataaacgcctcaccaatttggttgatgggagcatagacttggctttggtgaaggagttctatgcaaacttatacagctctgagggcccttcaccaaagcaatccagagtcagaggccatttagtgaagattgatgctgacagtctcaacacattcctagagacacctgtggtattggcagagggtgagacattacccacacactccagataa

SEQ ID NO: 13036 - DNA, 784 bp, Glycine max
  Peptide Sequence Number=SeqID_104721
gtcgactctagaggatccccggttgccagtggcggcagcgcatcgctgggccgtggcggcgtcggttgcggccagaccgaacgaggtatcgcacggatcggtgaagtactcgaaggactgcgagctgccgccgtacaggtcggcgatggtcggcgcgcggaagccctcggagtaggtcgcacgaaccagcagctgatcgatcgggcgccacttgaagccgaacttgctgttggtcgtgttgccgaaggtgctgaagtcggagaagcgggtggctgcgctcaggctcagttccttggcaccgggcaggtcggccaggatcggtacgttcagctccaggtacacttcattgacgtcgtacttgccgccggtcgggccagccgccaggtcggtggagtaacccgactgcgacagcgcgtccggattgaagttgcccttctcctcgcggtactcgtaacccagtgcgaagcccaggtcgcctgccggcagggtcaggatgctgcccgcaatgttggcgtagtaggacgtcatcgtggtttcgccgacgttgtgcgtcgtcgggaacaggaactgctgcaggtccggattgccggtcaagccgccatcaccggtgcggccgaacggaatggccgggttccacgggatgcagccgccggcgccggggccgtaggccgggttggtgcccgcagccaggcccgctgcggttccgcactccacgcggccggttgccgggttgtagaacgaggccccggtggcggcgttggcagccaggacgttgtagttgccg

SEQ ID NO: 13037 - DNA, 401 bp, Glycine max
  Peptide Sequence Number=SeqID_104722
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccatgaactagaaacagccatgaaggagtatggtatgggcaacgaggccacaatcagggaaattatatctgaagttgacacagataatgatggtagaatcaactatgatgaattttgtacaatgatgaggagtggaacccaacaacaaggcaagctattctaa

SEQ ID NO: 13038 - DNA, 351 bp, Glycine max
  Peptide Sequence Number=SeqID_104723
atggtgggttacacaccttcaagctttgcggatatggtcttcactgacgaaaggatcaaagtgggtctaaaaagaggcaaatctgatcatcatgctttgataaatgcaaaaaaaactgggacaaatgaagagggtgagaatgagggagaagcccatgctgtgactgccattcctatacagccaagtttcccaccaacccaacaatgtcattactcagccaataacaaaccttctccttccctaccacccaattatccacaaagaccatccctaaatcaaccacaaggcctgtctaccacacaaccaatgctaaacaccacctttagcacgaaccaaaacaccaaccaataa

SEQ ID NO: 13039 - DNA, 213 bp, Glycine max
  Peptide Sequence Number=SeqID_104724
atggggaagagaaagctggagttaggttttgaagaccagaaaattgatttcgacttgtttgtggaagacaagcctgctccaaaacacaatgtttgcttgcaggtaatgggagaaggtcaagaggttctgaagcgcctgcttcttgctaagcgcataatcacacatgcactaagccacgagttcaagcgcttagcgcaccaccctggaacctaa

SEQ ID NO: 13040 - DNA, 219 bp, Glycine max
  Peptide Sequence Number=SeqID_104725
gaagtagctacatgggaaatcaacaaagacaggaaacaaccaaggaggatctcaggtttcctacaaggttcctacaatcagcaaggaaaatggagatcacaccgtggtaaccaattcaataaggaccagggtggaccttccaataggccacctcaacaagggcctaatatctttcagaggactaccaaactggaggaaaccctagctcaattcatataa

SEQ ID NO: 13041 - DNA, 441 bp, Glycine max
  Peptide Sequence Number=SeqID_104726
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaccattcctcaatacacaatggacacgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 13042 - DNA, 222 bp, Glycine max
  Peptide Sequence Number=SeqID_104727
atgaggaatgctcatgagaacccaagggtcttctcttgcatctctggaacaattcaagaggaaaagttgaagaacacttcaagattcaagaagaaggatgaattcaagaatcaagattcaaggatcaagattcaaggatcaagattcaagaatcaagatcaagattcaagaatcaagatcaagattcaagattcaagactcaagaatcaagagaagacttaa

SEQ ID NO: 13043 - DNA, 264 bp, Glycine max
  Peptide Sequence Number=SeqID_104728
atgacaagcgcaggaatgatatgtccattacatgccatgaagagatgcatgatgcgatcaaggaacaagctagagaacctaacggaaaggatccaaaactccacttctagtgatagttcccaagggtggtttcatgtaactttactggcttctagagatatcatcctcttagatcgacctccactccttaaggctcacatagacctgggtatatggcctaatatctcaacgtgtgtgcgcagtgtaggtgccatatctgcatag

SEQ ID NO: 13044 - DNA, 199 bp, Glycine max
  misc_feature (19)..(19): n is a, c, g, or t
  Peptide Sequence Number=SeqID_104729
atgttcctccagaaagagnttgcttctggaggaagcaacctggctcgcctgggcgagctgggtggcaagctcctcccttatttccctataaatagggggaggagtgaaggagaaaggggttcagctcttctgattttcaaccgttcttcatcgttcgtcgttcgtcgttcgttcttcatcgttcttcggtcttcaatcg

SEQ ID NO: 13045 - DNA, 138 bp, Glycine max
  Peptide Sequence Number=SeqID_104730
atgggtttgtcaggcttaaaggagcactcaaacccggtgacctccaaggcctacactccaaagagtccgtcagggcctctccctcctgattcaggtccaacccctaaaatattttttgcatgcagacactgctcatga

SEQ ID NO: 13046 - DNA, 837 bp, Glycine max
  Peptide Sequence Number=SeqID_104731
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccccgacgctgccgcttccctcgtctccctcgctcgcgacaacgaccgttacgggaaactcatcatcgaagaaggaggcgtgccaccgctgttgaagcttctcaaggaaggaagaatggacggtcaggaaaacgctgccagagccatcgggttgcttgggaaagatcctgaaagcgtggaacacattgtcaatgctggtgtctgttccgtgtttgccaaggtcctcaaagaaggccacatgaaggttcaaacggttgttgcgtgggctatttctgaactcgccgcgaatcacccgaaatgccaggatcatttttctcagaacaatgccatacgcttgctggttagccatctggcgtttgagacaattcaagagcatagcaagtacgccattgcgaacaaacacaaatccattcactcggttttaatggcgagtaacacaacgagcgcgcaggaagaggaagatgataagcagatggtggctcacccgggggcgaatcagtcagccaatctgatgcacaacgtggtttccaacacaatggccatgggtaccgagctcgaattcgtaatcatggtcatagctgtttcctgtgtgaaattgttatccgctcacaattccacacaacatacgagccggaagcataaagtgtaa

SEQ ID NO: 13047 - DNA, 582 bp, Glycine max
  Peptide Sequence Number=SeqID_104732
atggactccaccctcatctccgaacgacccggcgaggagaccccttcgctcaatcgtgcccgtcgcgccgccctcggcagcttcgcgggcgccgtcgtcgactgccccgcgatgggcaccctcgccgcatttgccaccttcggcgtcgggttcctgtttcgtccgcttggtggggtgatcttcggccacttcggcgaccggctgggccgcaaacgtatgctaatgcttaccgtctggatgatggggattgccaccgcgctgattggcattctcccttcgttttccgccattggctggtgggcaccgatattgctggtgatactgcgcgccatccagggcttcgccgtaggcggcgaatggggcggcgcggcgctgttatccgttgagagcgcaccgaaaaaccggaaagcgttctacagcagcggcgtacaggtgggatatggcgtggggctgctgctgtcgaccgggctggtgtcactcatcagccattacaccaccgacgaacagttcctgagctggggctggcgcattccgtttcatcttcagcatcgtgctggtcattgccgcgctgtggatccgtaa

SEQ ID NO: 13048 - DNA, 402 bp, Glycine max
  Peptide Sequence Number=SeqID_104733
atgacatgcgacctttctttggtccttgtgaggtgcttggcacccatcattaggcaatttgagaattccgggaacacaagtcatttgcatgtggagattttacggtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 13049 - DNA, 597 bp, Glycine max
  Peptide Sequence Number=SeqID_104734
atgtggtatgatgaaagagtctcaaaagataaaagaactacaaatccaagattcagtttatgttgtggaaatgacaaagttgaacttccattgttacagaatccacctaaatatctctaccaacttttgtatgatcatggtacatctgatagtaaaaattaccaacagaacataaggacatataacatgatgtttgcctttacttctgctggtattaagttttacaaatcaattaatcattcaagaggacctcctacaataagaattcaaggtcaaccatgtcatagaatagatagtatgttaccaatgcctgggaaagaaccaaaatttgcaaaattgtatatctttgacacagaaaatgaagtgcagaataggattaatgcaataagtccacataatcaaattcaagaacacattgtttcacaacttagtgagatgctagatgaatacaacgtgcatgcaaaaactttcaggatggccagagatagattgcaagatgttcaagtgaataatatcaagttgaaattgattgctaatcgtgagaaagatggtcgtacatataatgtacctattgttcctgaagttgcagcactaata

SEQ ID NO: 13050 - DNA, 339 bp, Glycine max
  Peptide Sequence Number=SeqID_104735
atgtgggttcaaatagcaaccagacccacttgggccctccagaagattcctccagaaggctgttgcttctggaggaagaaaccttgctcgcctgggcgagctgggtggcaagcttctcccccatttcttataaatagggggagaagtgaagagaaatttcgttcagccctcctgctgaggcgcttccgtaacgtttccgtgggtgatttcgcgaaggttttcaaccgttcttcgacgttcttcattcgttcttcatcgttcttcggtcttcaaccgtggtcctcatttgcttttacgtgctttcatttactttccgtacccccttttgacgtgctttag

SEQ ID NO: 13051 - DNA, 659 bp, Glycine max
  Peptide Sequence Number=SeqID_104736
gagataagagcttgggacttggcgatttcaacttcaaattcatcaaggaattttgggagatcctcaaaggagatttcttgagactaatgattgagtttaattctcaaggggtcttaccaagaggagtcattgtgaaagtactatccattaggttgagaatggtcattggcaaagttattgatgagaagcaaagtgcttctgggtttgaggtaaggagatcctttggctccttttttgttccttatggtggtcaacggattatccggtcttatgaggcaaagcttgatgaaaaatctattttcagggataattgtggatacaataccgttgtgaataattttgcgtctctcctaaattgcaaaacaatgtcaatctcattcatctatctggggattccgttaggggaaaatcctaagaggaaaacaacatgggaaccggtgatacaaaagattgaaaagaagcttaatctctcgaagtgtaaaactatgtttcctgaagagagagaaaaagtaccacgggttaaatgggagacggtattaggaattaggaatgttcggggcgaatgcactcttggggagaagtaccctcagctttttgtgaattcggagcaaaaagagagcactacaggggagagtggcgagtgggtggaaggagtctag

SEQ ID NO: 13052 - DNA, 267 bp, Glycine max
  Peptide Sequence Number=SeqID_104737
atggttaaagttgtctctagaatatgtccattggatttaatgatgaaatatgtgcaatttcagttgaacttagctcatcagtgggctaagcgcgcatccaccgctaagcgcagcttcagcacgcttagcgcaacagaagaatttggcaaggcatcaatatcaaggccgcgcactaagcacgagatcaatgcattaagcacaacagttgtcttcagccaggctcagcgcacgactggcgctaagctcaaatccacttactctcgctaa

SEQ ID NO: 13053 - DNA, 246 bp, Glycine max
  Peptide Sequence Number=SeqID_104738
atggagttctacgtgaatagtaccatgcgtgaacagagttttgatgataacaaagatgatgacaaaaagctcaaaagtcaagatcacttcatgataacaaagatgatgacattcaagaatgagttcaagattgagtcaagaacacttcaaggatcaagaggaaatttgatttcaagaatcaagattcaagactcaagattcaagaataatcaagatcaacattcaagactcacgattgaagaataa

SEQ ID NO: 13054 - DNA, 1224 bp, Glycine max
  Peptide Sequence Number=SeqID_104739
gcgtcgcgcgtggtcacggtggatacgctgccgccagcgattacgctcgataatctgaccgccgacaacatcatcaacgcggctgaggcgcagcaggatttagccttgagcggcaccagcagtgcggaagcaggccagacggtcaccgtgacgctgaacggcaaaacgtaccagaccacggtccagacggacggtacctggcagctgatcgtaccggcggctgatgtcggcgccctcaacgatggcatcgtgaccgtgacggccaccgtgagcgacgtggcgggcaacagcagcagcgccgaccgcgtgggtctggtggacgcgaccgtgccgcaggtgaccattaacgactttgtcaccgacactaacaccgttaaccagctcgcccattcacaggcgcagatcctgagcggctccgtcaccggtgcggcggcgggcgaccttgtgaccattaccattaacagcgtcgattacaccaccgtggtggatgcggcgggcaactggagccttggcctgccggcgtccgtcgtgcaggggctgacggacggcacctggaccatcgacgtctccgtgaccgacaggtccggcaataccggaagcacttcgctggacgtggtggtgaataccgtgacgcctgtcatcggtatcaacacgctggcggttgacgacgtgatcaacgcgaccgagaaaggccagaagatctgcagctatacggcaaccaccgacgcgagcgggaactggagcgtgaccgttccggcggcaaacgtctcggcgctgggcgaagcgagctacaccgtgacggcgagcgtgactgacgccgcgggcaacagcgcgagcaccggccacagcgtgctggtcgacagcgcgctgccgcaggtcaccatcaacccggtcgccacggacgatgtcattaacgccgcggaagtggctgccggacagaccctgagcgggaaagtgagcggtgcggcgagcggtgacactgtcaccatttccatcggcggcaatatctatactgcgacggttcaggacgatctgagctggtcggtcaacgtgccgtcctcggtcttaaccgccatcggtaacggcgatctgacggtgtcagccagcgtcaccaacggccacggcaacaccggaaccggcgagcgcgacatcagcatcgacgcaaacctgccgggcctgcgcgtcgataccgtggcaggcgacgatgtgatggggatcctctag

SEQ ID NO: 13055 - DNA, 420 bp, Glycine max
  Peptide Sequence Number=SeqID_104740
atgtgtatacacttgaagggtgaatgctgtgaaagttttcccgaacgcccaaaatggactcggatgaatgcacaaattgataaaagaacatattttggaaacactgggttgactaaaccattctacaagccttgggccaaaattccaacttaccgtaaagcttgccctcggaagaaaacaaaggaaaaaaagttcccaatcaaagaatcggaagaaagcaaaaggagaaaattcccaatcaaagagtgggagaaagcaaaaacacaagagaaagaaaattcccgatcaaggatcgaaagaaaacagaagaaatatgcagaaaggtctttggaccagacaatatctgaacaatacagaattgtcacccaagtaaacagaaaagaaaggaaaccacgacctaaagtgatcctctccctttga

SEQ ID NO: 13056 - DNA, 607 bp, Glycine max
  Peptide Sequence Number=SeqID_104741
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgagaagagacatataggaatcatcatatcggaacatatgcacaaaaggacaaaaagggtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13057 - DNA, 307 bp, Glycine max
  Peptide Sequence Number=SeqID_104742
gaagcggaagagcgcccaatacgcaaaccgcctctccccgcgcgttggccgattcattaatgcagctggcacgacaggtttcccgactggaaagcgggcaggtcatacaatgctcaatggaatgcctcagaacttctccatgataagcacatgttgcattcgagttgtatcctcaggaaaatggaggcttcttttctggaaaattccttccttggttggtgttttggtttgtgttaagggtggggtgacctttatggataattggatgttcttggctgatagggtggtggataatgagaagggctga

SEQ ID NO: 13058 - DNA, 435 bp, Glycine max
  Peptide Sequence Number=SeqID_104743
atgtctgaagaagttgatatggatgtagaaaatgaagacgaacctggtgtgaaatcagaacatgttgattgttctgatgtgttcaaatcttataaggtgtttgctacctatgataatattttgaatagggctcgagttgttgcttacgaaattgcttttgtagcagtgattatgaggtcagacacaaatactaatatgagagaaaggacattatttgtcttaattggttgtgaaaggagtggtcagtatagagtcaggaagaaagatttgtcaatggtgaaaccaagaaatattctgctaacgttgaaggagcacaatgtcaataattatacaacaatcaaacaagtatacaatgcaagaaatgcatatcattcttccataagagacaataatactaaaagacaacaactaattaagcttcttgaacgagattag

SEQ ID NO: 13059 - DNA, 243 bp, Glycine max
  Peptide Sequence Number=SeqID_104744
gcaattcttggtggtgaagctccttcttccttggcttattccctagtggatggtgcctcccctatcctcttctcctttgccttccgctgcatctccatggacgaggaacttaggggaagtagcaatgggcccatcgacggttaccgtaggtggttgaaagcctacacacaaggtctggattggcttccaaatttgagaactactaaagcggtggagggtgaagctccagaagaagacgaagag

SEQ ID NO: 13060 - DNA, 309 bp, Glycine max
  Peptide Sequence Number=SeqID_104745
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggggatgcccttgctcctacgtatcctcaagtgcgatgaggaatttagacctacgtag

SEQ ID NO: 13061 - DNA, 339 bp, Glycine max
  Peptide Sequence Number=SeqID_104746
atgttcattaagaccaaaatctcgactgagatacatgattctgtgaatcagcatgaaaaggttcgaaacttgcttaaggttattgatgaccagttcatcactttagataaggctttaacaaacatcctgatcatgaagttctcctttctccagctcactagtgtgaaaggtgtacaagaagaaatacttgttatggagatgggtgagagtgcattgttgacatctgcttgtgggaagaacaaagcaactaagtctcaagctaatcaaaaggggaatggtaaaataccacctcaagatgatattaagaaggtgatgaagtgtttcttctataagaagtaa

SEQ ID NO: 13062 - DNA, 290 bp, Glycine max
  Peptide Sequence Number=SeqID_104747
tttcacaatctacgaatatttcttgtgaccttcccatattgaaaggtgataattataaggtttggaaggaaataattctccttcatttgggctggatggataataactatgctataaggaggaatgagccaccgggtattactgaaactagcgaacctgatgttgttgacctttatgaaaagtgggagagatctaatcgtctctccgttatgttcataaaaaccaacatatccgctagtatctggggttcatttgaccagtatggtcagagatctgttgaaagccattga

SEQ ID NO: 13063 - DNA, 508 bp, Glycine max
  Peptide Sequence Number=SeqID_104748
cggatgccgggagcagacaagcccgtcagggcgcgtcagcgggtgttgccgggtgtcggggctggcttaactatgcggcatcagagcagattgtactgagagtgcaccatatgcggctgcgcaactgttgggaagggcgatcggtgcgggcactcttcgctattacgccagctggcgaaagggggatgtgctgcaaggcgattaagttgggtaacgccagggttttcccagtcacgacgttgaaaggatgggttaatcatgggataaaaggtgctgaatcgattgctgaccatatgtaccgcatggctttaatggcattgattgctggcgatgttccaggattgaatcgagaaagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 13064 - DNA, 303 bp, Glycine max
  Peptide Sequence Number=SeqID_104749
atggctcaggagcggacatggatgtcttgtgtcttgttggaacaagtgcgaaaccaaccaaacacagagggcgggtacttctgtggtaggcccgctatgccgttccgagtctcttttatggagtccaaacctcttgctgaatccttgaccacagttgcaattctgctcaaagaggggagacacccggaggaaagatatggttttcttcccccgagaggacatcctagaatttcctcaaattcttcaatggttggtactaattggaagtctccgaatgtgaagcacctcaaaggctggtcgtag

SEQ ID NO: 13065 - DNA, 279 bp, Glycine max
  Peptide Sequence Number=SeqID_104750
atgtcattgcctagcgctgttcatgtgtcctccaccttcgagtttggagctatgcttcatgattgcctaagtgtggaccctcaagtgcaatcctccattctcccctttttttcggagccccatgaatgtcattgcctagcgctgttcatgtgtcctccaccttcgagtttggagctatgcttcatgattgactatgtggaccctctagtgcaatcctcctatcctcgcctttttcggagccccatgaatcctagcgcggttcataaaaagaaggagtag

SEQ ID NO: 13066 - DNA, 574 bp, Glycine max
  Peptide Sequence Number=SeqID_104751
atgagtcttcagtcttcatctagtgttaatggtgagggttctactcctaaggaccccttgtataagatatcagatgagttgagatcccttaagttgtggaaagaaaaacaagagagaaaagaaaaagtaaaaaaaagagtggaagaaataagtcaagatgaaaaagagaaaataagggaagaagaaagaaggaaaatactaagagaattaagaaaagtgaaacatgcctcctatagtagtcaaaactcttgcaagagcccaagtgaagaacttcgtgactattatgaaggaaggcatagggcacatcttagaactcactctcattggagagaaaaggaaagaaagcctcaagaggctaacattaacctcccatacttccatgggaaagacaatgaggctaacttagatcggaaaataagggtagagcaacaacttaaaaggaagtctacttcaaaatcttatggttctcactcttatccaaagaaagaccaaggtcaaggcatcttaggggtgacaacttctaagcccaaaaatgataaggggaagacaatagaaaagcagccccttaaggcta

SEQ ID NO: 13067 - DNA, 300 bp, Glycine max
  Peptide Sequence Number=SeqID_104752
atgtataatttccttaaaccttatgagagacacgtgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 13068 - DNA, 213 bp, Glycine max
  Peptide Sequence Number=SeqID_104753
atgccgggtcacggattatcagactggccacctggagtgatggctggacggaatgatcgtgcgatagcggatgccgttcaagccttagctcaggctatagggaatccgaatagaggagaagttggtggagctgttgagtaccaagggttggatcgcttcgaacgaaacaaccctccttcttttaatgaaggatacaaccctgatggtgcttag

SEQ ID NO: 13069 - DNA, 423 bp, Glycine max
  Peptide Sequence Number=SeqID_104754
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctgtcattcgcgactccacgcatggcagctgtagcctcgtccgtcatggcttcaggggtagcaaggtcttgttgcgctccctggttctccatctgcaccatctcaatcgtgaaaggctagacatgtctccttatcgaggttgcgttgaagccaccatcctccaccagtgttcgactggcttccatgagcggcgtcccgacatcgctaacatctgtagctatttcttccgatga

SEQ ID NO: 13070 - DNA, 207 bp, Glycine max
  Peptide Sequence Number=SeqID_104755
atggctggatacaagcctgacactgattatgttcagcaagatgttgaccaagaggaaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtga

SEQ ID NO: 13071 - DNA, 702 bp, Glycine max
  Peptide Sequence Number=SeqID_104756
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggacattaaagctaataagattcagcagctgaagcagaagctagctaatctggagaatattgcttcccatagaactctatctgaaagtgaagttcagaccaagagagccttgcaacaagaattgtgggatactgcaaatgcctatgaatccttgatgagacagaagtctagggccaaatggatcaaggaaggggaccgtaattcagcttattttcagggtaccgagctcgaattcgtaatcatggtcatagctgtttcctgtgtgaaattgttatccgctcacaattccacacaacatacgagccggaagcataaagtgtaa

SEQ ID NO: 13072 - DNA, 405 bp, Glycine max
  Peptide Sequence Number=SeqID_104757
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtagcttgggccagcactacacaggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 13073 - DNA, 855 bp, Glycine max
  Peptide Sequence Number=SeqID_104758
atggttgatcctaaaaaagtggaactttctttatattcaaaaattgaaagacattatttagcaaaacttccggatacggatgatgccatcataacggacaccaataagaatttaaaagagtacaataagaaatttgctgaaagaaaactaaatcctgaaaacggacaccgttacttaccatacatcgttctggtggttgacgaatttgccgatttaattatgacagcaggtaaagaagtagaattaccgatagcaagactggcacagctggcaagagcggtaggaattcacctcattgttgctacccaaagaccttccgtaaatgtaattacagggatgatcaaagcaaacttccctgcaagagcagcattcagggtaatttcaagtgtagattcaagaacaattcttgattctaccggtgctgatcagctgattggtaagggggatatgctttactttaacggaaatgaaattcttcgactgcaatgtgcctttgtagatacgcctgaagtggaaagaattgcagaatttattggcgagcaaaaaggatatgcttctgcgtttcttcttcctgaatacgtttctgaagatgcaacaagttcagtaggttctttcgatcctaacgaaaaagatgcactgtttgaagaagcagccagaattattgtttctactcagcagggatctacttccatgcttcagagacagcttaaattaggatataacagagcgggaagaattatggaccagctggaggctagtggtattgtaggaggctttaatggcgcaaaggcaagggaagtgattattagcgaccttcattctttggaacagtttttggaagatttgcgtaaataa

SEQ ID NO: 13074 - DNA, 207 bp, Glycine max
  Peptide Sequence Number=SeqID_104759
atggccgatattcccgacacgcaggaaggcgatatcggggcgaaagatgttccgtcctggcgacgcgtgtgtaaggtattactcaataatgactactggtgtcgggcgctttcattcagtcctaataaacctaagcattatcagcgttacagcgaacggataaagtcaaaacgcaaggagtggggaatattatgcagcaacgattga

SEQ ID NO: 13075 - DNA, 225 bp, Glycine max
  Peptide Sequence Number=SeqID_104760
atgaatgttcttcgtataggaaaacttatgagatggcacgaaaaacttgtattccaaacattcttgatacaaccctacccctcaagggcattggatagaagactccaagaagattgggtcagagatgtaggagaagaccttagggttctcatgagccttaaggaattttcagcccttctatttagggcacctagagtagcttttgtatcaggggtagttttgtaa

SEQ ID NO: 13076 - DNA, 604 bp, Glycine max
  Peptide Sequence Number=SeqID_104761
catccagatgatcatctggatcagtggttccatcgtaccactcaaggttgagtggtttccaacctatgggtatgtcagcttccatgatgcggtcgacaaagggggtgtgattccctttgagtgtgctcatgcattatgtgggaagagtgctcgtcaccctgaaggcgttgtactcaaacctccatccgatcgtgtatatatcatggctattggaggaggattaaagcctttgaaaaaggtctcgcatttaaggccagaccgtgtgctaaccatggttgaaatggggaggccacgaggcaagttttaccatggccccacagtgggcgccaaatgtacttaccaaaatctagagctatttcacgtcagggtggatgtcgctaaggagagtaagagtaagaatgaaaatggtgagatggatcctggtacttataaagtagagtgggagttgcaggtgtttgtaggggttgttatgggatttggattcaaattaggttggggaaagagaaggggtggaaggtgtataaggacgagggcacctgatggtgagggcacacgagggaaagtgacagtgaaggttagcacgagcacgagagccacttgctag

SEQ ID NO: 13077 - DNA, 1093 bp, Glycine max
  Peptide Sequence Number=SeqID_104762
ggtcgtctccatcggcggttcctcctcggaggagactcgccatggggctttcgatagcaagtccgcttcctcaaagagtgtgacggtcttgtgtcgtgctggtggaggcacttctcacctccgcgggagggtgcaaccttccactacttctccagtttgggaacttgttctggtcaccatgattcttcccctagtggtggcggggacgttaaggcgttccctcgtgtgcaatgtagccatagtgttgggttgccctcgtcccccttgccgttgccgggcgacatcgggcaattcgcccttcttttttatgtacatgtgtatgttcaaggtcttgagtcaagttctctcctggatcactttccagcatgctctgcttgagcacttgaacatggccccttctcaactccaccccaatagttgggccatggtgaaagcctttgagattttgtgccccttcttcaatatccgacccagtgtgtcggaccatttctccaagatcccggctattgtcattgtgactgatggcctgccattaacgttcaacagagaaggggagccctatttctcgttctactggaaattcgaccccaccaggttcaagtcgtttgatgaggatctattgacccttgttgagaaggtcaacaaagctatattgaagtgccagcctagactaacacttgttgtgttgttgctgcttattttgcatggaagaggtcaacttactgttgaggttggccttgcttctgaagtcgttgaggtcttccccaatattccttcctctcttttggctaagaggaagagagatgacggtgctgggacttctgctcttgcttttgctattgttccttctcctccacctccacctactgtggttgttaaagaggttgctcctactgctaaagtcagtgcaccagccacttttgctagtcttgtcgtggcaccttcatccaccgtcactgcacccttgttcagtgccaattttttgacaacaagtgctctagaaatgtggcctccttcttttttcggtccactagttcctgacttccacctcttatcacccccatgtttctgtggatcacatctacacctctag

SEQ ID NO: 13078 - DNA, 579 bp, Glycine max
  Peptide Sequence Number=SeqID_104763
atgtactcatcaaccctttgggttagccctgacacaaaagcacaaatgatgtgcctttttcttacttacctaactcagatgtgcaacccttttcgaaggctccaattctcctccagcaaccatgacagatacaaatactctccaacaactccaaaaccgcattatggagatggagcgagccatgaggaggaacttagaaagctaaaagctggccatgatccattagaagcccatgtcaaatgccctcagggcgacgagcacttcactcacatattgcctgagcgcactcaaggggaatcaccccctcaacacacaatcaacactcaagatgatccatgtctctcccacatacactgtgctacagaacgaactattcatcgacgcccctttgtcgactgcatcatggaaactgacataaccctaggttggaaaccactcaacctagagcgatatgatagaaccattgatccagatgaacatctagacgctttcctcacccaagtgaatctatacaccaatgatgatgcaatcttgtgttgtgtcttcccatcgtcccttaaatgggtgacattgacctag

SEQ ID NO: 13079 - DNA, 404 bp, Glycine max
  Peptide Sequence Number=SeqID_104764
atggcttcccgtaggagaaaagcaacagctttagtgtcccaggctaggtatgatagatcaagatttgtatcccaagatgcctgggaccgctacatagacaatgtccttggccggaagatccttccggaaaggaatgtgaagttgtacattacagaatttgatgaattcaggagagaaattgagtggaggaattggcataaggaggtcactaacttctctgaagggagcattaacgtggcattagtgaacaaattctatgccaacctttatgaccttgaagataaatcaccaaagcaggtgagggtgcaagggcacctaattaaatttgatgatgacgccctcaacacctttttgaagacaccagtggtcatcaaggaaggggagagcttgccctcttactccag

SEQ ID NO: 13080 - DNA, 216 bp, Glycine max
  Peptide Sequence Number=SeqID_104765
atggatgcgtcgcaggtagactctccaaaggcttgtcaaacccaaggtccacccttggtgattcttgcatctctaaaggctcgtaaaacccaggtgatgcaatcctaccccgcaagggcattgggtagaagactccaagtagattgggctagagatccaagggaaggccctagggttctcatgagccttagggtagatttcgagcccatgggctaa

SEQ ID NO: 13081 - DNA, 129 bp, Glycine max
  Peptide Sequence Number=SeqID_104766
atgggggtgagcttagctattatagggcttctcaaggaagctttctcaaagaagcttctcaaggaagttttcttaagaaagcttctcaaggaagttttcttaagaaagcttctcaaggaagctacctag

SEQ ID NO: 13082 - DNA, 414 bp, Glycine max
  Peptide Sequence Number=SeqID_104767
atgccttcacagatccattgccatcacaaattcgtctccatcatcgttgtggctttgccaccatcacaacatcatccttgtcctggatctactatcgtcgcgacttcatctttgtcctggatccaccaccgtctttgccgcagattcgttgctagtgttcctcgttctatgcttccccaatctcttgcccaagctattctcttctactcccagaagaagcacaaaagaggggaaaatttcatcgtcgccgaaaatcacccccaacgacaatacacgatgaagagaggccgtggaagagaatttaaagaggccatttatcttgaagttgtgaaacttttctcaagataccgagctctgataccacttgttggaataagtggcctcagaataattaagaagagagggttgaattaa

SEQ ID NO: 13083 - DNA, 207 bp, Glycine max
  Peptide Sequence Number=SeqID_104768
atggcagcaagggatcatgttgttaaagattggggatatgcaggaaaattggttgggggttgtctagggtttagaatgttagtgtactgtgtcgatggtggttgggagaaggtgatgatggaggccactatgggtttgaaccatattgttaagggtttgacaaagggaaaatttggtgttagagactattgtggtggccaccactaa

SEQ ID NO: 13084 - DNA, 200 bp, Glycine max
  Peptide Sequence Number=SeqID_104769
gaagagaaaaatcagaggaaaacaaagtggaggagaaaaaagcaaatgaagaagaaaagaaagaagaagagaaaaaatcagaggaatcaaaagatgacaaggaattcaatgaggaatctgtgccaccagaaattgtgttaggcacaacctttgcaatacatggacactttaagcacgatttctggcatcttttaagttag

SEQ ID NO: 13085 - DNA, 1819 bp, Glycine max
  Peptide Sequence Number=SeqID_104770
atggccgctgaagaagacctcaaatggaaaatgaagatcatatgtttttatgatcttcaccctctccgagtcgatgtctactcgatcgcattttcgtctgatcatgttggagtgtctttcaagattgaagcttgcagcgcattctctcttttcacttctctcttccacgaaagctttttctcttctctcttctgcgacgagcttcttttccgcgaggcttctctgacagcccttggacccatttgcattcgagaagacgccggaaaaaatggcgacaacttggtgacggtggcgccttccggaagacccgttaggggttcttccggaacttccggaagaattcttccggaagatttccggaaaaagggttcttccggaagttgtgaaacgtcttccagaagtactggtctttcggaaagctcccagaacacctcttccggaaagttttcggaagaaatcatggctagaacacgaggtttaggtcgtgccataggtagacttgtaggcagagatagacatgatgatcatgatgcagctgatgttcccgagaggagtaggcctactgccttagcccgtacgcaacgggttcaacatatgattgccgagggacgtgatatggctgaggacgttgctgacatgactgacgatgtccctgtgctggctgcggaggcacctgagatgcatgcggacatagagggtgctgatggtgctgaggggtcagatgctgatgatgctgctgagggattccctggtgggccacgtgactcatcagtgctgacatcatttgccgagcatgttgcacatgctgtttggagtgaacaggaacgtcctgatttgaagttaatgtcacatgggaggaaggtgacactgattgggaggctagtgcctgagattgaaggcctcgtggctgccacaggattaagtccactgatcgattgttcagttattactggcgatcctggactgatatccgcattcgtggagaggtggaacggtgagaccagcaccttccaccttccggtaggagatctgacgatcacattggatgatgtgtcgtcactccttcatttgcccatcactggcgccttgcacagtttccatgctttttctacggaggaggctagatttttgctgacagggttgctcgaggtgtctaccgaggaggctagagccgagacaacactgacacgtggggcatatgtacgactaggatgggttcgagacatttatgagacgagataccttgctcagagtggtggttatgcttggggagttgccacgctggttcatatgtatgaccagttagatgaggcttgtaggaccaccacccgacagcttgcgggtgtgcaccaatgcgtgacagatgatacataccaggagacgtccccacgtgcttctcggtggttgacgtcgaaggcacacatgaagagaatcacaggagcaccttacagggcacgttgtgatggtttgaccgtcacagatgtgtcctggttgctgtacacggaacatcgggggagcatccctccgccgcctgttggtgctcgattgtcacacgatgagatagatgacaggtggatgcagtttgcggagcacttactacctgcgggtcagctttgtctagtgcctgagcaggttccagtggcatttgaccccccttcacatgtggatgattacgacggatatgaggcgattgcacagaggttggagcgtgtgctcaaccttaggatagtcactgcagacacagagttatatgacattatgcaggattgcctgacgatcgtgagaaggggatccagtgctgatggaactgtcagggctc

SEQ ID NO: 13086 - DNA, 333 bp, Glycine max
  Peptide Sequence Number=SeqID_104771
atgggcatcactgacttcataaatccaagggatgatgagaagccagtatatgagaggatcagggaaatgacttgtggaggtgtgcactatagttttgaatgtactggaaatttaaacgttctaagggatgccttcttgtcagctcatgagggttggggattgactgtgatattagggattcatccatcaccacaattgcttcccatccacccaatggagttgttccaaggtcgcagaatagtaggatcagtttttggaggcttcaaagggaagactcaattgccacattttgccaaagaatgcatggatggagtaaggactaccattctctga

SEQ ID NO: 13087 - DNA, 507 bp, Glycine max
  Peptide Sequence Number=SeqID_104772
atgggttctggcccgtgggccagcccgacccactgtgggctagagctaacaacccaattggcaattcacactcaaaaagtagaaaacctaaacggcaacaagctaacaaaagttacgaaacctaaatctctaatagtgcgaattgcaaaaattgatctggcggcacctccaccacacgagccactgacggtgacggtgacatccgaacgctcaattgcccgtcaccacggcaccgaccttccacttctacctcgtttcagtcgtttgtgtcgtcgttgtggtcgacctccaaaacggtgcattagattgatggaaatggcttctgaaattgtaaatcgagttgactctgttgatgacattgagtttatggaagatgaggaagaaggcagggttgaacctaaaccaaatgcaaaggagaatagaagtgacaatgatgaaaaagagagtaaaaaagttaagatggtaaagaaaaggcagaatgtaatgcatgtgggcaacaatatgtaa

SEQ ID NO: 13088 - DNA, 207 bp, Glycine max
  Peptide Sequence Number=SeqID_104773
atggaccgtataaaaaaattggcccgtaatcagcacggactgcgggtcccgcaagccagtccatggacctgggcccgtttacccacctctagttttaaatgtgtgaatgtggactctaggtgtctcccttgttctggtgtgaccctaaggtgtataacacgacctaaagactacaccaagaacccatataaagtgcgtaaggtgtaa

SEQ ID NO: 13089 - DNA, 354 bp, Glycine max
  Peptide Sequence Number=SeqID_104774
atgtaccctctacttgtaccacaaagggtgtaccctctactttgtgaatgggtatacaaaagaattcttaggggggagaagggagacacaaaagaattcaggcggttagtcatttgttcttttaaaaaagggagaagagagatacaaaaagaattcaggcggttagtccttggcgaattctttttggcaaagggagaagagaatgaaaagatgaatagcacaagttttcaaggtttagaaaaccagaaaactttggaaagcttttggtacaaagaagaagaagaagttcaaagagattcaaggcttgtaaaggattgtaagagattgattggaaaagtattcaagataagatag

SEQ ID NO: 13090 - DNA, 318 bp, Glycine max
  Peptide Sequence Number=SeqID_104775
atgcgtcatctactagggaataagtcatggaaggaggagcttcaccaccaagagagtgtcttggataagaagcttagagagaaagcttcaatggaggaagacaatgagagagggggcataggttttatgaatttcattttcatttcatgtgaatctaagaggaatatttcaaggatatgccaaaggcatcttaacatatttcctttagatgtcacaagaataggtgtaactctagtacatgagaaagtaatacgccacaagaatataccaaaggaatattccaagaatatgtcaaatgcatctttgcatattccttga

SEQ ID NO: 13091 - DNA, 318 bp, Glycine max
  Peptide Sequence Number=SeqID_104776
atggattttcatcattaccatacaacagaggcataccttcgatggaagcgcagacatgaactccacaaacgccaactcgacaatgtggttgcaatcacggaagcgcagcccagtttgcgacaaacacgaactcaggcagaaggagaaacaacaataaagccctgggatgtacctcaatggataagtggcaaagacaatctccacaaacacgatctccacaatgtggttgcagtcacggaagcgcaggcgactttgacacaaggggaaagaagaagaacgatagggttcaagcgcaaggagaaagaagaagaacgatag

SEQ ID NO: 13092 - DNA, 327 bp, Glycine max
  Peptide Sequence Number=SeqID_104777
atggaattggacttggcactacatgtggatgaaccacccattcccacggtagaaagtgctcaacaaaagcataaaggatctattcctgaaagcgataagcttaagacttatatgaatgctattgaggagcagtttgttagcttcaataagtccatggtcagcaccctaatgaaaaagctttcaagcatgaagtatgataatatcaagggtgtgcatgagcacattatggaaatgagggataccattgctaaactaaaatcccttgaaattaagataaaaaagttagtgggagtggaaatacttaacatgtggaatttgaagaaataa

SEQ ID NO: 13093 - DNA, 732 bp, Glycine max
  Peptide Sequence Number=SeqID_104778
atggctgcagcttctctagcatatcttcaattgctgtcttttcaagtgctgtttttgttgtctcctttatgtcttatactattctacattgttgttgctactgataatatgagtcttcaaaaagctcagttgttggagaattccctggctgctgagtacgttcatgatgaatcagaaactttatctgatattgatgatgaagaagttgatttgtacattcatgatgaggaggggaagcatatcaagaagatactgtgggaaacaacatatagggagtatcttgaggagcaggcagccaaggaagcagctgcagcagctagcaagaaagcttttgaggcaaaatttgaaaactgttcggaggatatactagcggcaagagagcttgctgcatcttctactgaagctgtggcaaaatccaaaaaggaaatgagacagaaacgagcttatgaggcaaaaaatacaaggccagctcaatctgctgcagaggcctttggccaaatgtctaataaaaaaagggagcaggtagccaaggaagcagctgcagcagctaacaagaaagcttttgaggcaaaatttggaaactgttcggaggatatactagcagcaagagagcttgctgcatcttctactgaagctgtggcaaaatccagaaaggttagaggtgttcatgttagaggttatggtgttcatgttcgatttatagttatagaccattttttggctagtacctag

SEQ ID NO: 13094 - DNA, 249 bp, Glycine max
  Peptide Sequence Number=SeqID_104779
atggatgtctacttagagtcattggaagatggttctctggatgctagtgttttgatgataacaatgatgacaacaaaagatgatgacaaaggtgatgaacaaaaagctcaaagatcaaagaacaactcaagtgaatcaaagaacatctcaagtgaatcaagaacaagtcaagagttcaagaatcaagaagaattcaagactcaagaagaaagcctacaatcaagaatcaagatcaagattcacgagtga

SEQ ID NO: 13095 - DNA, 222 bp, Glycine max
  Peptide Sequence Number=SeqID_104780
atggtgacgccatcagcatgtttatatgtaaagcatgccagtgtttttcagcaagcattggcccctatgtatgatacattggaaagtgatttgaagaagcctttgtattcaagatgcaagaagtcattgacactgttgtcagcggtattaagtctggctaatgtgaaggccaaatatgggtggagtgacaaaagcttcacttcatcgcttaaggtagtgtag

SEQ ID NO: 13096 - DNA, 315 bp, Glycine max
  Peptide Sequence Number=SeqID_104781
atgacccgtgcctacatccagtcctcaagcaacctcttgagatttcctttccttgtaaaaatcatttacaagcaaagagccacaaaggatgtaccttcccttgttctctttgatcaaccaagtagatgtaccctctacttaaagcgaaccacaaaggatgtaccctcccttgtgttcactattacaaccaagaagctacctgcttcttacacaaaattctcaaacgttcagttctttgaattcagtatttgggcaaagaattctcaaacgaattttcctttcttcaaggaaagattgaacaaaaacttagaatga

SEQ ID NO: 13097 - DNA, 327 bp, Glycine max
  Peptide Sequence Number=SeqID_104782
atggatttagctgatttagagtgttatggagttgaaaatcctaacgcacgattgtcttgttttgtcaacaaggcttttgcagatgttggtagtgacatggcaaagcttgtccttggttgtgtttcgatagaagtggatgtgcggcttgcttatgacacacatgccattatcaggaagaaggacttgactgattcaattgtcttaaggaacattggtgtaggtataggtcattctcttcttgcctacaaaagcacacttcaaggaatagggaagcttcaggtattcagtgcaacatgggattggaagcttcaggtattcagtgcatga

SEQ ID NO: 13098 - DNA, 321 bp, Glycine max
  Peptide Sequence Number=SeqID_104783
atggagaccatagatgcacatttttcatcttcttattggagaatgtacaattacactggaggatgtagcactgcatcttggcataagggtggacggcggtatagttgcggctctgcttgtctagcaacgctgtatagggaaatgtgtagggccattgaccctgatgccaaaaccatgggcgcaagagttaattggacaccatcgtatctgttggttacaagatggagtggcagtggattaagctttactggtacaccacatggagatgtcatcgattatagaatgagattagactacatgacagctgaacagttcttgtga

SEQ ID NO: 13099 - DNA, 468 bp, Glycine max
  Peptide Sequence Number=SeqID_104784
atggaagttgggagttggaagtggaagttactggaagttggaagtggaagttactggaagttggaagttggaaatgaaagttattggaagttgaaagttgaaaatggaggttggaagttggaaggggaacctatccctcttaagattattgaggccacaaggtccaacagatggaaatacctgaagagaaatgtgaatccgaaaggagaagaggtaaatgtggcggtggaggttgcattaacaacggcgatgctaaaggtgatggcgctttgcccatgcacgggttgcaacaataggattcacaggccagtgttgaaaaataagggtgggaatggtgatggtgaagggcacgatggacgtggcagctttggcaaagaagttgtcagagaagttaagagaaagatagagagtaacaacagcgatgctgaaggtgacgacgctttgcccatgcaaggattgcaacaatag

SEQ ID NO: 13100 - DNA, 411 bp, Glycine max
  Peptide Sequence Number=SeqID_104785
gccacgggtaagggttggggtcctggcgctgctggtgcagtatatactgatagaagttatcattcaattgcacctaacctctatgctttgccgcctactggcggtggtggtgcgtctgctgctagtcttgccccggctgctaactggcagaggcctgtgatcaatgttttaaattccagtgccatatcagacttttatgggtccactgggtgtctcagagaccaactggcatttaggcagcaggagatcaaaattatggtcactgggaaggatgttgctgagcagaagcgtcattcaaatttggttcaaagtggtcatgctatagctggcctatggcctcttcatcaaaacctgatgatggaagcttgcttgtggggcttctatggaggctggatctttgagcttcaatga

SEQ ID NO: 13101 - DNA, 626 bp, Glycine max
  Peptide Sequence Number=SeqID_104786
atgcggcaactcatggcatccttctgccagatgcagtcccagagcctctggttggtccctccggtcttcgaagtttatgagggatccactgttgttcataatactcctttgttgcttggccaagtaaaggtgggtgtggaggaggttacagatgcagatgctccagttcctatacccactgatgaggtagctgtgtctccggcaaaaccacctccaaagcccgatccagaggtcgatgatccgctttatctgacgacattgaccatctcagagcttttcttgaggccttatcaggttacatgggatgccactgtgtttggggtctttaatccagatttcccgctctacataaagctcgaagacctctccgaaatcgcacacggtggtcaatgtctcaacatatcagtgttacagttatggattctgcatctcactgaaacatgtatgcgagcggggaattctgatatctatggattcctcgagccacagtccattcagaggtctaggcaatcgcagtttgagtctgaaagttacataaagacttggatgcagagttcaaaacgcgatgtctatcttggagcctacctaaatgggccagacaactaccttaaggggattattaacag

SEQ ID NO: 13102 - DNA, 492 bp, Glycine max
  Peptide Sequence Number=SeqID_104787
atggaagatctttttaagaggtggactaagtatcttgaaagcacacgattaggggagttacacccttacaatcaatatgaagaagaaataactcctaatcttgagagtgtgtttacggaattcatggcataccatgctagctctaaagccaatcaaaactcaatgcaaaatcaggaaattcatgttggtaagagctactccatggaaaattatcagtgggagcaaaagttacaaccctacaatcaatatgtagaagaaagaagttctaatatggataatttgttgatgcaattcaaggaaacaactgaatctactcaacgagcatttaaaagtctaaaaattcaagttagtaagctagctaaagaagtggctaaatttgtggccacaagggaagaaaactttgtagaggttgaagctcatgaggaaagccttgtagaagagcatgattcaagagaaaaagatgaagaaaaaagtgaggcgaaagcacaataa

SEQ ID NO: 13103 - DNA, 327 bp, Glycine max
  Peptide Sequence Number=SeqID_104788
atgatgataacaaaagatgatgacaaaggtgatgacaaaaagctcaaaggtcaatcaaagaatgagttcaaattgttcaagatagaatcaagaacaattcaagactcaagaggaaaagttgaagaacacttcaagattcaagaggaaagatacatcctttgtggtacaagtagagggtacatctacttggatttgactgagaacaagaaagggtacatctcttgtggatcagttctagtggagggtgcatccactaggttcaaagagaacaagggagggtacatcccttgtgaatctttgcttgtaaaaggatttttacaaggttga

SEQ ID NO: 13104 - DNA, 414 bp, Glycine max
  Peptide Sequence Number=SeqID_104789
atgacaaagatgatgacaaaaagcccaaagaatgatttcaagattgagtcaacaagttcaagatcaagtttaatttcaagagaagaaatcaagaagattcaagaatcaagagaagttgatttcaagattcaagagaagatgaattcaagattcaagaaaagaaatcaagaagacttcacaagggaaggtacatcctttgtggtacaagtagagggtacatctacttgggttgttgtaactgagaacaagagagggtacatctcttgtggattagttcaagtggaaggtacgtccacttggttgttcaaagagaacaagggaggatacatcccttgtggatctttgcttgtaaaggcttttacaaggttgaaaagaaatctcaaggaccgtaggtcacttggggactggatgtag

SEQ ID NO: 13105 - DNA, 201 bp, Glycine max
  Peptide Sequence Number=SeqID_104790
atgcagtggcccttgaaattcaggctacaattccatcaaccccgagaaaccatcaaggatagcaatgtggcacgatgctcttggcgcctattttatcaatgcactgttgatgataatgtgcttatggaacttgaaaggcctgcatggctcattgcctttgctaacttgatggtattcatccatgttgttggtagctactag

SEQ ID NO: 13106 - DNA, 69 bp, Glycine max
  Peptide Sequence Number=SeqID_104791
atgaaagttgagcctcaaatttctaaagaggattcaaactttgcaaatgaagaggaaatcaacgggtaa

SEQ ID NO: 13107 - DNA, 294 bp, Glycine max
  Peptide Sequence Number=SeqID_104792
atggctactccacctgcctcgcctcctcctcctcctttagtagcatcagcgtctccgtctaccttgaagcggacacgcaaagtcacacggctacgatccttggccattagaccacctgggacagagagaccggtggtccacgtcgatcctgtgaccaggaaggccgacagtccccacaagaagaaattaagaacatatttggggattgtcgctcgtgataaggtcgacgtgacatacgagacttggaaggaagtccctgctgctcagaaggatttgatatggaaggatattcag

SEQ ID NO: 13108 - DNA, 267 bp, Glycine max
  Peptide Sequence Number=SeqID_104793
atggagatgggaggagatctccatgaccacatcaacaagttcaatcaattagtaagtcaattgttgaatgcaaatgataatcactctgatgaggagcaagcatttttgtttttgacctcactaccaaggtccttcaaagctttgattcaaacgttgcttttgggaagatcaactttgaatttggatgaggtgattgccacacttagagaaaatgagagaatgatgagaattgaaaatgttgatgatgaacacaatgcaatagatgtg

SEQ ID NO: 13109 - DNA, 579 bp, Glycine max
  Peptide Sequence Number=SeqID_104794
atgtaccctgagaaagtgctcgacagcttctggaagtcacgctcagacatgatgtcattcccaccgtcgccaccacactatgcaacggcaacatcgattgcacgctctccctttcttcttatcctggatcttctagaagaagcgttacaacaatcgaatcttgttcaccagttttactccgattccagtggcatgattcacgttgatggagattcagttgaaaccgtgtgtgcttttgatggtctcgggttttgggaagataaaggatatcagtgggaagtggaagaggaaccagaatacttcatgcctaagcaaccagctcgcctgggcgagctcattccttcagggctaagcatcagctcgcctgggcgagcttcccctgtccctaaatggctttttcatataaatagccatgctgggggatggggtttaagggttcaaaagttgggaaaagaaagagaaagagaggaagaagaggaagaaggaacaaaagtaaagtcgaggcactaccgaattgcgactgtgatcattccctacaccgttctcttgttcggtgtccctcgtgcaatagtcgattag

SEQ ID NO: 13110 - DNA, 276 bp, Glycine max
  Peptide Sequence Number=SeqID_104795
atggagagggagatgatagcaatgatagtagacacattacctgtgttctactatgagaaaatggtgggttacatgccttcaagctttgcagatttagtgtttgctgcaaagattcctcaacctccattttcccgaggatacaactcgaatgcaacatgtgtttatcatggaggagtttcagggcattccattgagcattgtatgaccttgaaacataaggtacaaagtctaattgatgcaggctggctaaaattcgaggaggacaattgcttgtga

SEQ ID NO: 13111 - DNA, 351 bp, Glycine max
  Peptide Sequence Number=SeqID_104796
atggggctatgggcaatggttccatttctcaagaccacttcatgttggcttcaccgtttcgtgctggtgttcaaatttgattttgaaatcgataggccagcctcctatgaaactaggttgcaaaccttggggaagctcacttcacttggtaaggtcgacaatggtgccgccacgttggagaaaacaatgtcggcggcagaaaattccaaggaattgggcacaagggagaaaaaggaatcgcatgaagacagtacaagtggaggtttcaatctcttctccgtctctctgacgtttgggaattctatcgcaacagtcggaggaataactgaaggaatctcagggaaccgctag

SEQ ID NO: 13112 - DNA, 1965 bp, Glycine max
  Peptide Sequence Number=SeqID_104797
atggtgtatgacttgcacgatcttcttgtttccctgcctaataagtggacttgttttaaaaagcacgatcttcaaatgggaaaactattggctaaagttttcacagtttctgccaaggcaaagtttgatatcgcagaagctacgaaggtgaagacgaaggttatgtcaacagtagcgacgagatggcggcaatttaagtccatattgactagcaaatttgtgtttgctaagagtgaaggtcaacaaacgcaggatgttgtgacacaatatggactagatcctgaagcgtggaaacaatttgaagaaacccggctcacacctaactgggagggtattaggaaacgagcacaatcaattcaaaaacacaacgactgccctcacgtactttcacgtgggggatatgatttgcttgagaagaaattgttagacgagaaacgaaaaaggatacaagaggaagcattgttgagtgaaaatccagcaagtcttgatgaacccccatctccaataaaaagacatgttaagtggaaggttgctcggaccagggctgttggcaatatgacatctgagtccgcacaggaaattgcagataaaataggttcgtttgtaccccatggtcggcaagacatactgaacactgccattgggcgacctgaccatgggggtcgcgttcaggcagcaggctcaggtgtgactattactcagtactacggaagggcatcaaggacatgcaacagttcgtccacatccatcagccaacaacaactagatgaagttgttgcaaggcttagggaagacatgactggtcagattagggaagaattgaggactcaaattaaggaagaattgaggactcagctagaagaggaaaataaaaggagcttggaaataatgaccaatgcattgaaagaggctattaaaaaagagttgtcaaagaaaggatccccagagccactccaaattcagccggacatacaacaattaggtgcgcgtgtcagcactaagggaagtaatgttgttatcaatgtccaggcttcacaggaacatcatgctgatgccataccattgatgggactgtatgtgcagcgtaaggatggtacactaaggttggtggccatggggaaaataatgcagggggattcaatcatacacacagtggcatatgcagatgatgttgccagggccgtcgatacatttgtagcttggcccacacaccttgtgaaagctgtattagatgaggatccagaaagtattccgcacaacgaggatgcacatgtgccgaagccgactaatgtggatgcagatgatccgttgcgtggattgataaagtacagtttcgatatttacaacaagccagttgaaatcaactttgatgggagctgctttggaattgtagatgcacctacatcgatattcatagcatattcagatgttagtgaaataatagcaggagacaaaagtcttaacatatctgtcttacaattatggttaatgtatatgcatgagtggagtcagatatttagtcaaggttccatgtatgcattccttgagccacagtcgttggtttgttcaaaggatagatgcagcgaatgccaacaatatcttgaaagatggcttaaggaatatgaccgagaggtgtacattggaccttacttccttcagaaacctgatatgcatatcaaagctacaattaatagggtaatgacgaaattgaagacgaccttgtctcctgaaactaaggcagttgcacctaagtggattgaagttaagagtcacgttcaaaccggatgttatgaatgtggatattacataatgcattggatgtggaacatcataaccagtgacataaagagtgactggtccatgtggtttgctgatgagacaccattggacatcgacaacatcaccacaattcgaaagaaatgggcaacattttttttaaagacagcaataagtaaaaacggctaa

SEQ ID NO: 13113 - DNA, 528 bp, Glycine max
  Peptide Sequence Number=SeqID_104798
atggcggggagttcttcatcagctgctgtaggggaagatacccgtgacaacttcattagtcacatttatgaagaactacagaggaaaaagattgaaacatatatagattacagactagccagaggcgaagagatttcacctgctctccacagagcaatagaaaaatctacgatttatgttgtcattttctcccagaactatgcatcttccacatggtgtttggaagaactcacaaagatactcgattgcaagaacagatatggaagggatgtgatcccagttttctataaggtggatccatcaattgttaggcatcagagagagacatatgcagaagcattggttaagcatgaacatcgatttaaagacaacctcggcaaagtgcatgcatggaaggctgctctaaaagaagcagctgggctcgtgggctggcattcacaatcttatacaccatctagagactggaagagagagagagcttggaagaaccaaaacaagaaactcttcatagcaatggctggaggttaa

SEQ ID NO: 13114 - DNA, 390 bp, Glycine max
  Peptide Sequence Number=SeqID_104799
atgatgaaggtctatgggaaaacattcctacaggctgagtgcgaaagtaatgctttgtttaatgtgatcatggtcacagatccgacgtctcctccgcagtctgatggtcaatcagaggccacttccaagaggagtagaacaacgacacggttgagaacatttacattaagaaccgtggatcagcccagaccggcagtttatgtggatcccgctaccgggagagcatcgggaccgatgcgtgaaaagttccacagctacctaggcgtagtggcacgagaaaaggttctcattatccacaataattggaaagacgtacctaaaacgctaaaggagatagtgtggaatgacattctaataagtccttcataccaattagtatatttgaattaa

SEQ ID NO: 13115 - DNA, 1416 bp, Glycine max
  Peptide Sequence Number=SeqID_104800
atgggtgtctaccacaagcttcatagttgcctgagccttacggagacgacgctggatggaaggaggaggtttcctgtaagtcacttcgaaaggggtaagactggtaccggagtggaccaaagtattgtaggaccactctgccaggtccaggaaatggacccactgttgtgggcagtcgtggatgaaagccccgagatattgctccacgacgtggttgagtacctcagtttgatcgttcgttttagggtcgaagaaaaggatggccacaaaatgagccgtatattgagctgtccaaagatagctcttcccacagggcgttggggactggaagaggatgaagtaaacccacgggtttcttcgtctcttatcttggacacggtgaagagttttcgcaaagcccaagtggccaccgataggtgtagagtgaaattcctccataataatgggaataaatgtgttatccgagggaagccatatcttcttatggaagaagaccaagtcacggctgatggtgaacccttcatgttctggaaattggtagatgttatttatcagggtggatcaaagttgggaagggataatgagagtagagtccctgaagaaggtgggggtttgttgttctggggtctgaatgacttgcctcatgaggtgcttgagactcttgtggttagtgtgaatgatgaagtgactgtcgtgcaagtaatggcgccatttacggacaatgacagtgatggcatgcagttcgcagacataggtggatgctcgctaaagtcgagcacagaacaccttactgtggaaagcgatggaatgggaacgttggatgagggaactggctatggaggcgtaacctttgataaagcgaaggtagaaacccgtgaggccgaggaagccatgtcgagcttggagaaccatttagcttgccccaattcgtctaagagtttgtcaatggtgggcatcacaggggatgagaatggactttggcttatccggatgagaccattggcaagcatggaagcaacttgtttttcaagtttggctttctggaagtgtagggggaaggaattcgggttcactaaagatgtgggagtactggtggataatggttttgggtgtatgagggggttccttggaggattgagatcgaatacggagctgggctgggatgggacatctgtagtgagtgttatgggctggcccaatgttgcaaatgtcatagtgagtcggggcaaagaaatccaccacgaatctatggccctggatgaccactggtatctgaagacaagaagtattgcagtccatagtggtgtcgttccccaccagtattgcactgatgaccacgagtccactgttcatcacaatggtagcataggccgtggttgcggtggaccgccaattcttccgaggaaagtcgcttga

SEQ ID NO: 13116 - DNA, 681 bp, Glycine max
  Peptide Sequence Number=SeqID_104801
atggctgtttcaagggatttggcatttttcagtttattggcctctattctacagctaaggtcaacgatggtcaaatttggaggtctggacaagaaagaagatgatcaaagtggtgcagtggtaaaggagaatgttcattggaaaagcaaaagtgcaataaaacagaaaaagaaggataactcttcaaaggaccagaaagaatcacaagaccagtctgatagcatcaatgttggaagtaggacttttgaaactgctggcatagagaaggcagaggatgtgtctgccattgatgttaaagtgaagcttaagaaagtcacttctatgaagaagaaaggagatggatgctgctgcatgagcagctgcactgcttggggtctattgggtcgcaaccagaatggcttgagtggtggtgtggcaacaagtgttgatattgatgatttggcaatccatttgatctgttcgaatcattgtttgagggcaattatcgtggcacaggttccaaaggttcttggaatggagcaaatgatgctgaacatgagtattatagtcttggctaaactagggactacaccatccagatgtagcacttgtggaggtcaaggccgggttttctcatcaaccagaactccattagccatcttccagcggtcaatgacatgctctgcatgcaatgggacatga

SEQ ID NO: 13117 - DNA, 279 bp, Glycine max
  Peptide Sequence Number=SeqID_104802
atggcggtggtgggaacaataggtagggttccttttgcggaggtcagggaaacacaatgtgagggtgggcacgacggagtcgtcggcgggatgagttcaggcaacagcgcgctaggtttttgctataggtttttggaggacaggagatcgagtgttgaatcatcgcgaaacaggagccatttatggcacgcgggaagagctcacgcagttgtcgcaggatttgaaaaaggaattgatccagattttgaaccagttctttccatgactcctcttaattga

SEQ ID NO: 13118 - DNA, 192 bp, Glycine max
  Peptide Sequence Number=SeqID_104803
atggcactgaaatctggtcccttctttgacagcttatgcaagaaaccttctgcaacattggacgagttgagagcaaggactgttagattcactcaaatggaagaaatgaccaagttcaaagagaaagctagaccagttgcacaaagaaagaggaaactcgaccctgagaagggaaaaactatggataaataa

SEQ ID NO: 13119 - DNA, 156 bp, Glycine max
  Peptide Sequence Number=SeqID_104804
atggaagcttgcttgtggaacttctatgaggctagatctttgagcttcaatgagcttgaagaggatgctttaatggaggaaaagaaagagggagagaaagagagaggggggagcacgaaattgaaggaagaaaaagggagagaagttgaactttga

SEQ ID NO: 13120 - DNA, 1311 bp, Glycine max
  Peptide Sequence Number=SeqID_104805
atggtatgttcatgggtcatgttgttttgtgctgtgtctgatcgcactttctcattcattgtgtatctaccatactccagcgtcatcttcacccatcatgttgcacctaacattaaggaagttgattctgaatttgaagctactgatgatcctgatgctcttgcacttgaagtgtatgatccccctccatcaagtgagtatgttagcagaattgagcttgagttgcttagaacgaggaaagcatttgctcaagctctggatgatagacgctatgctgaagatcaagctgtgaagtggcagcatctaattgtagacttcttttacaagaagttagtggttgggaaactccaagaagtccttcccctcctggaagtccaatgcgtacccttccttgttcctattgatttgtcatcagactctgattcttttggtgaggagttctttaggaagcttgatgaggattttgctactgccaagcaaaaaggggagaaaaattgcatcttatggggacaggcctttctttctggggaaccaagtattgttgaggctgctgcattgcataaggccattgttacacggaatcccaaagctatggtctgtctgtacatattttgcactggggtctggtctattttcaattgggcaactcttttctgtcacccatgtccatcaagcatttcatggtgggaagagactgcagtttcaatttcattgcctttggcaaaacgtagtgttcttggtggacttctccctaaatctttgttgtacgtactagagcgtagtggtccagcagcatttgctgcagcaatggtttctgattctgacaccccagagataatatggacacacaaaatgagggcagaaaatctaattcgtcagcatcttagtgattttccgcacaaactgtcacagcattgccatgttttatatgactacgccctcatgcctccagtgacatacccaaagctgagagatgaaatgtggtatcactgttattacctcaggaacctatgtgatgatattcgttttccaaattggccaattgttgaacatgtagagtttcttcagtcactacttgtaatctggcgtgaagagttcactagaaaacctatgaactttctgaggaagaagcttgcaaaatccttaaaatattcttttgcattaatgaatcaggacacaggagtaaagcattgtgttcccgtgtcctctagcatgaagttcttcatagtcatccacctattcatctgctcccccgaacacaaagttcaagatcatcacaggatccaaacacaaacagcaaaccgggagtga

SEQ ID NO: 13121 - DNA, 375 bp, Glycine max
  Peptide Sequence Number=SeqID_104806
atgactacaaggaatggagacaatgaggctgaaaaatcagttgggagtaagggtgaagctgggaaagaacattctttagaggtaccattgccaaccagtatgagatcactcagggtggaaaaggataaagtggtggttggggatatctctggtagtgcaaccttggatgatgtggtggctgcaataaagaccatgtgcaacttggttaagcaagactacaatcagtcggccaaagatgttgtcgaggatgtggcaatgagtgggactcacaatactttcacctatgatgaaacattatgttatgaaaaccctaataaggcggtgtccaaggcgactgccaggtgtagcagaaaggaagcatatgggaaatgttga

SEQ ID NO: 13122 - DNA, 1296 bp, Glycine max
  Peptide Sequence Number=SeqID_104807
atgtcggacgatgagagagaggagaaggaattggatctcacttctccggaagttgtcactaagtacaagagcgccgctgagattgttaacaaggccttgcagttagttatttcggaatgtaaaccaaagacaaagattgttgacctttgcgagaaaggggattcgtatattagagagcaaactggtaacatgtacaagaatgtgaagaggaagattgagagaggtgttgccttcccgacatgtgtgtctgtgaacaacactgtctgtcacttctctcctcttgccagtgatgaaacagtgttggaagacggtgatatagtgaaaattgacatggcttgtcatatagatgggttcattgctgctgtggctcacacccatgttcttcatgaggggccagttacaggacgggcagctgatgctattgcagcagcaaacaccgccgccgaagtggctttgcggcttgtaaggccaggaaggaaggaaaaactgattggtttgattgccttgttcttgatgcatacttgtagcattgatatggcgggaaatagtgctgctttagtgccagaatggcatggagtgacccagggtccctacatggagacaaacaaggatgtaactgaagcaattcaaaaggttgctgctgcgtatgattgtaaaattgttgagggtgttcttagccaccaaatgaaacagtttgtgattgatgggaataaggttgtgcttagtgtatccaatccagatacaagggttgatgatgcagagtttgaggagaatgaagtttatgcaattgatatcgtagcaagtactggagatggcaagcctaagctgttggatgagaagcagacaactatttataagagagctgttgacaagagctatcatttaaagatgaaagcatctaggttcattttcagtgaaataagccaaaagtttcccatcatgccattctcagcaagggctttggaagagaaaagagctcggttaggtttagtggaatgtgttaatcatgagctcctgcaaccttatcctgttctgcatgaaaagcctggtgatgatgttgcacatatcaaattcactgtattgctaatgcctaatggatcagatcgtgtcacatctcacccactccaggaattgcagcccaccaaaacaatagacgatcctgaaatcaaggcatggctagcattgggtacgaagacaaagaagaagggtggtggaaagaagaagaaaggtaagaagggggcagaagctgaaccaatggaggcaacaaatggtgctacaccccaagagcaagattga

SEQ ID NO: 13123 - DNA, 723 bp, Glycine max
  Peptide Sequence Number=SeqID_104808
atggaatggggtggtggtgacgacaataacaatgatggagaggatggtggtggtagttgcgttgatgacaatagtggtggtggctgcactagcgatgatgatggtgacaacaatggtagtgacgacagtggtggtgacgacaatgataatggtggtaatggtggttatagtgacaacaatggtgtagtgacaatggtgacaacaatggcaatggtggttacggcgacaataatgacagtgagtgatgacaacaaagctggtggtggttgttatgacgacaatggtgacgacgatgatagtggttgttatggtagtgatggttgttatggtgacaatggtagagtggtggtggtaatagtgatgacaagggcaaaggtaacggtagttgctgcagcggtaatggcggtgagtggtggcaacaacaacgatggtggtggtgtggtggtggtggctaagatggagatggtgatggagacaatggtggaagtgttggtgatggttgttatggtggcgatgatgatggtaacagggacgacagtggtagtggtggaggttgctatgatggagatgggtggtagtggtggaaatgatggtggtgccaacaatagtgatggtgatacggttggtgacgataacaatgatgacaactacaatgataatggtgggggcatgggtggtgagagggggagagtgagaaagagtgactatcttgttactttctaa

SEQ ID NO: 13124 - DNA, 132 bp, Glycine max
  Peptide Sequence Number=SeqID_104809
atggtggcgtctctggtgctctctagagctcctcctctgattgctctgttagggttcttagatctctcatataacaatcttagtatcggcaacaacatagaggagctacagtgtcaaccgggaactgtgtaa

SEQ ID NO: 13125 - DNA, 363 bp, Glycine max
  Peptide Sequence Number=SeqID_104810
atggttcaaagaggcaggggaatccgcgtattgctctatcaagatagcattctcttccatgggttttatcatcaaggagcttcacagttttattattccgatgagggaagttttgttagtgaggatccacttactgtaaaagtcaaacatctcaaggataaaacttataagaaagacgatgatattataaaggccacatcttttgaggttatatcgaccctaagagatgttcttaaaacaagtttcctttggagagatcatgtccaaacatatactaagataacagatgagcaagaaaatttaaattctgggaggagtgcaaatccctctgaggctatagggaatgactggcttaaggcctaa

SEQ ID NO: 13126 - DNA, 372 bp, Glycine max
  Peptide Sequence Number=SeqID_104811
atgaaattgaaggtgcgttgcggtggtcggcggcggcaaacgaggtacgcagaaggtggtggctgtgtcgcggacatggacgaagatgagtggatgtatgaaataatgtttgaacaagcggatatggattatgaaatgaagaagcatgtggtgtttgagtgtcgagaggatgttttgcggtgggctcgatccgttgctcatgaaaatggatttatggcggtgattttaaggtcggacacaaacacaggagtggcaagtataggtgtaggaaaaaagaatttatcagaagagacactgggtactaggaaatatgggtgtctccttcaagcttcgttgcaagctcattggttggaggaggaggctagatggtga

SEQ ID NO: 13127 - DNA, 879 bp, Glycine max
  Peptide Sequence Number=SeqID_104812
atggttggttggttagagaggaacaacataaaaatgagagaaactagaatgtggaagacatatgatgatgacacgggtgagactactggaccagcaagctttcataacaaccgtggaaaaaactgggcacttatcaacaatggtcatttctttgataccaaccgcttaaactactataatgtgactaattcgactaagcttgtaatggagaatgttgaactgtacatgaatgcacgtgtttctccgacctctttgacctattatggattttgcttgggaaatggaatctacacagtaaaactccattttgcagaaataatgtttactgatgataaaacatatagcagtcttggaaggcgtgtatttgacatctacattcagagaaatttggtggctaaggatttcaatattgcaaaagaagcagggggtgttggtaaggcagtaattaaaaatttcacagttgttgtgactagtaacgctttggagattcggttatattgggctgggaaaggaaccacttctattccatttagatcagtttatggtcctcttatatcagctatatctgttgatcctaactttatacccccatcagaaagtggtactagcagcatatccataataagggttgtggttgtagttgtggttgctggagcaattatcatcttgatatttggtatattgtggtggaagcgctttttaggatgggaaagatcagtgggcagagaactgaagggtttagaatcacaaactagtttatttaccctacgacaaatcaaggcagcaacaaataactttgacaaatccttgaagattggagaaggagggtttggtcctgtttacaaggtatatcctcttaaatcaaccactttttcctga

SEQ ID NO: 13128 - DNA, 252 bp, Glycine max
  Peptide Sequence Number=SeqID_104813
atgggagttacggcgacaataatgccggagagtgatgataatatagatggtggtggttgtttatgccgagtggtggtggtaatagtggggacaagggcaatggtagcagtagttgctgcagccgtaatggcggtgagtggtcgcaacgacgacgatggtggtggtggttgtgatagttacatggaagtgtttctaacacttgtagaggaaaaaaaatatgatctactttgcattcaaaatatacaacaataa

SEQ ID NO: 13129 - DNA, 192 bp, Glycine max
  Peptide Sequence Number=SeqID_104814
atggctaagttttgcggtgtggttctcccaaagttcttaccaactgatcaagacaaagagtatctttccctcaacaatggctacagccaacatatgaatttggagcagttacttttggtgaagttcaaaggttttggtaagaataaggacggtgaagccttatgtcaatgtgaagctgatttagctctttga

SEQ ID NO: 13130 - DNA, 123 bp, Glycine max
  Peptide Sequence Number=SeqID_104815
atgatgagtgtcttctctggattttctcttcttttccttcttcctttgtgctttgcttccttagctgttggagccactttgccagaagacgaagcatactactggaagttgtgcaagctctga

SEQ ID NO: 13131 - DNA, 213 bp, Glycine max
  Peptide Sequence Number=SeqID_104816
atgtgggttctatggggttcgagcgacgaaaatatgggttttccggcagctagggggttctgtgggttccagcgacgacaatgtgggttttccggcagtgtagggggttctgtgggttcgaccaatgacaatgtgggtgtcgacagagcagtttccggcagatttcgggcggacaacaatttcaggcaggaggatgacaaagagaagaggtag

SEQ ID NO: 13132 - DNA, 210 bp, Glycine max
  Peptide Sequence Number=SeqID_104817
atgagcagcacgatcgcaaaacacagtctcccagtgcggaggaagaagacgatgctcacagcgggaacacggcgcggaggactgatgtcaagcttttctgaaaccagcaaccacttcacgcaaagaaaacgaaatgaagaagaacacgacttagatgaggtcaggggtgaggaaggtggccgaaatcacttcatgccagcaaaaagatga

SEQ ID NO: 13133 - DNA, 177 bp, Glycine max
  Peptide Sequence Number=SeqID_104818
atggatgagaataggtggaagggttttacacagagcaatgtgaggattagtaaggaggttgagggtttggaagctagaatgatggagttcaatccacagcttgtgtttgaggagcctgaatcgggtgttacggttgttaagctaacacatactgatgtgcctgaagaggataggtga

SEQ ID NO: 13134 - DNA, 354 bp, Glycine max
  Peptide Sequence Number=SeqID_104819
atgttcattctaatcccaattgtgataaactcatcccttacatctaaggaggctcacggtttccaagcgttagagaaaaagagaacagattgtaacctccattttactgtaatgtgtgagggacatttctctctctatggacgttatttcatgaatcccaatgatgaagatgtggaaaagagattccaaaggtggtgtccaaatttcacgatgatccaacgattaacaaatccgagatcgtcattttacttagacaggtttgagtgtatgcgagaaaaagagagggttttgggaggaggaggagaagggaaaataaaattgagagaaagaggaagtgtagagactatggtctga

SEQ ID NO: 13135 - DNA, 384 bp, Glycine max
  Peptide Sequence Number=SeqID_104820
atggaggctggtcagatcttagtaatggaagggacaaagcttggcattctcaatgatggaaggacctccgaaagctatatcagcagcctgagttcactcttattcatcagcagatgtggtcagcagaatagtaccatctcgaacatgggaagcttctctcaaggcaattggtgttggggcttaaagtggagaaggaatctatttgattatgagcaacatatagctatggcatttatggaagcaattactgatatacaaatccaggctcatatgcaggatattatggtctggaaagctgatcccagttgtgtatattacactcttcggcagaaatataatcagtttttcttgataagtagacagcaaaaggcccacatttcctga

SEQ ID NO: 13136 - DNA, 273 bp, Glycine max
  Peptide Sequence Number=SeqID_104821
atggctaaagtgaatgctcaaatgctagagtttaagaattcaactctctttggaatccagccaaacttgtttgtatgctttcatacacaaagtagaatgattgaagccagagccagagcaaatactagaaaagaaagtggaaaaattcaaaacataaggatgctgaaaaagattttagagatcccaacctacaaagacaccatcaaagctacaaaggcaacatacaaacttttgatgttcactcttcccagattagctttgatgtttacttaa

SEQ ID NO: 13137 - DNA, 111 bp, Glycine max
  Peptide Sequence Number=SeqID_104822
atgtggaactttttaatggcaacagaatggagaaggaagaaagatgattggagacgccacttcaaggagaagatgagtcaagcacaagctcaccaccataggaagtcatga

SEQ ID NO: 13138 - DNA, 342 bp, Glycine max
  Peptide Sequence Number=SeqID_104823
atggggaaccagccaagaccaaactttaatgcagggggtattctggatttcaacatggccaacaatataatcagcaacagggacagtggagaactcaccctggtgggacaattggcaaaacaacaagcagaccgaccgtcaagcagctttggagccaacacagagaagaatccgaaggaggagtgcaaggctgttatgactagaagcaaaatggtgagcttgaatgaaggtgagaagaggataggtgaagaaaaacaacagctagtgactgaactagaaattgacccagtggtggaacctttgagtgaggttgaggaagaagtggaagcagaagatgattag

SEQ ID NO: 13139 - DNA, 954 bp, Glycine max
  Peptide Sequence Number=SeqID_104824
aagcctgtaatcgattaccagcagggtgcatatgctacaggttactgctgtaatcgattacaatggcttgtaatcgattacaaggtgtcttcttctataaataagcacattatcgcagagcctcgtgcacagacccctaacctccatacaagtgacgatgcaaaccttccccaaaacttcaaatcttcgtatctctttcaattcttaatgaaatcacttcaaacaaagcccaatcttcatctttttcaattctctttcaaacccactgatcaaaatccattgaaacatcttcaaatggaagaatcatccaggaagcgcaaaggatcttgctccatcaccaccactgttggccaccaccgccaaggaacttctggagacccacccgcaccagttcctccttctctttcatctcttagatcatctacattattctccttaggtgatcagcgtcaaagtcatgatgctctccgcatggtctataataaccaggttgacatgaccggcagattacttgctgggtcattaacttttcattgtcgcatcatgcaatatatcattgttcgtattttgcttcctcggtcttcaaaccttgcccaagcctctaaggaggatttgattgcattatgggccaatgcacctctgccttatcctcaccttgttagtgtttttcttcatcatttcaatattcctttggatgatgaaccatatgtcaaagttaagaggtcattttctattggtgccggtgcggttacctcctttcattaccaaaaggatgttgatggtcagtgggttcgcaaacaagacttgcctctgcctattcctgacgagccttttgtgggtgaatgctttaatgcactggatactcactttgatgggatggatacgaggatcactcgactcgaagatgatatgagcttcattaggcgttacttcgatcccccggccgactcttag

SEQ ID NO: 13140 - DNA, 237 bp, Glycine max
  Peptide Sequence Number=SeqID_104825
atgaagcatgataaattagctaaacttgttacaaatgtatctcgctctatccttgagcaggcagctttcgactataatgcagtcgatgcctctcggtaccacaactcaattattaataacaacaaaggtcaactaatgaagtttctcagaattcaaagagccttcacttacttggatatgtctagcaacaattttgagggtccaataccaaatgagctaatgagttcaagggattga

SEQ ID NO: 13141 - DNA, 483 bp, Glycine max
  Peptide Sequence Number=SeqID_104826
atgccacaagaaccaaagtcgagttccaacgatacttggagctatatcaagcagattggaacaagactaggtgaacaaaggagtatgatgaggaggatggatgaaaattttggagaaggaagaaatagagactacgtccaacagctcctggaccttgcctccattgagaacatgtcatttctcttatactatgactacactttcttgaatccaatagaagcaagattttctccttctacgcctgaagcacaacaagctaaggatcaatctggtatgattgaaatttcacaatcccaggaacaaccacctaagtcaccttctcctccacctgaaaccttatatgctgaacccatttctgttgctgcacctgaaagtgaagtggtgactcttgctaaagtagaagaaccgggcttaagcttttatcataatttccaagctttattggcaccaatgatggcttttcttcaatacctggttccatag

SEQ ID NO: 13142 - DNA, 363 bp, Glycine max
  Peptide Sequence Number=SeqID_104827
atgtgggatcgacacaggcttaaaggagcactcaaaccgggtgtatttacccctaaggcctacactttgaagagtccgtcagggcctctccctcctgattcaactcctcctccggttgctctgttagggttcccaaacgttagagagaaggagaagggattgaagcctccattccatggtcctacgtgcgatgcatctttctccgttcagaggcattcttttgtaaatcccaacggtgaagttatgggtttctacgggaaagaaaaagttacaatgcgaagggtatttctattaactccgacatcttttcttaattcccaacggttagaaggctcggaattgagttgcaaacctggtgcttaa

SEQ ID NO: 13143 - DNA, 639 bp, Glycine max
  Peptide Sequence Number=SeqID_104828
atgggtgaaataaagaaggtgcaagagtggatgaaggccaacatggaggccatgaaagagcaaatggccacaatgatggaggccatgatgagtataaagaagatattggaggtcaatgcggctgcagttaccgctaccaacgccgttgctgaggtggacccgactcccccatctggcctcaaccaaataaatcatccaattttggatatgaacaagcatgcctttctgccatatggcttgcctcccaactatatgccacccaatgttgcgcacactcccgatgagattgtcaataactccgcaaccatacccgttgagagtcaacaacttcaagctgatcatgcacatgtctttcaacccatgggggagacacatgaaataccccaccacaacctagccaacttcgagcctcgcctcgaatacgccactaaggggcaaacagttggtggtgtacccctaccaaacactttggagggccctcagtttcgcccacaaccacaacccttgcattttgtgacggggaaagtccctcctactatggcggaaaaagggaaattggatcatataaaggaaaggctgagggccattgaaggaggcggagaccatgcttttgctgacatggcagaggggatcctctag

SEQ ID NO: 13144 - DNA, 591 bp, Glycine max
  Peptide Sequence Number=SeqID_104829
atggcctttttattgagtttcttggcccctagctcgcccaggctagcctttggctcacctgggccaccaaaagacttccatgttaagcgtggagggaggctgatcaaggggttggaaggtccagaaggtcaggaattgagagaagagagaaagaaaaagaagaaagaagaggaaacgaggccgaatcgcgatcgcgatcattccttactttgtttcttgttcggcgttcttcgtgcaaccaccgactctcctttggcttttcgcccgcattcctgtcaaagggtaggttgcgacaatagccaagatgaggctactacttcaccttcctctagtgaaagtgaagaagcaaaagaggaagaatctagtgaagaaatctacccccaagaagaaggacaacctttaatggttaaggatgagtgtaaggaggtaagtgtctcctccaagaggttagctaaaaaggaaagtcattttgcactaaagacaaacattaaagaaacttcccctcttagacaacctccacatcttcgcctttgtaaaagacacttgttagcactgccacacctgttgggcttggggttattcctcaagtaa

SEQ ID NO: 13145 - DNA, 543 bp, Glycine max
  Peptide Sequence Number=SeqID_104830
atgaacctagaggaattagcgagtggtgactacccaacatttagttcactcatttggcacagagaactcacaagcttcactttgctactcttaacagactctaagactatactttttggagttgggagcatgggaatcggtatacattgtacccgaccaccaacacctaggaggcttggcggcattgttaggccctgttatgtgtcgattatgataggctttgagaggtttgtttgcctagaaaaaccatacgtcatgattatgagtagaagattcacccctacaacttttagggttaggagatggcgagggagtcacgcccctttagaccagatgccatgcacatcactatcgatcaccattggtactgctacattgcttggggatttacatctcgtcggcaattggagtgatttgaagatattagtttttatctgggccactaaggcccaaggagatcacactgatacgatgcccgaggaggaggaagtgtattacaagcttctacgagatttagaatcttcatttgatgaggaggattga

SEQ ID NO: 13146 - DNA, 276 bp, Glycine max
  Peptide Sequence Number=SeqID_104831
atggctgctgttggaggagctgggttggatgatgaagggatgtcatcggttcttgccctttttcttgatgccatctgcaagaaagggatccaaacaactgcaaaacgaatagggtcgtccagcttagaaaatgccgcaacgaattgtgcttggcctatggaagctcggcttagcacgagagttaggcttagcgcatggatcagaccacttagcgagatctacagattagaaaacctgcaactctcgctaagccaggctctgggcccgcttagctaa

SEQ ID NO: 13147 - DNA, 582 bp, Glycine max
  Peptide Sequence Number=SeqID_104832
atggcctctagaaaatgccaagctggacccagtcagccacaaggggggattccacctgggattcctcctgattttcttcagagacagcctgggaccatcaaatttgacgttgagacgttgaatgactttctagggatccctgtcatcgtcctagaaggggaattgatgctgactgctgacggggctccctggaagattctgcgaaaggaccgcaccaccttggcccaaacctggagtgtgatttcttacttcaacctttcttctacctcccacaccttggacctcaacatggatcggtctagtacatcgagagtcggcttccccgctctgatcactgccttatgcgacactcaaggagtctattcatacacattgacctacgagccccttagcccggtgatcaacctggcctacattaaaaagaactattggaatccaacagattcttctatcgcatttccaggggcaaggcgggtccatgccagagccactcaggacgcaccaccaccagcaccaccactagtcatccctcctccggttgcctcctcttccgtcagcccatcttcttcttcttcccagtag

SEQ ID NO: 13148 - DNA, 219 bp, Glycine max
  Peptide Sequence Number=SeqID_104833
atgcgtgcgcggcccttgagggcaaaggagcatgtcaaagcgttcaccttttgggaacaacgggtgacacgaccaagacctttacggtcgaacctcagtgtccacgaagcgcaaacccgcaccgaccgtggtcttggtggaggcgatggctctagtggtggtggtggaggtgacggtggcggatacggtggtcgtgggagggaggcaagagaggcttag

SEQ ID NO: 13149 - DNA, 702 bp, Glycine max
  Peptide Sequence Number=SeqID_104834
atggagttaccacaaaagagagagctagtgctggatgagtttgaggcaaaagcttatgattcaatggatgtagacctaagcatagaagtagtaaagtttgataaatatcaaggtgttacagaaggagtgatggttagagagggagtccaggaaaactcacaagttactatttcaagcactttccataagatttttcaggtgttagatctatggaaggtttttgttagggaggtggagaatccattgttgcttgaaaaccagcttcacaacatctttatagggaacttgaagattatgggaaaggacaagtacgggttgaaaaattgtattctcatgatgcgtcagaaagggagattcacaaatgtcatgtgggaaaagaagggtgtgtgtggtttgaaaattgacaaggaagaatggtggggacaagaaattaagtcgatgcaaacaagacattacaaggataatatattattgctaaaaccaagcaaaggagattatatgtatgagatccttaagggggaggaggaatggatgggcggtatatttgagtctatcatggagtggacacaagatatacctatcaacattaggctagaacaatgtttattgccaacatttgaggaaggaagagtcagattggagtctttgattatgagttacaatcttgaaggggcctcaagtactgcattagagggtggatga

SEQ ID NO: 13150 - DNA, 836 bp, Glycine max
  Peptide Sequence Number=SeqID_104835
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggttgatacatgtgatgatcacgaaccttgttcgtgggaggagatgaacaacgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13151 - DNA, 207 bp, Glycine max
  Peptide Sequence Number=SeqID_104836
atggccttctatggtggtgagcttcttctagactcaaaggaatccattccgttgccatttatcttccaagaagcaaaggaatccattgatgaagaagatcctaggcctacaagctccaatggagcttacatcaaaaggggtcagtatgacagagattgtggggcggccgacaaaagcgaggctcttgctcctacgtatcctcaatga

SEQ ID NO: 13152 - DNA, 111 bp, Glycine max
  Peptide Sequence Number=SeqID_104837
atgggcccagttttgctagactcgcaaagacccttcttgggaggatgtgcggaaaaaggcacagaagctcctactgaaaagaccaagaagaagatggaggaagctgcatag

SEQ ID NO: 13153 - DNA, 869 bp, Glycine max
  Peptide Sequence Number=SeqID_104838
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctctgttcctgcctttcggttaccg

SEQ ID NO: 13154 - DNA, 564 bp, Glycine max
  Peptide Sequence Number=SeqID_104839
atgaagatgagatttaaagtacgggataagatcactttaattcttgttcttttaggactattaagctatgttaatgctaccacgctgcagccaatggtaatcgtaataacagcactagtcatcggttttctgaaaatgatggttactattgaactgttcttaccattaatggcaatgataggaaacagggggatgttctacggagcattttatacgttcgtccttatgatgaatcaggtggcaaggacaacaactttgcaaaatacgtttgcggtaggagtattgggatatgatcaattgaccaatgcaaggctcagtatcctgatgattcctggaattattctggccggaattacagctattttctggtttaaaaatgaaaaacctttaaagatgttcattttttcaggattttctgcgatgataggatatgctgtgatcatgtacttttcaatggtattggagttcaattatgaagtatggtattatacgcttgataaactggaacttgatgatatgcttgctgcaatcggcttggtgctggtttggagaacattcttagcg

SEQ ID NO: 13155 - DNA, 156 bp, Glycine max
  Peptide Sequence Number=SeqID_104840
atgaagagatgcatgatgcaatcaaggaaaccagacatgggactatcaacgacaatgcatcaccaaaagaggaaaactctaaatgaggcctcattgttatcaagcgagtcggggacccagcatgaccataaattgacttccactccctatggctaa

SEQ ID NO: 13156 - DNA, 247 bp, Glycine max
  Peptide Sequence Number=SeqID_104841
atggtaatggatgttattggagggcgagagcatcgttcagcaaaatacgcaaaagctgctcaacactttgtaccaggtatcatagtaaaatacaaaacttcatcttcaatagaggaaggtgacgatgaccctcctagggtgattcttaatcgtgtattttgggcgtttaatccatacattgaaggcttcaaatattgcaagccacttgtgcaagtagatgagacatttttaactggcaaatatcatg

SEQ ID NO: 13157 - DNA, 481 bp, Glycine max
  Peptide Sequence Number=SeqID_104842
gaaaggcgaaacttgccaaggagaagttcaagttagccgctacacacatccggaaggagtgtgtcgaattacgggaagagctaccgcaagagcccttgaacaagagaccaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagttgcctattcaaggtccaaaaggggcttgtctcagcgtttatgtgagacagagaccaacatgctagctatcatcgccaagtaccaagaagagttaaatctagccacggcccacgagcatagggtcgcggacgagtatgcccaagaatacgcggaaaaagaggctagaggaagggtgatcgactctttacaccaagaggcaaccatgtggatgggattggtttgctctttcccttga

SEQ ID NO: 13158 - DNA, 249 bp, Glycine max
  Peptide Sequence Number=SeqID_104843
atgtggaggtccaagtgggacaacttgcaaaatagttggcggataggccgtcaagcagctttagtgctaacactgaaaaaaaatccaaaggaagaatgtaaagctgtcatgataaggagtagaatggaaacccatgtggatgaaagaaaagctgagaagaagatcgaggaacataaacaacagttggctgatgaactgccgctggaaccggttgatgatttagttgaacttgaagaaattgttgaggaa

SEQ ID NO: 13159 - DNA, 676 bp, Glycine max
  Peptide Sequence Number=SeqID_104844
gcgctttgaggccatcagaggatggtcgttccacaaagagaggcgtgtccagctcagggaggatgagtatacggactttcaggaggagatagctcgcagaccttggacgctgctggtgactcccatagccaagtttgaccctgagatagtcctagagttctatgctaatgcttggcccacagaggagggagtgcaagacatgcatgccctcaaccagttgctgggtgacccgctagttttggaggaaggtcaacagtgtgagttcagccagaggaggaacagggttgatgggttcgatgaggaagccattgcccagttgttgtgcacaccggggcaggatttcacccggaccgctgcagggaggcaggtgcagatcatgcgcaccagcatgaccactttgacccagacatggatgacactgctgctcagcaatgtcttacctagcaatcacaactccgatctccctctgcctaagtgccagttggtgtatgccatcctgacacggatgagcatccacgtggcccaggtgattgctgacgccatttatttgtttgcaggtatggcacctaccaggcaccctctggacctagataagtccaacaaggccctggggtttccggcactgatcacgggcctctgccagtccttcggagttcccgtcaccccagtaaagtaa

SEQ ID NO: 13160 - DNA, 187 bp, Glycine max
  Peptide Sequence Number=SeqID_104845
tgataccgaggactttgatgttgattttgagcaactaatgaataatgctgagaaaggagaagatgaagattgggggcttcctccagatttgaaaagaatggtggagcgagaagaaagggaagatatgcctggtttgagctcagacattgtacaacataaactacctataaatcctgagtgttccccg

SEQ ID NO: 13161 - DNA, 300 bp, Glycine max
  Peptide Sequence Number=SeqID_104846
atgaaagttgctgatcccacttgcataactgctcgtacctgctcaggaactggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatccacgatgtcggatacaatgtccaggacatcctgcccgaaaatactggacacataa

SEQ ID NO: 13162 - DNA, 471 bp, Glycine max
  Peptide Sequence Number=SeqID_104847
gcctttcgtgacttcagtcaggctgggaggtatgcatggggagtagttgtgctggtgcatatgtacgatcacctgaatgatgcttctatcagcaccagccgacagcttggtggttacatcacgctgttgcagtgctggatatacgagcactttccctcagtcgcaaagtccattactgatccagactacgacgaggattcaccgcgtgcctggagcgcctggaccgactctggattctggatgtctgttggatcccatatggggagcaccgaccggtccgggacttccataggatttcatgctattccggtctgctgcactgggggccagttgctgtgtattactgaccaaagagggtcatgcggcagtttggatacacccagaccattcctgctctgcttgccgattcatgggtgtcgtttaatgatatacacgataggtggatgcactactcgaaccatatggttgtag

SEQ ID NO: 13163 - DNA, 935 bp, Glycine max
  Peptide Sequence Number=SeqID_104848
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccaaaacggctacgtgcgcagttacggcctcatgatggtcgtcggcgtggtagtcgtcggactcgtcgtcgtcctgggccggatggcctgagcgctggaggagctgacatgtctttcccgatcctcacagtgatcgcgctgctgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13164 - DNA, 276 bp, Glycine max
  Peptide Sequence Number=SeqID_104849
atggtgaaagttggaacctcttacgtgccgatcaacgtctcattttcgccaaaagttggcccagggcttcccggtatcaacagggacaccaggattttttattctgcggggctccagtggctatctggtttctatcagctgttctcctgttcagctactgacggggaattgggggatgtgctgcaagtttgcgataagttgggtaacgctacaggagtgttcccatcactggcttactatgttggcaaaactgtgacgggtgtcagtgaattgtaa

SEQ ID NO: 13165 - DNA, 324 bp, Glycine max
  Peptide Sequence Number=SeqID_104850
atgtttctatcagctgttcctcctgttcagctactgaaaggggtggtgttatccgtaacggcaaaagcacacgccggacatcagcgggcaagtgtaaagcggtctgacgctgacgctaaccaccacacccgccggcttaattgcttgccgctacagggcgcgtctttccattcgaaccatgtcaggctgcgcaactgtaatgaggaagggcgatggtgcgggcctttcgctattgccagctggcgaaagggggatggtgtcccagtcagaacgtgcttcatgtggcaggaaaaaaagctgcacggtgctcagcagaatatgtga

SEQ ID NO: 13166 - DNA, 884 bp, Glycine max
  Peptide Sequence Number=SeqID_104851
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcaaatattctaccggtgacattggctaccaggttcgagaaagtgtaaaaactgcccagcttaaagtaaaggcaaatactgaaaacgtgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13167 - DNA, 579 bp, Glycine max
  Peptide Sequence Number=SeqID_104852
atgtcgcacgtgccggactggctgcagtggctgagctatctgctgtggccgctgtcggtgatttcgattgtgctggtattcagctatttcttctccaccatcgccaactggattgccgcgccgttttgcggcctgctggcggagcagctggaaggacgtctgaccggaaaacccctgccggacagtggctggctcggcatgatgaaagacatcccgcgtatcatgaagcgcgagttacagaagctcggctactatttgccgcgcgcgctgggcctgctgctgctctattttatccccggctttggccagaccgtggcaccggtgttgtggtttctgtttagcgcctggatgctatcgatacaatattgcgactatccgttcgacaaccacaaagtcagttttcctcagatgcgtaacgcgctgcgtcagcataaaaccgccaatatgcagtttggcgcgctggtcagtctgttcaccatgattccgatcctcaatctcgccatcatgccggtcgcggtatgcggcgcgaccgccatgtgggtcgatcgctaccgcagccagcatgcgcgtcatctataa

SEQ ID NO: 13168 - DNA, 525 bp, Glycine max
  Peptide Sequence Number=SeqID_104853
atgatggtggcctgggtgatgttggggtacggctacgagcccggaatgggtttgggcaagaacaacggcggcagaaccagcttggtaagcaccagaggaaacagcgggaagtttgggttaggctataaacctatgcaagctgacataaggaaaagtatctcggaaaggaggaacaaagggaaaagcccacggttgggacagcaagtcgaaggggccccaccctgccacatcagtagaagctttataagtgtgggtttaagacacgaaggccaagtcgccgcgatatgcgaggatgactccccgaggagatcggatttggtacggccatgtcctcctggttttcgactaggaaattggcgagtcaaggagcgcccagacgtttacgcgacaagcataatatccgacgatgagtccctcgaaggtactaatacccgagacccgaccatcaatttcaagcaagaagcgggtcggatggagtgtgaagaggacgaggatgtggggcttcccccagagctggagggataa

SEQ ID NO: 13169 - DNA, 762 bp, Glycine max
  Peptide Sequence Number=SeqID_104854
atgactagagacaagaaccggtcatcagcagggaactcaattcaaaggaaccaatcttctacaggctatcactgggagtcatgctggcaactagattatgatgataaagcagaaggagttattaatctggatgacctgctaatgcaatttaaagatacagtagagtcaatgcaacaggcttttagaagaactacaactcatattagtaagttggtggatgacatggctaacactgcggccagagaagaggaagagcgtatagagattgaaacgtatcaagaaagcatttttcaagttacctccatccataatcagatgaccactgaagaggaaacgtctataatctccagtactccagaatactcctgctcggcctttgctggctatgttagaggaacagagaaaggtagattgaaactcactgtagaggatcaaaaagagtcttttgacctctttgaggccatgaaacattcagatatgggtgatgcttgttctgaggaggaagaggtggaacaggaaatagtattaacaacttcaaccatgaaacaacattttcctttcgaaaaagaattgggtggtgagatagacagcttagtcgataatgaagagtgtgatgatccaaaagacaattgtgttgatcgtgtggttttcgaaaaattggagaaaataagaccaccagtaaagcccaaagcagaattaaaaacccttccagcacatctaaagtatatattcttagaagatgacgagagtgggatcctctag

SEQ ID NO: 13170 - DNA, 387 bp, Glycine max
  Peptide Sequence Number=SeqID_104855
atggcttacgaacggggcggagatttcctggaagatgccaggaagatacttaacagggaagtgagagggccgcggcaaagccgtttttccataggctccgcccccctgacaagcatcaagaaatctgacgctcaaatcagtggtggcgaaacccgacaggactataaagataccatgcgtttccccctggcggctccctcgcgcgctctcatgcagttcgctccaagctggactgtatgcacgaaccccccgttcagtccgaccgctgcgcctgatccggtaactattgtcttgagtcctacccggaaagacatgcaaaagcaccattggcgtcagccactggtaattgatttagaggagttagtcttgaagtcatgcgccggttaa

SEQ ID NO: 13171 - DNA, 872 bp, Glycine max
  Peptide Sequence Number=SeqID_104856
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcataatcatcttctgggaaactgtgagaaatgcaaaatctcagtcccatcccagccctgttgaatttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13172 - DNA, 546 bp, Glycine max
  Peptide Sequence Number=SeqID_104857
atgactgaaatattaaaaattggtgaattttacatatttgtgattgattttgacgtgctagataactggggtttgggtccctccccaaaagatccggaggaactgacgagtaaaacactgtggcatataagcttcgacagtcggcttattgcttttggacgaaggcttgatgccatacaagagccaaatgtgcagcaaaagatcttgaataaattcggctatggccttgcggacaaaaaggagttcaaggaaatacctggcgatctagagttgaaggaaccaaaaggggctgccaacaccaccaacattttggcaagtgttcagcttgagccgattgagatcctcaagattctccaagttgatagcatcaacgtcatcttcattatccatggcagcattgggggtgattacttcaaaattgatatcgacaaacaccaagatgagatgaaagcaagagattcagaggggggatttttaggaaaggcagatgaaggagaattgattttgaagaaggataaaagtgatgaagataaactaaaagtgtaa

SEQ ID NO: 13173 - DNA, 381 bp, Glycine max
  Peptide Sequence Number=SeqID_104858
atgggcttttcaagattaaattcaagacaatacttcaagattacaagtcacaacatcaagatgatcactagtatattaggaagggaattcctaattgaattagcaaaagaacttgtaaaaggaatttacaagatagtggaactctcaagcgggttgcttggggactggacatacggggacctacggggcggggagcatagtccccctccccatccccgaattagctgcgggggatttttcatccccatccccgtccctgcgggaaaatttttctccgatcgtagggtcctgaatgaggcagtccacatggaaatctccgagttgcgaggagaattaccatgcctacttttaccgcttagcatgcattcaacctgttcttag

SEQ ID NO: 13174 - DNA, 245 bp, Glycine max
  Peptide Sequence Number=SeqID_104859
gcgagccgtcagtaaagccggtatcgcgcacagcagcgggcagcactgatcccagcgcagccaccgtacccgacaccctcgaattgccttgcgacctgaccaatccgccaactgggggtttgccaatcaaccttgcagacgcaaaaaagccgggaaatttcccggctgcctcatcatacaccccttttcattcaggatgcaccccgcctggcgttttagctgccaggcggagcgccgccgcatga

SEQ ID NO: 13175 - DNA, 417 bp, Glycine max
  Peptide Sequence Number=SeqID_104860
atggcgaatcaagaagagtgggttccgtttatggatgtattagcattgctaatctttggggttgtcctctttccaaacgtggatgtttcgcacttattccaacaagacataaggcatccatgtccgctccgaagccatcgctcgtgtgtcgagaaaagaagagtagattgggaccaacacttggctgggataggaggcagaacagtcaactggtttccacgatggaaagaaggaaatgagggagttctcttctcatgtgggggctacccaaacatcccgttgataggaacgaggggttgcattaactacaatcccgcacttgctataagaccgttagggtaccccatgaggggagcaccgacggaagaaagcctgtctcctttccttgtgagagattttggcgtgcaaaatttcaag

SEQ ID NO: 13176 - DNA, 825 bp, Glycine max
  Peptide Sequence Number=SeqID_104861
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacataggaacaaaagctggtaccgggccccccctcgaggtcgacggtatcgataagcttgatgagatcttcacaatcgttgtttcctcggcagagtatgctaaggagatactgaaaacccatgatgtcatctttgcatcaaggcctcactttctagtttcagaaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13177 - DNA, 489 bp, Glycine max
  Peptide Sequence Number=SeqID_104862
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcgctgttcatgtgtcctccaccttcgagtttggagctatgtttcatgattgcctaagtgcggaccctcaaggcactcctccattctaccccttttttggaagcccatga

SEQ ID NO: 13178 - DNA, 93 bp, Glycine max
  Peptide Sequence Number=SeqID_104863
atggcacaaattctactgcatgggacccttcaagccaaaatctatgaggtggataacctcaaggttggaagtgttggtaatgttttaaccaag

SEQ ID NO: 13179 - DNA, 884 bp, Glycine max
  Peptide Sequence Number=SeqID_104864
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatggggaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13180 - DNA, 246 bp, Glycine max
  Peptide Sequence Number=SeqID_104865
atgaccataatttgtctccgcatgtcatcgggcccgccgcctctggatgacaaagaaggtgaaaaattacaggaccaaatggttccccacatgtcatcgggcccgccggctttggatgacaaaggtgcagatgaccataattgtctctgcgtgccatcggacatgactgtgtttgaatggcgaaaaggtgagtggaatgaccataatttgtctccgcatgtcattgggcccgtcgcctctggatga

SEQ ID NO: 13181 - DNA, 324 bp, Glycine max
  Peptide Sequence Number=SeqID_104866
atgaagactttaaagactaccgtggatggtaaagctgatcaagctgcacctcaatggattgaagcaaagagccatgttcaaaatggaggctatgagtgtggctattatgtcatgcattggatgtggaacatatggtttggtgatggcacatcattagacatggagaccataacaacaattcgcaacaaatggaaagatccggtggttgtacatgagcccggtggttggccgcctgctggcgaaccaaatgccgcaaatactgctccgtatcaaacgatccgactggaccagcctgatgaggtggcggcgcgtccgcggcctgtg

SEQ ID NO: 13182 - DNA, 78 bp, Glycine max
  Peptide Sequence Number=SeqID_104867
atgacgggtatgaagaggatggggcaggatggaggaatgaaaggtatagggagagaagaagtcatagaagatatggag

SEQ ID NO: 13183 - DNA, 702 bp, Glycine max
  Peptide Sequence Number=SeqID_104868
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatccaggagcaaggtatgtggatgttcttgtactgttcttttagctcttccgtggctttggaatttttcaaaagaaaaaggtcctttggttgccgtggccctcctgggttattgtcctggatttctggtttctttgtccttttacagcatgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 13184 - DNA, 412 bp, Glycine max
  Peptide Sequence Number=SeqID_104869
ggcttcacggtatcaacagggacaccaggatttatttatctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatatagcaaaataagggaggtggttgccgcccaactcgcccaggcgagctcagctcacccaggcgagccaggttgcttcctccagaaggctgttgcttctggaggaagcaacctggctcgcctgg

SEQ ID NO: 13185 - DNA, 310 bp, Glycine max
  Peptide Sequence Number=SeqID_104870
atggtgaaagttggaacctcttacgtgccgatcaacgtctcattttcgccaaaagttggcccagggcttcccggttcaacgaggatgcacaccaattatgtttctcgaatgtttcctcagtttttatgtggcgcttatcgataccgtgcgcctcggggggggcccgacacttatgattctattagtgaggcataccagccggacatcagcgctggcaagtgtagccggggtgctaatgacgctgcgctaaccaccacacccgccgcgcttaatgcgccgctacaggcgcccgctttcccattcgaaccat

SEQ ID NO: 13186 - DNA, 291 bp, Glycine max
  Peptide Sequence Number=SeqID_104871
atgcacacacgaagtttcacaaatccacaattccttagaataggcccaactcacaaaaagtccccagtggagtcgccaactgtcgcaacgtgcccttcgcgggcgagcgagggcgaggctcatgggtgcgctttccaaaggaggaaagatgcgcggagtcgccaccaacgtttatttgtggaaaacgtcggaaaaaccgaaggaaaccggtcgacaaaagcggggctcttgctcctacgtaccctccatcaaagaggaaatcagacctacgtagttcttccttatgcgtga

SEQ ID NO: 13187 - DNA, 519 bp, Glycine max
  Peptide Sequence Number=SeqID_104872
atggtaggcaaagatttgggaagtacgggcggcccccgttatgcacaaattcaaaacaagcatgccttcccaccatatggcttgcctccctactatacacgacccaatgtggcgcacattctcgatgagaataactccactcccatatccattgagagccaacaaccacaatttgatcatgcacatgtctctcaacccatgggcgagacgcatgaaatgccccaccacaatctagcggactttgagccttgcctcggatatgccactgaaggacaagcagttggtggtatatccatgccaaacactttggagggccctcagcttcgcccacaaccacaacccttgcattttgcagtgggaagagcccctcctgctatggctgaaaagggaaagttggatcatatagaggaaaggctcaaggacattgaaggaggtgaagattatgcctttgctaacctaaaagagttgttcctagtacccaaacatggtcatttccaagttcaaggtgccagactttga

SEQ ID NO: 13188 - DNA, 315 bp, Glycine max
  Peptide Sequence Number=SeqID_104873
atgcacgaacacaacttggcaatcaattcgtggggctccggactcgatagtggaggatacttgaatgacaatcaattcatggggctccgaataagatttgatggtggaggatgcacgaacaacgcttggcaatcaattcgtgtggctccggactcgatggcaatcaattcgtggggctccggactcattggtggaggatgcatgaatgacaatcaattcattgggctccgaataaggtttgatggtggaggatgcatgaacagcgcttggcaatcaatttgtggggctccggaatcgatggtggaggatgcatga

SEQ ID NO: 13189 - DNA, 252 bp, Glycine max
  Peptide Sequence Number=SeqID_104874
atgcggggctaccctatggttacttgcaccattcgtcaaccagggccaaacgagtctgttgatgcgcggagactgacatcgtcttctgcaccttttgtcgtcctgacccgggcaaactatcccgttgacgtgcggggatacctaacggctaccgccaactttcttctcctaagggcagatgagcccattgatgcagagagactatcatcttcctcaacaccatttgtcggcctgaccagagaagtcaggtga

SEQ ID NO: 13190 - DNA, 341 bp, Glycine max
  Peptide Sequence Number=SeqID_104875
atgccatcaagcagattccaagatatgctaagtttctaaacgagctgtgcacccacaaaaggaagttcaagggcaatgaaaggattagcatgggcagaaacgtgtcagcattgataggtaaatctgttcctcatattcctgagaaatgtaaggacccagatgtggtgattcatttggcaaatagaagtgttgcttaccccgcatgtttcatagaggatgtgctggttcgggttggtgaacttatttttcatattgatttttatgctcttaatatggaagagggattttcccatggttcagctccaattattttaggcaggccatttatgaaaacagcctga

SEQ ID NO: 13191 - DNA, 450 bp, Glycine max
  Peptide Sequence Number=SeqID_104876
aaggtgctaggttatggttagctaagactgagaagattttcgaggtgatgggttgcctcaaggagcataaggtcccttatgcgacgttcatgctccaaggagaagctgagaactggtggaagttcgtgaaacctacattagcagcacctggaggctactggcctcaatacgaagatgctcggaacgaagaagacttatgtgctcagtttgagaatgggcttggactggagattcaacaggcagttagctacatgcagatcaaaaatttgaatcaactggatgaagccatattccagcaacaaggggaaacaacctatggctacgtccaacatgagcctgtcaaaggggactggggccattatgctcgggagtgtagaatgactaggagaccgacggtaactgccaattctaacacagtcaatcgtggatctactaatcccacaaagagcg

SEQ ID NO: 13192 - DNA, 713 bp, Glycine max
  Peptide Sequence Number=SeqID_104877
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggagtttgtctgatgtccaagagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13193 - DNA, 480 bp, Glycine max
  Peptide Sequence Number=SeqID_104878
atgaaaacgtttcagtttgctcatggaaaacggtgtaacaagggtgaacactatcacatatcaccagctcaccgtctttcattgccatacgaaattccggatgagcattcatcaggcgggcaagaatctgaacggtctggtgataggtacattgagcaactgactgaaatgcctcaaaatgttctttacgatgccattgggatatatcagcggtgttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 13194 - DNA, 426 bp, Glycine max
  Peptide Sequence Number=SeqID_104879
atgcatgttatatttgcctcagaatattcaaatcgttgcaacaagtttcggagatttgggcaatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13195 - DNA, 165 bp, Glycine max
  Peptide Sequence Number=SeqID_104880
atggaaactaaagagagaaaaagtgacggtgttgaccatcacacaaagaggttccgcgattctaagaagaatctcaaggttgagacaataaagattgtaagggtagaggttgatgaagaaggaggagtcggtgtcgtgaaggaattggaggagtggactgaataa

SEQ ID NO: 13196 - DNA, 168 bp, Glycine max
  Peptide Sequence Number=SeqID_104881
atggcggatgaggaaagtcttccggttcagtgtcgtgttccatttgcctcaaggttgttgccgataatggggatagatcctggtctaagcttcaatgcagtcatcaatttcatctcgcttgtgcattcgaaggccgatgcctcaatcagttttaactgcagcgattga

SEQ ID NO: 13197 - DNA, 555 bp, Glycine max
  Peptide Sequence Number=SeqID_104882
aagacaccaggggtcatagaggaaggggagagcttgcctgcctactccagatggatacaaacttgggatccctcatctcaggcaacccagaaatccagggctaggagatccgagggcccaccatcttctgctcctgcccctgctcatgtttctacttcagctccctttgcatcttccccatctacttctacaactctagttcctccagttcttacaggttttcccgctcagagctcagaacattccttatctatgctgcaaagcctgcatcagggccagctcctgatcatgcagagtctgcaggatgtggtccaccagcggccggagcctcagccagcaaagaaggatgcttctgctaacatctcagagccctctccatctgagccatacagttttgagactgatccagttattgttcaggatgatgttgtagtaccagagccatcttctcagcctgagcctgagccatctgcaccagtgttggacttgcctatttcttatgatccaccatctgcaccaacactggacttgaatgatgctacacaggataattga

SEQ ID NO: 13198 - DNA, 368 bp, Glycine max
  Peptide Sequence Number=SeqID_104883
aggactacatgtcctcaccttcagagggctacacgccctcgccgtcagaggactatacgtcctccccttgagaggactacacgtcctccccttcggagggctacacgccctcgccttcagaggactacatgtcccccttttcagagggctacacgcccttgcctttagagggcgacatgtcctcgccttcggagagctgcacactccctcgcctttagagggctacgcggcgccaactgtgcgaatacaactagagagggaggctatcacacaactactatgcataccgggtcaagatttcacccgtgccgctgcaaagagacaagtgcggatcgtgcacaccaacatgagcactcttacacagatat

SEQ ID NO: 13199 - DNA, 270 bp, Glycine max
  Peptide Sequence Number=SeqID_104884
gaacatgggacgaggcgactgattggagaaggacatgaatcacaaggactttactacttggaatccagtccacctggggcttgttttgcaatctcaaagcccaaacttttgcatgatcgtctaggtcacccaagtttaccaaaattgaagatgatggttcctagtctcaagaatcttcgagtcttagattggcattttacatcagtctacatgtcctcacacaccacaacaaaatggcatagcagaaaggaagaatcgtcatcttgttga

SEQ ID NO: 13200 - DNA, 806 bp, Glycine max
  Peptide Sequence Number=SeqID_104885
gggtaaggggccagtggattcctttcgatgcagacgccctcagtcaattcccgagatacccgctagtattggaggagggtcaggagtgcgaatacggtcagaggaggaaccgggccgatggatttgacgaggaggccattgctcagctgctatgcataccaggtcaggattttgcccaaactgctgccgggagacgggtgcggatcatgcgcaccaacatgactacgttgacccagacatggatgacgttgctgctcagcaacatcctgcccaacgatcataattccgacctccctctgccgaagtgtatgccacctaccaggcaccctctagacccagataagtctaatagggccctgggttttccagcattgatcacgggtctctgccagtcgttcggggttcctgtcacaccaagtaaggtgattcgattgctgatcacccgagctttcatagagaagtattgcacgcctagacaggcacagggtggcgacccgcaggccccagacgcaccgccgccacctcatcaggctgatccagcagggtcattgacacggagtggtatttacggcatttggttcgccagtaggcggccaaccacagggcgcacgtacagacccatgattgtctctactagctcagcctcaacctgcaaagccatggtttcgctccttttccatgccctactccggatcagttcagggctgaggtcgcatggcccggagattggcctgaggcccaggcaggggaagcacccgcagaggctcccggcaatgcagatgaggcccgcatggacgaggagatga

SEQ ID NO: 13201 - DNA, 773 bp, Glycine max
  Peptide Sequence Number=SeqID_104886
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttaggccaaacttagcttccctttactcacttgatctctcaaaaaatgaaattatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13202 - DNA, 330 bp, Glycine max
  Peptide Sequence Number=SeqID_104887
atgactagaggcaatccatctgacttacaaccctttgattctgagatagataggacatttcatagattagttaggcatcattttataccttttgatcattctgagcattccattactggtgaagctgtgcattctgttattggtgattttgaacatcctgatcttgagcattataattttgagcaatctgattctgagcattctgattttgcacattctgagaacatggcacaacctccaccccgtgagaggactctaagggaaatggttgcacctgatttcacctacgaaagcttgtgcatccaataccctgatgaggatgtcccatat

SEQ ID NO: 13203 - DNA, 836 bp, Glycine max
  Peptide Sequence Number=SeqID_104888
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacatcctgatgaatctgggtacgcgcatggtctaaaggttcactatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13204 - DNA, 345 bp, Glycine max
  Peptide Sequence Number=SeqID_104889
atgacgttgctacttagcagcattctgcccaacgaccgtaatgtcgatctccccctgcggaagtatcagttggggtcgcgcccacaagacacccagtggacccggagaagtccaacagggctctggggtttccaactttggttacgggcctttgtcagtcctacagggtgcccgtaccccccggcaaggtcatgccatcgcgacatagggatcgcgcccgcaggacaccccgtggacccaaagaagtccaacagggttctggggcttccggctctgattatgggcctctgccagttctacggagtgtctgtcaccccccagcaaggtcatcaggccttctactag

SEQ ID NO: 13205 - DNA, 435 bp, Glycine max
  Peptide Sequence Number=SeqID_104890
atgcagggtgagtatgctcaagcgttacaggaaaatgctatgtgtgctttagcaaacatctctggtgggttgtccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13206 - DNA, 306 bp, Glycine max
  Peptide Sequence Number=SeqID_104891
atggtagccataaccactgctaggttttctcaacctccattttttcgaggatacgactcgaacgcaacatgtgcttatcatggaggagttccggggcattccattgagaattttacaacgctaaataaaatggatagatttgacatctttgtccctcatcctctcataattacatctttgcttctactggaatatgggtgcgagccattgatttgtttgctcaaacgacctgcgctcctgagtgttgacttccaagaccgttcaatcagagattactcgtcttgcacgttggtgggggtgccgtaa

SEQ ID NO: 13207 - DNA, 309 bp, Glycine max
  Peptide Sequence Number=SeqID_104892
atgcaagggttgtgggcgaaactaagggccctccaaagtgtttggcaggggtacaccaccaactgcttacccctcagttgcatatctgaggtgaggttcgaagtcggcttgattgtggtggggtatttcatatgtctcccccataggttgagagacatgtgtgtcacaacctacccttcggcgggagggcaacgtggggctcacgggtgcatcttccatgggaggaaaatgcacggagtcgccaccaatgtttatttgaggaaaacgtcgaaaaaaccggaaaagatgtggtcttcgaactttaagtga

SEQ ID NO: 13208 - DNA, 121 bp, Glycine max
  Peptide Sequence Number=SeqID_104893
atggaactaattgagaatatggctgctagtgatcacgttgcacactttgtggtagagctcatgaatcaggctgttggccaacattacaaccagcaccaaaatcagtggaggactcaccctg

SEQ ID NO: 13209 - DNA, 306 bp, Glycine max
  Peptide Sequence Number=SeqID_104894
atgacaaaggtgcagatgacaatgttagtctctgcatgtcaacgggctcgcttgcctttggttgaccaaggtgtgggaccatatggttcccccgcatgtcatcggactcgtcgtctctggatggcaaaggtgcagatgacaacgttagtctctgcgtgtcaacgggctcgcttgcctctggttgacaaatggtgcgagaccatatggttcccccgcatgtcatcggactcgccgtctctggatgacaaaggtgcagatgacaacgttagtctctgcgtgtcaacgggctcgcttgcctctggttga

SEQ ID NO: 13210 - DNA, 513 bp, Glycine max
  Peptide Sequence Number=SeqID_104895
atgaagcacttcactgacaccctcatcagtgccaacataggaacaaaagctggtaccgggccccccctcgaggtcgacggtatcgataagcttgatctgagcgccctggataagatgcatgaggagcaagagcttttcactgagaagatgagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13211 - DNA, 405 bp, Glycine max
  Peptide Sequence Number=SeqID_104896
atggagataagtatgattgatgttgcatgtggtggagcccttggagacatgacccttgctgaagccagaaatttaattgagaagatggcttcaaactcccagcaatttagtgccaaaagtgatgctattgtcattagaggagtgcatgaagtagccacgaattcatcttcatcaggtgagactaagaaacttgaaggtaaactagatgccttggttaacctggtaacccaacaggccatgaatcaaaaatcttcacctgtcgccagactctatggtttatgctcctctgctaaccaccacacagacctttgcccttctgttcaacaatctaaagcaattgagcagcctgaagcttatgctgcaaacatctacaacaaacctcctcaacctcagcagcaaaattag

SEQ ID NO: 13212 - DNA, 156 bp, Glycine max
  Peptide Sequence Number=SeqID_104897
atgtctgtgctaaagggagcagttgcgctcagctcaccatttgggcttagcgtgcatccaacgctaagtgcagcttcagtgcgcttagctcgacagaagaatctagtagagcatcaagatcaaggccgcgcgctaagcgcaagatccgctcgctaa

SEQ ID NO: 13213 - DNA, 228 bp, Glycine max
  Peptide Sequence Number=SeqID_104898
atggaagctacgttgcgaaggaatatggtcgagcggagaaggaaacttctgcaagacagaatagttgcatccattcttgagggggagactcatttctctgacttattatcacctgattcaccatcgtcaagggaatctgatatgaatggcagcagaatggagaaggaagagagagaggagacgccacttcaaggagaagatgagtcaagaagaagctcaccaccatag

SEQ ID NO: 13214 - DNA, 268 bp, Glycine max
  Peptide Sequence Number=SeqID_104899
atgactaatgcaaactgtctacaagagtcattgcattcagtctcaaacaggaatctaagattatggaaatctatccactattgctttaagtctgaaggaccctctaaaattctcacaaagtttatctctactgacaatggtacttctcatgtcatcaatgcatatctccaccgaccttctgcatctttcaacgagctcaagcagctccacaaggagcttggatcatctcactctcataagaagcacaaaaggcacacaacagagaatg

SEQ ID NO: 13215 - DNA, 352 bp, Glycine max
  Peptide Sequence Number=SeqID_104900
ggacacccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggcacagcgagagtgtggattgaaatcgcaaggaaaacttacttgtga

SEQ ID NO: 13216 - DNA, 860 bp, Glycine max
  Peptide Sequence Number=SeqID_104901
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgacactatttctactgaaatcgatgtgactgactttgaagacctgagtgacgttcaggatactatcaagtctgagtatggtcctgctatggctgacattgatgctcctttgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13217 - DNA, 609 bp, Glycine max
  Peptide Sequence Number=SeqID_104902
atggcagagccatcgaagaagagaaagggatcatcctccaccgctgttgttgctgcccatcgccgccacggcccatccggagcacccacagcacctattcctccttctttgtcatctccaagatcatcaacattgttttcatccgatgatcagcatctacggtacctttctcagttttcctctagaataatattagaccctaagtacacagacatagaattctttaatgatgaaacgtttgattgttatcaagtgtttcaaaattctggtcttgttgatttcatgtcattaaaattgccatattatcctgaacttgtaaaggtcttctactgcaaattaaaaattcaggatggcattattatttttgaggtgcatggtatttctatggtcattgatcagtcactattcttttctttgactcatttacccagtcaaggtgcaccttttgagggcaccattgttgatgactggaaattcgattattcgagtcatgatgctcgtcacatggtttgtaatgatcaagctgaaatgactggtagattgctggccgggtcatcatcatgcattatatcattgttaggattttgcttcctcggtcttcaaatttag

SEQ ID NO: 13218 - DNA, 218 bp, Glycine max
  Peptide Sequence Number=SeqID_104903
gctcatacttagcttatgggctcgaaatctaccctaaggctcatgagaaccttagggccttctcttgcatctctggtccaatctacttggagtcttctatccaatgcccttgcggggagactacttcttgcctttcctctagtggaagtgaagatgatgtaaggggtgaagcgtctagtgaggaagtctacccccatgaagaaggtgacctcttaatg

SEQ ID NO: 13219 - DNA, 309 bp, Glycine max
  Peptide Sequence Number=SeqID_104904
atgaattgcgttttctttcacgtgtcctccaccttcgagtttggagccatgcgtagtgattgcttagtgcaattctccattctcacccattttcggagcccaatgaattgcgttttcgtttatgtgtcctccaccttcgagtttggagctatgcgtagtgattgcttagttcaattctccattctcacccttttgcggagccccatgaattgcgttttggttcacgtgtcctccaccttcaagtttgcagccatgcatagtgattgcttagtgcaattctcaattctcaatctttttggagccccatga

SEQ ID NO: 13220 - DNA, 806 bp, Glycine max
  Peptide Sequence Number=SeqID_104905
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13221 - DNA, 732 bp, Glycine max
  Peptide Sequence Number=SeqID_104906
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcgggttcaagtaattctcctgcctcagcctcccaagtagctggggctacaggcatgccactatgccctgctaatttttgtatttttaatggagatgacgtttcgccatgttgggaggctggtctcaaactcctgacatcaggtgatccatccgcctgggcctcccaaagtgctgggattacaggcatgagccactgtgcccagccactttgggttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 13222 - DNA, 201 bp, Glycine max
  Peptide Sequence Number=SeqID_104907
cccaagcctcttggagtcttctatccaatacccttggtgggtaggattacatcacaagtgtacgctgagaaggaagcaatagggagggtgattgatgcattgcatcaagaagtgaccatgtggatggataagttcgccttgaccttaaatggaagtcaagacctcccgcgactactagccaaagcaaaggccatcgctgaa

SEQ ID NO: 13223 - DNA, 480 bp, Glycine max
  Peptide Sequence Number=SeqID_104908
atgagggaagttgtcgagttgatgcctggtttgggtctccccttgggtttgcaaggtctgccttcggctccgtcggctgtccagaagatttctacttctccagccactaatgttaatacatcgactgcttcagccaaccttgtcgaggctcctctgtccaccgttgctgcacccttgttgagtgtcggcgtggcgaccacgagtgctcctatgatgccacctcctcctttttcatctccactggttcaccactcggctgtgttggcgtcagcgttgccttccatcttttctcaccctagtgtttctttggatcacatctatacttctcgcgatgcttattcactatggggtataggttacaagcctgagcagaagacctcgattggttttgtgtcaacctatgataaaaatcttattcagtcagctgggttcataatgctactgattttgccaaggtcttcctctagcgaagtttggtga

SEQ ID NO: 13224 - DNA, 255 bp, Glycine max
  Peptide Sequence Number=SeqID_104909
gaaaatgggggagatgcttgccacccagctcgcccaggcgagctagattgcttcctccagaagcaaccgccttctggaggaattttctggaaggcccaagtgggcctgaatttcacggattgtgctacaatgctttctcttgacttctggaatctcacagaacttcacgaatcgcctaacgatgggtgccaagtacctcgaagtggtcaaacgagggtcgcatcccaacagcggatggtccccggacgaaattag

SEQ ID NO: 13225 - DNA, 555 bp, Glycine max
  Peptide Sequence Number=SeqID_104910
atgcaggcaaccatggatagactgatgctgcgcctgccgatttttggcgaactgatccgtaaagccaccattgcccgcttcgcgcgtacactgtcgaccatgtttgcagccggtgtgccattggtggaagcactggattctgtggctggcgcctccggcaacaaagtctactttgatgcaaccaagaaaatccagagtgaggttagcaccggtaccagcctgaccgtgtcgatgcaaaacgccaacgtgttccccaatatggtgattcagatgacggccattggtgaggaatctggttctttggatagtatgctgaccaaggtagcagacttttacgaaggcgaagtcgatgatgccgtggctgccatttccagcctgatggaacccgtaattatggttgttttgggcgtattgattggtggcctggtggttgctatgtatatgcctatcttcaaaatgggtaaggtgcttgtaacgatttctcaatctcatcgtagggctgcgcacccagcatacgcttaccattttcaaagaacagggttggcgtactattga

SEQ ID NO: 13226 - DNA, 435 bp, Glycine max
  Peptide Sequence Number=SeqID_104911
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgcccggttaaggctaaactga

SEQ ID NO: 13227 - DNA, 210 bp, Glycine max
  Peptide Sequence Number=SeqID_104912
atgggtgcaagggataaatatatcatgcacaagtaccttcataatcaatctgacaaactgtcataccctaatttcgtccggggattattatttggtgatatacaacctttgattggccgcttcgagatacttggcaccctttgttgcacaatatgtgaagtcccgagacgtgccgaaaatcaaaaggaagcaggcttacgcgattcgtga

SEQ ID NO: 13228 - DNA, 135 bp, Glycine max
  Peptide Sequence Number=SeqID_104913
atggaagaaaactctaccaacttcccttatgttctaagacacatgccttcaaaagatcctctagcaactaaatggttcattcagtctggccatcagtctgaggatgggaggtcaacttctccagggaaaacctga

SEQ ID NO: 13229 - DNA, 687 bp, Glycine max
  Peptide Sequence Number=SeqID_104914
atggcagatgatattgtatttaatcatagaagacaaggtatccaactaacagacaaagaaaaaatgcatctttgtttgatggaaattgaaaacctcttgcaagcgaataggaaaagcctacgagattttccttcaatgccatacccactaggatatgccgccaacccgcaccaaaataatctcatctacaatgaactggcttacgacagggacatattggctgccgaatttgacaaatgctaccagtcgctaacagattatgcatgtggttgcaactcaatcaggtggagtttattttctatatggatatggtggcacaggcaagacattgtgtggaaaactttatcatctgctatacgctctactggcggcattgttttaacagtagcttcaagtgggattgcctcaatactattgcctggcggtagaacaacatattctaagtttgctattcctgtccctgcaacaaaaaattctacatgcaatatctatcaagggagtgatttggctaaattgttgcatatcacaaaactcatcatatgggatgaagctccaatgtgtcacagatacaatattgaggcccttgacaaaagtttacaggacatcatgcacaatggcaatccttttggaggaaaggtcattgtttttggtggtgatttctgtcaaattctacttgttgttccatga

SEQ ID NO: 13230 - DNA, 165 bp, Glycine max
  Peptide Sequence Number=SeqID_104915
atggttaatctatgtctaatgggcaaaaattatgaaagcgacgcagaggtgtctttgaagaagaaattgtatatagatagcggttgttcaatgcatatgacgggagatgatatgaacccacatggcacaagggctgacttaggatcgtctaggattaaaccttga

SEQ ID NO: 13231 - DNA, 756 bp, Glycine max
  Peptide Sequence Number=SeqID_104916
cagaagctcctggctgagaagaccaagaagaagctggaggaagttgcacagacaggaagcgttgatggcatcatcgaccctccatccccggtgagatgccacgtgaagtggaagatggcccgcacgaagaaatcaggggacatgacgactgaggccgcaaaggaaatcgttgcgaagatcgcgacacagggatccttcgtcccccatggacgtcaggatgttctcgccgctgctattggacgtccagagtaccctggacgtgtccgtgctgttggagccggtcagctgacccagcaaatcagggaccagctagaggagtccatcacagagagagtgacgcggcaggtcatggcatcctacaaccagatgcagtcccagattcagtcgcagatgcaaactcagggacttgcattgcctcttgaccctctagttggtcccttcggtcctcgagtgagcacaaagggaagttgtgttgatccctcaggaaatgatcctgagacgggtgactcagataggtgtggcttgtacatcgaaacagatcctgcccgcctggttgccctggggagagtttatgagggatccactgttgttcataacacttctttgttgcctggccaagtaaaggtggttatggaggaggttacagatgcagatgctccagttcctgtacccactgatgaggattccctagtggggcaagcacttcacaccttccttgcttggccgacatatctggtcaagtctttatcacaacag

SEQ ID NO: 13232 - DNA, 722 bp, Glycine max
  Peptide Sequence Number=SeqID_104917
atgcctagcgaaccggtttggttgaatcaggtgcacggtgtgcgcgtgattgatgccgctttatcctcttgcctggaaagtgccgatgccagctttaccaaccggaaacaggtggtttgcgtgacgatgacagccgactgcttgcctgtgctgttatgtgatcaggccggcactgccgtggcggcgattcatgctggatggcgcagtttgtgtgatggggtgattgaagcgacggttgccgcaatgcctgtcaaggctggtcagatcatggcgtggctggggcctgcgattggtccggatgcgtttgaagtcggcagtgaagtgcgggcgcagtttatggcgcaggatatgcaggctgagtctgcattcaaggccaaaggggataagtggttgggtgacttatatgcgatcgcccggcagcgcttacaaacgctaggcgtcacgcaggtgtatggcggcgggcgttgcacttatagtgagccggaaaccttttttagtttccgccgagattgcgatactggccgtatgggtacatttatctgtattctagagtgttttggcctcgcgtttagcacgactaacacgccactggctgcacctttgacgcatgatgtgatcggaccgccattgatggaaacgctcaggcggctttccggcagtgaagatagtgcattgttaaatgcactggcagcagcgtttaaacagcattacgatacgacggg

SEQ ID NO: 13233 - DNA, 438 bp, Glycine max
  Peptide Sequence Number=SeqID_104918
atgaaatcatatggaagtcttggaccggtcggtgctccccatatgggatccaacagacatctgaaatccggagtcggtccaggcgttccctgtacatcagtgtaccgtgatgtaatcaccaaactgtcgactggtgctgataaaagcatcattcaggtggtcgtacatatgcaccagcgcaactactccccaggcgtacctcctagtctaactgaggtcacgaagggcctccaaaaacacaacatgaacatgggttgcactcttgttagcaaaaagagtgcaacccagaagatgaagatgaaacgtgcgagccgcagctgtccaatgtctggcctggcatcgacgttgatagatatcacgtatccattgcaggcgtacatacggtccacgacattgccctgtttcagccctggcagcctctgcagtgaccatcaataa

SEQ ID NO: 13234 - DNA, 542 bp, Glycine max
  Peptide Sequence Number=SeqID_104919
atgacccaagagctggtagcccgcggagataccttacggttatccgcacccttgtgtcatccagaggcggcgggcccgatgacacacggagataccttacggttatccgcgcccttgtgtcatccagaggcggtgggcccgatgacacgcggagataccttacggttatccgcacccttttgtcatccagaggcggcgggcccgatgacacgcagagacaaaatttggtcattctgcacccttgtgtcatccagaggcggcgggcccgatgacatgcggagataccttacggttatccgcacccttgtgtcatccagaggcggcgggcccgatgacacgcggagataccttaggttatccgcgcccttgtgtcatccagaggcggcgggcccgatgacacacggagataccttacggttatccacacccttgtgtcatccagaggcggcaggcccgatgacacgcggagataccttacagttatccgcacccttttgtcatccagaggcggcgggcccgatgacacgcagagacaaaatttg

SEQ ID NO: 13235 - DNA, 365 bp, Glycine max
  Peptide Sequence Number=SeqID_104920
atggttttaggtcatgagtttgtgtgggagccttacacaacaactgttatatcatggttgtctcccatttgtgtagtcagaagtgacgcacggtgcgcggtggtgcgactaatttgtttccaagttattgagtggcaccaaccggatagagtattgagacaatttggaatgcaacaaccaattccagagtctccttcgcagcccttgaacattcatggcataacactgaaaggaaaacatgacgaaaattgggggcaattgttcgccccaatgattgatcagtggaacaattgccatgctattagggtcgacgcttatccccgacaagaggacctattgatctttaactccgactacatggtctg

SEQ ID NO: 13236 - DNA, 1025 bp, Glycine max
  Peptide Sequence Number=SeqID_104921
atgttgggaagacacatattagctgaaaggaaagtggaaatctatcacacagagctggatgaattcaagggcgggctggagaggcgtaactttcacaagtgcctcaccaacttagctgatagtagcattgacctcgcgttggtgaaggagttctacaccaacctctacagtctcgaggggccttcacctaaacaagtcagaaaccggggccacttaataaggattgatgcagacagcctcaattcctttctagaaacacctgtggtgcttgctgagggtgaatctttgcccacctacttaagatattgcaggatccctactgacattagagaaattgagggtcacccagggaagatccttagaaaagatctaaccacccttgctcagctggacatgaatgttggagccctcatttctgggcagattacttctatggcccagtctaactcctcaagacttggttttcctactcttatcacagctttatgcaggaccagaggagttgcctccgacagtcttgtctttgaacgtttgagcccgggggccagaagaccaagggcaaagcttgttgaggcttcttctacatcaacagctcctcatctagcttctacatcagcagctcctcatctagcttctacatcagcagctcctcctccagctcgtattgcaacagctccttctaccctacctcctgcagattctcaatgtttcgaagccatgcttcgaagcatacataaggggcagattattttgctgcaaagtctccagctggtagcacctccagactccatccctacagtagagcaatttaatgaatgggtaggctggccagggactcagcctcctcctcaatgggacgacgaggatcccgccgctcaggtaccacatcagccatcggataagtcatcagagtcttccactcctgagcccttgatcaggaagaggagggtagttgtaactgaaattctgatactgaggacagatgtcgtacaggatgtcacgacatcgcgcttcagaacatgcag

SEQ ID NO: 13237 - DNA, 666 bp, Glycine max
  Peptide Sequence Number=SeqID_104922
gaagatgaagaagtccgagctctaaaattagagctagggaaggcgagactcgccaatgagaagttcaaatcagctgctacacacatccggaaagagtgtaccgagttacaagaggaaaacgcggccactgcaagagcccttgaacaagaaaccaaaagggcccgcaaggaggaatatggccgagagaaattccgaggagcattgtggggtagtaacaatgagctcaagctccgaagagaggagagagatcggtcacgggtgcatggcttgatcttaaagggagagttagttgcttgcgcgaggtccaaaaggagtttggctcaacacttggaagctacggagcaaagcatgttagctaacatagggcaatacaaggaagagttgaaccagtctgtggcccatgaacaaaagctagtggaggattttgcacaagtgtatgtcggaaaagaagcaagggggagggtgattgatgcactacatcaagaagcgactatgtggatggataagttcaccttgaccttgaatggaagtcaagacctcccgcgtccattagccaaagcaaaagccatggccgaagtgtgtatggcccccgaggagattcatgggctaatcaattactgtcaacacatgatagatttgatggcccatataattaggaatcgttag

SEQ ID NO: 13238 - DNA, 207 bp, Glycine max
  Peptide Sequence Number=SeqID_104923
atgttggggaagcttgggaggattgatggggacccggtgttgagagaaacgaggatatgggctacgtgggagtacgtgagctcagttggaggtgggcaacaggggatgagtggtacctggagatatgtcgcgggggtcagagatatgtcgcgggggtgctattgcccaaaaccaagcttgaccaatcccgacccaacccgggcatag

SEQ ID NO: 13239 - DNA, 645 bp, Glycine max
  Peptide Sequence Number=SeqID_104924
atggcacctaagaaacggaaggctccttttacaccttcccaagtcagatatgatcggtctagattcacctctcaagaagcttgggagaggtatactaatataattgtgcctaggaaactactaccaaagagaaatgtagtagtatattacactgagtttgatgagttcaaggaggaactcgagagaagacattgggatgaggagctgactgattttgctgacggcaacatagatgttgccattgtgaaggaattctatgctaatctctatgactcggaagacaagtcacctaagcaggtgaaggtcagaggtcatctgataaaatttgatgaagatactttgaacaccttcctgaagacccctgtaattctggaagagggggagaatctttgtgcttattctaggtttgcactcctgaggccggatcctcaggagttggctgctaagctttgtatcccagggaggggattcgagctaaacgctgatggtcatcctttgaagatattaaggaagaacttgaccactttagctcagacatggagtgttctttccttctctaacttgattcctacctcccacacatctgatgtcacattagacagagccaagttaatctatggcatcatcgtgaagatggatacgaat

SEQ ID NO: 13240 - DNA, 144 bp, Glycine max
  Peptide Sequence Number=SeqID_104925
atgttagtctctgcgtcaacgggctcgtttgccccctggttgacgaaaggtgtgggtaaccataagagattgcaaaagaatatttatacggataaccacttgggtatttccgcttgccccctaacttcacgggttagtgcttga

SEQ ID NO: 13241 - DNA, 195 bp, Glycine max
  Peptide Sequence Number=SeqID_104926
atgtcacaacgtgccctttgcgggcgagcgagggcgacgctcatgggtgcgctttccaaaggaggaaagatgcacggagtcgccaccaacgtttatttgtgggaaacgtcggaaaaaccgaaggaaaccggtcgacaaaagcggtgctcttgctcctacgtaccctccatcgaagaggaaatcaaacctacgtag

SEQ ID NO: 13242 - DNA, 663 bp, Glycine max
  Peptide Sequence Number=SeqID_104927
atgtacaattatcatgtgaaaggaagagctcctgatcttgaaagtgtattggcagacttcatgacatatcaagctagttctaaagattatcaatgggagtcagaatggcaaccttattttcacaatgaagcagtggggttgtctaatctggatgacctgttaatgcaattcaagggtacaatagattcaatgcaacaagcatttaaaagagctgagactcagattggtaagttggtggacgacatgattaatgttgtggttagaagagaaaaagagtatgcagagattgaaacacatcaagaaatcattcttcaagttaacacaatacatcatcaattgatcatcaaagaagaaagagatgaagtctccattattccaaaatatccctgcatagcaactactggatatgttgtaggcaaagataatggtcagttggaactcagtgtagaggatcaaaaaatctcctttgacctctttgaagcaatgaagcacccagatatgagtgatgcctgttgtgacatcctggaaatttctactcggaatttttgtaaacggtgcattttgaacggttatatatatatgagtattattcagtgtatgtatatatgtatatatatattcttggtagaagtaggtattttgggggaaagatacacgggttag

SEQ ID NO: 13243 - DNA, 190 bp, Glycine max
  Peptide Sequence Number=SeqID_104928
ttatggtgagttccctacggatagaagatcgaaacaagcttggttgaggtattacccattgaagaacgatgaagaacgaatgaagaacgtcgaagaacggggaggtggttgccgcccagctcgcccaggcgagccaggttgcttcctccagaagcaacaaccttctggaggaatccattttggaggccaa

SEQ ID NO: 13244 - DNA, 504 bp, Glycine max
  Peptide Sequence Number=SeqID_104929
atgttcggggtctttaatccagatttccccctctacataaagcatgaagacctctccgaaatcgcacacggtggtcaatgtctcagcatatcagtgttacaattgtggattctacatctcactgaaacatgtatacgagtggggaattctgatatctatggattcctcgagccacagtccattcagaggtctgggcaatcgcagtttgagtctgaaagttacataaagagttggatgcagagttcacaaagtgatgtctatcttggagcctacctaaatggtgctatcaagggtcttgatgatgctccacagcctaaatcaaaggcttctgctaggtggattgtcatcaagtgtaatagacaaaaaggaagtactgagtgcggctactatgtgatgcactggatgtccaccatcattttaggaacttttaggaataattgggaagcgtattttaacgatcctagaccattggagccagagagattaaaagcattgcggatctag

SEQ ID NO: 13245 - DNA, 246 bp, Glycine max
  Peptide Sequence Number=SeqID_104930
atggcattgactttgcaagaggctctcctacatcactatggggttctgttagagctatactgggacatccctaaaccatttgattcaagttcatgccgcagtctagctacactgaatggtgcagaattagagaggcaaaacacgggcaaatccaaaggctatgactttgtgactttcaaggaggctgaggctgccaagaaggcttatgaggattcaacaacgctcattatcaatggccgtcgttga

SEQ ID NO: 13246 - DNA, 276 bp, Glycine max
  Peptide Sequence Number=SeqID_104931
ctccagagatggtggcttcagatgagtgatcattttctggttctggctcatgctgttgagctctgggcagataagtctgctaaagctgggagtggggttgaagtagaggatgcaggaatgccagctattggcataaaggaagagggagcatcagctgctctgagcttggtcttccttgcctctggaaatttaactgtttggtctacctggagcggtgcgctcagtgaacctgaaagctcatcttcttctggattcttcctcgcgtttagccattga

SEQ ID NO: 13247 - DNA, 300 bp, Glycine max
  Peptide Sequence Number=SeqID_104932
atggatgaatactttagggtatcaaactgtaaaagtgcaaaggatatgtgggataccctacaagaacacaaaatggaactgttgagattaaatcaacaccaaaaaaatgataagaaaaagaagggaattgctcttaaagcttcatcttcaatccaagaagaaagtgataaggaagacttaattgatttgaatgaagatgatgaacttagccattttgttaaaaagttcaataagttcctgagaatcagaggaaatcaaaggagactaaactttaaacctaaaagaaggacagaagattaa

SEQ ID NO: 13248 - DNA, 501 bp, Glycine max
  Peptide Sequence Number=SeqID_104933
agagacccctggtccatgtggatcctgctaccggcaatgcaaacagtccccacagcaagaaattaagaacatatccggggatcgctgctcgtgataaggttgaacttgatatccctgaagcatttgatgtaaggacaaaaaagaaaatacttcagaatgtgggggagtggtggagacagtttaagtcagatttgacgttgaaatgggcacttgcagctgacaaggatagtcaaggagaaatgagcccaattttgtcagagccgcagagacccttcgtgggaggatgtgcaaaaaaagcacaagccatccagaaacaaaacactgcccctcacgtgatgtctcgtaggggttatgaatatttagaaaagaagttgatggatgagaagagaaagaaaaaactagaggaaactgctcaattcagaagcactgacaccgtcattgatcctccatctcccatcaaacgacacgtgaagtggaagctagcccgcaccaagaaaactg

SEQ ID NO: 13249 - DNA, 489 bp, Glycine max
  Peptide Sequence Number=SeqID_104934
atggataatgaagagggcgtgcaagaacagatgaaggccgacctatcgaccttaaaagatcaaatggcttctatcatggaggccatgcaaaaacttcagaaaactatagaagataatgccacggcggccgcctccaatacagcaagggaagcggaaccggtgctacagcccgcaataaacttgggccgagacagaaacacgacggtgttaggtcggaggtatagtcctcaagcctacccttatggtttgcctccggacttcactccccgtaccgctccagatgatttgagccaagcccctaccttcgaggggcaattccctccttatgccgactatcccctgcaagaagatgatgaaggagatgcccatctaggccctctgcttcccctcaaagatccggcccctcatgaattgccccaaccaaacagtccgccatgtcctgtcttcacccacacccgtaaaagaatccgttccctttgcaaaagataa

SEQ ID NO: 13250 - DNA, 225 bp, Glycine max
  Peptide Sequence Number=SeqID_104935
atgtcccgtggaccgccgccccccacaagggaatactctaaccctgggaactggggcctggccaaagtccagggtggctcaaagttcgatcaaggagatccctgtcctgtgccctattcactaagagggggtaaccttgggcaataccaatccatttttggtttctataagcccggggggatttattatccagggaatactcctccaggttataaagcccactag

SEQ ID NO: 13251 - DNA, 408 bp, Glycine max
  Peptide Sequence Number=SeqID_104936
atggtctatgttcttcagcagatcaccatacagatctctgtccttctttgcagcaatctggagtcaatgagcaacctgaagcttatgctgcaaacatttataatagacccccttaacaacaaaactaagaacaacagaataattatgacctttcaagcaacatatacaatccagcttgtccctcctttccaaaatgctgctggttcaagcaagccatatgttcctcctccaatacatcagcagcaacagcaacagtcacaacaaagacaacaagcaactaaggctcctcctcaaccttccttagaagagttagtgaggcaaatgaccatccagaatatgcaatttcagcaagagacaagagcctccattcatagtctgacaaatcagatggggcagatggctacttag

SEQ ID NO: 13252 - DNA, 998 bp, Glycine max
  Peptide Sequence Number=SeqID_104937
atgccctcttgggggaagaaaaccatatcttttcttcgggtttcttccctccttgagcaagattgcagctgtggtcggagatttggcgagagagttggatcgtatgaagcaaactcgaaacggcgtagtgggcctactgcggaaatacttggaaggcaaggcaagggatatggcgaatcaagaggaatgggtcccgtttgcggatatactagctttgctaatctttggggttgctctctttccaaaaatggacggtttggtggacctagccacaatttgatgctttccttgcatatcaaccatagcaaggagagcccagtggtggctatcttggcagacttatttgatacatttgaccgaaggtgcgagaagaacagcgcacggatcgtctgctgcttacccgctctttgtgtgtggttggtttcgcacctattccaacaagacataagacacccgtgtccgcttcaaatttattgctcgtgcgtcgaaaagagaagagtcgattgggaccaatacttggctgggataggaggcagcacaatcaactggtttcctcgatggaaggaaggaaaggggggagttcttttctcatgtggggactacccaaacgttccgttgatagggacgaggggttgtattaactataatcccgcacttgccataagacagctagggtaccccatgaggggagcaccaacggaagagagcctctcgcctttccttgtgagagatttcggtgtgcaaagtctcaaggttgtacaaagagtccacaaggcgtggaaaagtccgttgaggaaagataaagaacttaggggcatccgtaatggcatcatcggtggttatcatgaatggctaagagttcatacgcgagggttagattggctctccaagttgaaagttatcaacgaggagaacttcaaagctccggaagaggatgaagaagtccaagctctaaaattagagctagggaaggcaagactcgccaaagaaaaattcaa

SEQ ID NO: 13253 - DNA, 794 bp, Glycine max
  Peptide Sequence Number=SeqID_104938
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcggctaaggtcagcagtgaatgtaacgatatcgtgatggcgagtttcaatatcaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13254 - DNA, 903 bp, Glycine max
  Peptide Sequence Number=SeqID_104939
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgacttgtcttgttggagctggtcctgatggaaaacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 13255 - DNA, 861 bp, Glycine max
  Peptide Sequence Number=SeqID_104940
gaaacgcaagagtatcggtcaagacccacaacacaatatgatacaaggagatttcactccttagatgcttggaaccggtacacagataatgtcctggggaaaaacatcttgcctgagaggaaggtggagctctaccacactgagctaaatgattttaagactgaattggagaggcgtaatttccataaatgcctcgccaatttggttgatgggagcatagacttggctttggtgaaagagttctatgcaaacttatacagctctgagggcccttcaccaaagcaagccagagtcagaggccatttagtgaagatttatgttgacagtctcaacagattcctagagacacctatggtattggaagagggtgagactttacccacatactccggatactgcaggttgcccacaaattacagagagattgaggttgccttatgcatattgggccgagggttcattttgaacgctgggggccatcctgggaggattctcagcaaagatttgactactttagcccaggtgtggagtgttctctcatactataacttggcccccacatcacatacctttgatatgatagtggacagagctaggctgatctttggcctagtctctcgcatggacattgacatagggactcttatttctggccagatgacttctatagcccagtctaacacttctagacttgggtttcctactctgatcaccgccctatgtagagccagaggggttgtctctgacagccttacttttgagcgcctgagcctggtcattaagttggcctacatcaggaagaactgttggaatcacgaggatctaattatttctatccaggggctaggagggcgagcgtaa

SEQ ID NO: 13256 - DNA, 882 bp, Glycine max
  Peptide Sequence Number=SeqID_104941
ggactaaacatcctcgctttccgaggactacacattctcgccttcagagggctacacgccttcgccttcagggagctgcacgccctcaccttcaaagggctacacgccctcaacttcagaggactacacgtcttcgccttgaggactacatgtcctcaccttcagacgactatatgtcctcacactaagagggctacacgccctcgccttctgaggactacacgccctcgccttgaggagtacacgtccacaccttcagagggttgcacgccctcaccttcagagggcttcacgccctcgccttcaaaggactacacgtcctcgccttcagaggactgcacatcctccccttcagaggactacacgtcctcgccatcagaggactacatacgcctacatgtcctcacactcagagggctacacgccctcgcctttaaaggactacacgtcctcgccattagaggactacacatcctcgcattccgaggactacaagtcctcgccttcagagggctacacgcactcgccttcagggggctgcacgcccacaccttcatagggctacacgcactcaacttcaaaggactacacgtcctcgccttgaggactacatgtcctcaccttcagacgcctgcatgtcctcacactcagagggctacacgccctcgccttcagaggactacacgcactcgccttgaggactacacgtcctcacctttagagggctgcacgccctcgccttcagaggactacaagtcctcgccttcagaggactgcacatcctccccttcagaggactacacgtcctcgccatcagaggactacacgttctcgcctttaaagggctgcacgccttcactttcagaggactacacatcctaa

SEQ ID NO: 13257 - DNA, 831 bp, Glycine max
  Peptide Sequence Number=SeqID_104942
atggcgccttccgcgccggtggaggagagcagtgagccgatcaccaatctcagcacgccttacccgatcacgctgcgcctgttggcgttgaacaacgtcaaggtcaccgtcgacgacaccgccatctcgctggccgagttccgcaccggcgcgcagtggcaagagcgcgcgctgacgctgatgccgaccaagatcggctcgctgctgatcgcattgccgaaaaccccgcaaaacccgctgccggaagcggtgcagccggcggtcgaggtggcgaaaaaggtcggcgagcaggttaccgacgcggcgaagccggcacctcagccggaagagaagccgctgggcgaaacgctgaaggaactgttcgccaaaccgctgttgccggatctgccggacatccgcctgccgctggatatcaccgtcaaagagatcagtggcgaacagctgcgcttgaccggcgataccgacgtgctgatcacgagcctgttgctgcaggccagcacgcaggatcaacatatccagctggacaacttcgacgtgaagtcgccgcagggcacgctgtcgctgcaggggcaggcaacgctgaccggcgactggccggtgtccctgaccgccaacagcgcgctgaacatcgaaccgctgaagggcgagaaggtgaagctgaacgtcggcggcgggctgcgtgacgagctgaaggtggcgctgaacctgtccggcccggtcggcgcccagctcgatgtgcaaacccggctggccgaagccggcctgccgctggcgctgacgttgcagagcaagcagctgaaatggccgctgagcggcgaggcgcagtatcag

SEQ ID NO: 13258 - DNA, 887 bp, Glycine max
  Peptide Sequence Number=SeqID_104943
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcataatgctagcaaccagctgtgttgattcacttgcatttgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13259 - DNA, 198 bp, Glycine max
  Peptide Sequence Number=SeqID_104944
atgtttgttctcgcaggaaatggccccaaggaagctatgcctcagagagatccaggaaggataaagcggctgaaggaaccagttccgctcccgaatatgacagtcatcgttttaggagcgctgagcaccagcagcgcttcgaggccatcaagggatggtcatttctccgggagcgacgcgtccagctcaggacgacga

SEQ ID NO: 13260 - DNA, 362 bp, Glycine max
  Peptide Sequence Number=SeqID_104945
atggagcagcgtggacatggaatgtattacacgccaccaacatttgctcagtatccttcgcagatgtatcagtatcctttcgaaggccatgacactgatatgtctgcaagcgaacattcgtttggtggtgttgcggaaacacaacctaatttttcatggccgaccatgaccccttcgcagcaacatgatgccccaatggcaacacctaatgccccattaggtcagcaatgggatgtacccggagcaatccctgcaatgggtgacttattaggtgttgatttgcgtcacgagttttctgcagaggctgaggaacaagggcggagacagcgcgcaagaagaaatccggatcgtcaagcccgaag

SEQ ID NO: 13261 - DNA, 189 bp, Glycine max
  Peptide Sequence Number=SeqID_104946
atggatcctttcgttaagcgcaagcctcgcactaagcacatctttgttcatgcgctaagccaagattctcacacgtttagcgatcaaccccggcatctgaggctgatttggtccgctaagctagccaaggctgagctaagccaatttcagttcgatcagaattcggctaagcgaaggtctaaccgctaa

SEQ ID NO: 13262 - DNA, 193 bp, Glycine max
  Peptide Sequence Number=SeqID_104947
aagatcacccttgaggattattcaagcagctcagtaccgcaattctttactagcattgcacatcctgaagtgcaagctcacgaagaaaagcttgttgtaccatctgtggtgaggctcatgaaacaagccaatgtattcccactaaagaaaacactcaagaaattcattatatgggaaatcaacagcgacaagg

SEQ ID NO: 13263 - DNA, 184 bp, Glycine max
  Peptide Sequence Number=SeqID_104948
atggccccgaggaagcttgcctcaaagagatctaggaaggacgccacggccgaagggactagtgccgctcccgagttctatagtcatcgtttcaagagcgctgagcaccagcagcgtttcaaagccatcaaggggatggtcctctccacccgagagagacacgtcccagctcagggaacgacga

SEQ ID NO: 13264 - DNA, 96 bp, Glycine max
  Peptide Sequence Number=SeqID_104949
atggtagccataatcccagaaaagattcctcaaccttcattttcccaaggatacaactcgaatgcaacatgggcttatcatggaggagctggctaa

SEQ ID NO: 13265 - DNA, 165 bp, Glycine max
  Peptide Sequence Number=SeqID_104950
atggagcaagtgtccaagtggaatttgcttcaagagcttggatttcctcatgcattgctcgatgccattcaggataaggaacaacttgatgatagaactgagagggcaaagtgtgaggatgatctgaggcagggattgagggtgaatcaattgggtcatggttaa

SEQ ID NO: 13266 - DNA, 447 bp, Glycine max
  Peptide Sequence Number=SeqID_104951
atgtcgtttgaatttgctcagaggttcaacattcaatttcaagcgtcccgatatattacgaactcaataggacatccgagtaaaaagttattgtcgtttgaattggctcagaggttcaacattcaatttcgagcgtctcgatatattatgggactcaatcagatcatccgagtaaaaagttattgtcgtttgaattggctcatagagcttcaacattcaatttctgagcgtctcgatatattacgggactcaatcagacatccgagtaaaaagttattgtcgttgaattggctcagagcttcaacattcaattttgagcgtctcgatatattacgggactcaatcagacatccgagtaaaaagttattgtcgtttgaattggctcaaagcttaacattcaatttcgagcgtctcgatatattacgggactcattcagaacatcctag

SEQ ID NO: 13267 - DNA, 507 bp, Glycine max
  Peptide Sequence Number=SeqID_104952
atggaaaaacaaccccttaaggctggtataagacacattacttctaaatgccccaccaagaaaaccatgattaggaggggccaagacatttatagtagccaagatgaggctactacttcaccttcctctagtgaaagtgaagaagcaaaaggggaagaatctattgaagaaatctacccccaagaagaaggagaacctttaatggttaaggaggagtgtaaggagacacttgttagcactgccacacctcttgggcttgaggttattcctcaaataaaggagttgttggatgagggtcgggttcccacaaaccctaagagaataaaggtcattcctgattggcccactccaccaagtataagggaaatctggggctaccttgacttaacaaactttttgatgcaatcctaccccccaagggcattggatagaagactccaagaagattgggccaaagatgcaagagaaggccctagggttctcatgagccttagggtagatttctga

SEQ ID NO: 13268 - DNA, 378 bp, Glycine max
  Peptide Sequence Number=SeqID_104953
atgagtcatcattcatctagtgttaatggaaagggtactagtcatagggaccctctatctagaatcttagatgagttgagttccctcaagttatggaaagaaaaactagaaagaaaagaaaaaggaaaagagagggacaatgtagtggctaacttagattgggaaataagggtagagcaacaacttaaaaggaagtctacttcaaaatcttatggctctcactcttatccaaagaaagaccaaggtcaaggcatcttaggggtgacaccttctaagtccaaagatgataagggaaagacaatagaaaggcaatcctttaaggctagtatgcaagagaagactagatttataaagtgctttaaatgtcttggaagatga

SEQ ID NO: 13269 - DNA, 258 bp, Glycine max
  Peptide Sequence Number=SeqID_104954
atgattaacagggacagtcgggggcatttgtatttcatagtcagagaacgaaagttgggggctcgaagacgatcagataccgtcctagtctcaaccataaacgatgctgaccagggatcaacggatgttgcttttaggacttcgctggcaccttatgagaaatcaaagtctttgggttccagggggagtatggtcgcaagactgaaacataaaggaattgacggaagggcaccaccaagagtggagcctgcggcttaa

SEQ ID NO: 13270 - DNA, 513 bp, Glycine max
  Peptide Sequence Number=SeqID_104955
atggaagaagaggaagatttggacgaggtcgattccaccaccgagatcgagattgagctagaaaatctcggggaagggggtcttgtaggcatggtagccgtggttggtggcaacaaaagcgaatcacccatggaagaggggacgcgaagatggcacgccgtgtttgatctggctggtttggtggtgttggaggtggatgttcgccgaggaggttccgatctagctgatggtggaggtgatccgacggcgatgttggagccgggaatgatcgtggagtcgccgacctcgtcgagttcaatgcccggagggatcaatagctgggattcaaaggaagacgaaggaagagggttggtggtgggggttttggaggcgttgcttgaatgggaaagagggtggcggaaggagaaaagagaggtgggacactgcaggttttggagaagagagaggtggcggaaggagaagagagaggtggaggttttggaggcgttccttgaatgggctacacgacactga

SEQ ID NO: 13271 - DNA, 519 bp, Glycine max
  Peptide Sequence Number=SeqID_104956
atggctacttctggtcctattttttcattttctggaaccccaaccattgcaactgccaagctcaactggaaaaattatttgtcgtggtctgcttcagttgagttgtggtttcttggtcaagggtaccatgaccacctagagaaaaacgtcaatgctgttccaaacgacaagaaacctgaatgggagaaggtagattatcaactatgtgctgttctgtggcaatcggtcgagtcagatgttttggaaattttcagatcttttaaaacatgtcatcttttttggaagaaggcccaagagatcttcgccaacgatattcaaagcctatttgatgcgactgtgaaagttacagctctcaagcaatctaaccatgacatgattgcacatatgggtaaagctcgggcagcagtagaagagctgagaaggtttcttgtggctgatttgttggaagaggtgaataggaaattggacaagttctacatggtccttatcttgaggagtctacactcagattttgatcat

SEQ ID NO: 13272 - DNA, 159 bp, Glycine max
  Peptide Sequence Number=SeqID_104957
atgcggaaattgattaaggaaaggatggaaaataaggtggttaatttcgtgggtcttaataaggtggttcttgacataaaatggatgagtgggatggagttatggccacgagataattctgggcagaggtggattttctggaattgtggtttcaaataa

SEQ ID NO: 13273 - DNA, 636 bp, Glycine max
  Peptide Sequence Number=SeqID_104958
atggcttctcatctaaaaggtgttgcaaaatcaactttgtcagatcaaatacgtaaggagttgtgtgagtacaagagagataatcctgcaagcacacaaaaagacttgcagagatggcttgaggaaaaatttgagttgaaagttagtcaaggaacaatatcaaacacacttaagcggtcaaatgactatctctctgctgaaatagaaaagggaagagcagagatcaaaagacacaaaccagcaaaatatcctgacatggagaaggttgtttatgagtggtttctccagcatcaagagcgtgtgaatattataagagaattaattttgcagaagacaagagatacaatgaaactcgtgtaccctcatgatgattcagattttaacttctctataggatggcttgggaaattcaagcaccgacatggcataaagtcatttcgtcgttttggcgagagtgggtctgttgatgtacaagacatggagcagaaattggtatcgattcaggagaaaattgatcagttccctataaagatgttttcaatatggatgaaactgggttgttttataggttacaagctgatcattcactggcaacaaaacaacttgaaggaagaaaataaaataaagaaaggctga

SEQ ID NO: 13274 - DNA, 348 bp, Glycine max
  Peptide Sequence Number=SeqID_104959
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggaagattcctgatttgatgggatgggtccaggttccaaaggatagactattggtcatagggacattagagaggaaatcaatatctctagacaaagag

SEQ ID NO: 13275 - DNA, 327 bp, Glycine max
  Peptide Sequence Number=SeqID_104960
tcaggtggcaggcggagatacccaagtggttatccgtataaacactctttctctatccgtcagactcaaagtccgagacggtgagttcgatgacatatggagatacccaagtggttatctgtacaaacaatttctgttaatcttaacccatgaattcaggtggcaggtggagatacccgagtggaagtcaggtggcaggtgggggtaccgtatggttatccgcacctttcgtcaaccagggggaagcgagcccgttgacacgccgagactaacatcgtcttctgcaccttttgtcatccagagacagcgagtccgattacatgcggg

SEQ ID NO: 13276 - DNA, 565 bp, Glycine max
  Peptide Sequence Number=SeqID_104961
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccatgggtcatgatcacttgatgattttcggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13277 - DNA, 186 bp, Glycine max
  Peptide Sequence Number=SeqID_104962
atgttccttgtattcaatagtgctttgaaaggacttgatgatactccacaacctaaatccaaggctggtgctaggtggattgttgttaagtattttaatgatgttagaccattggaagcagagagattcaaggcgcttcgcatccagtggacacagtattatctgaaacttagagatcaaacttag

SEQ ID NO: 13278 - DNA, 561 bp, Glycine max
  Peptide Sequence Number=SeqID_104963
atgtcaaaatataatctgcatgttctgaagcgtgatgtcgtgacatccggtacgacatctgtcattggtatcagaatttcacaccctttggacccagataagtccaacagggccctgggattccccgcactgatcacaggactctgccagtcgttcggggtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatagccagggcttcgcttctttttcatgccctactccagaccagttcagggcagaggttgcatggcccagagattggcccgaggcccaagcagaagaggcacccccagaagctcccggcgacggagaagaggcccacgaggatgaggagatggccgatttgcttgacttcttgggagggagtggagatacgtga

SEQ ID NO: 13279 - DNA, 408 bp, Glycine max
  Peptide Sequence Number=SeqID_104964
atgtcgctgcatgttctctatctttatgcgttttctagatctccccccccagggaatgctttccggtccgctgtatcccttgttacggtctttcaaagaaatgaacatggatttgaggcttttaagtcctcacgggcaggtatcatgcctttttgggtacttctaaggagtgaatgtcccactaaaactaactttccagaatgtttgttcgcaggaatggcaccgaggaagcttgctcaaagaggtccagggaaggacaaggcggccgaaggaactagttccgccccggatgttactgcagtcaccgctttaggagcgttgtacaccagcagcgtttcgaagccatcaagggatggtcgtttctccgggagcgacgacgttccagctcagggacgacgagtatactga

SEQ ID NO: 13280 - DNA, 378 bp, Glycine max
  Peptide Sequence Number=SeqID_104965
atggcttacgatacatctggacgacgatatggtcacatgacaaccaacctatcagaatttgtgaataaggtgttgaaagattgtcccagcattccaataacattgttggtcaagtcaacatatacttgtggttacgtgagcatgaactactaccaatatatggatgttgtttacaccaatgagcacatcttaaaagcatactccgcacagtggtggcctcttgggaatgaagcggcaattcctccttctgatgaggcatggacactaatccctgacccaactacaattcgtgcgaaaggtcggccaaaatcaacaaggataaggaatctaaccaccgacaaaaatgtagtagatgtggagcagaaggggatcctctag

SEQ ID NO: 13281 - DNA, 285 bp, Glycine max
  Peptide Sequence Number=SeqID_104966
atgtcaaatttacgcaacaccggtgtgcgcaccgatgatataggatttacgttggtagacctaaagaaacttggttaccacaatgaccatttcatcatggcagaacaagctagacaaggcaaaacaattggtgttaatgtagaagatgatgattcatacatggacacctatgttagtcctttgaccactcaaatcactcctaacgttgtcggagaagaagaagctggaaacgttcatgctaatcaaaatgatcatgatgaaggagaattgattaacaccgtgtaa

SEQ ID NO: 13282 - DNA, 336 bp, Glycine max
  Peptide Sequence Number=SeqID_104967
atgacattaacctataaaaataggcgtatcacgaggccctttcgtctcgcgcgtttcggtgatgacggtgaaaactctgacacatgcagctcccgggagacggtcacagctgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 13283 - DNA, 588 bp, Glycine max
  Peptide Sequence Number=SeqID_104968
atggaggggtaccgaggccctcaattcgtaatcggtcatagcgtttccgtgatgacggtgaaattgttatccgctcacaatatccgagacacaacatacggagccggaagcatagacaagcccgtcagggcgcgtgcgggcgccattcgctgcattcaggctgacggccaactgttgggaagggcgatcggtttgcgtattggcgctcttccgctattacgccagctggaaactcgctgcgcggatcgtgctgcaaggcgattaagttgggtaacgccagggttttcccagtcagacgttggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccg

SEQ ID NO: 13284 - DNA, 564 bp, Glycine max
  Peptide Sequence Number=SeqID_104969
ggcgaaggcgctggcgatcgagggcgtcagcttgctggggctctgggcggtgccgggctcggcaaaggcgggctcttgccgtgcaggggccgcctgccttccgaagtcgatggtggcgggagcaattgtgtcatgcactcgtggctgtcggaatcaggaacggcccattgcggctggtatcgtcgggcgaatccatcgcgcccgaccatcgattcaggaggccgaacacgtgcgcagtctggcgtcgccagctatgcgttcgccgtggcgcgtgccgtgccgacgaagatgcgcgcggcgcccaggttcaagttcgtcagtccagccgcgcggcacggcatcgccatctgcaggaagctgcggctctcgccattcgtggccagcggccacgggttctggccgaccggacgcgggaacttcggtccacgccgatgcggaggcgcggccgtggtagccgatgggcacccacttgtagttccggcccagcaggcacggggtgcaggtcggaactgcttgccgatggcggtggcgtggtgcaccagatgtagaagtccggtccagtag

SEQ ID NO: 13285 - DNA, 357 bp, Glycine max
  Peptide Sequence Number=SeqID_104970
atggccttagcaaacttattattccaaaaaggaaattcaataaataggcctcatatttttaatggagagggttaccactactggaaaacccgaatgcaaatcttcattgaggcaatagacttgaacttttgggaagccacagaaatgggaccttatgtgcccaccatggtggctggaaataaaacaacagaaaagcctaggaacaaatgcgtattcatggacaagattctaaaggaaaaggagaaggaagcaatgaggattctcatgttgatgaaaccaaaaaaaatgatgatcttccaagagaatggaaagcttctagagatcatccccttaacagcatcattggtgatatcttaa

SEQ ID NO: 13286 - DNA, 342 bp, Glycine max
  Peptide Sequence Number=SeqID_104971
atggctataacctatggaagcaatgacttccaagattattttgatgatgccaaagaatcaagagttaagcaagttccaaagaatcaaaagtcaaaaagcttcaagattcgatcaaggtacatcctttgtggcacaagtagagggtacatctacttgggttgttatactgagaacaagagatggtacatctcttgtggatcagttcaagtggagggtgcatccacttggttgtgcaaagagaacaatggagggtacatcccttgtggatctttggcttgtaaaggattttacaaggttgaaagaaatctcaagaaccgttggttgcttggggactggatgtag

SEQ ID NO: 13287 - DNA, 261 bp, Glycine max
  Peptide Sequence Number=SeqID_104972
atgtcgtccaaggttattttgatgatgccaaagaatcaagagttaaacaaattccaaagattcaagaatccagtttcaagagtcaagaatcaagatcaagattcaagactcaagattcaagaaacaagagaagactcaatcaagataagttctaaaatgtttttcaaaacattgagtagcacaagaagctttcacaaaatcattaccaaagagttttactctctggtaatcgattaccagaaggtagtaatcgattactag

SEQ ID NO: 13288 - DNA, 633 bp, Glycine max
  Peptide Sequence Number=SeqID_104973
atgaagattattatctcaatcccattaatgaactgtgatttagccagaggagagcaacataaagacagttgttatttttattctgtaaataaccatgattggagacaggaaccggtcatttatgaatatcttgaagaggaaagagtccctgatcttgagagtattttggcagacttcatgacataccaagccagctctaaaggatcttgttatggaatgcaacagcagggaactcaatttcaaaggaaccagtcttctacaggctatcactgggagtcatgctggcaaccaaattatgatgataaagcagaaggagttattaatctggatgacctgttaatgcaatttaaagatacaatagagtcaatgcaacaggcttttagaagaactgcaactctaattagtaagttggtggatgacatggctaacactgcggccagagaagaggaagagtgtatagagattgaaacgtatcaagaaagcatttttcaagaaacgtctataatctccagtactccagaatactcctgctcgaccactgctggctatgttagaggaacagagaaaggtagattggaactcaatgtagaggatcaaatgtggaagcaaagcttcatgatgaatcaaaagtga

SEQ ID NO: 13289 - DNA, 78 bp, Glycine max
  Peptide Sequence Number=SeqID_104974
atggaggctgtgctaccgcttgaggtggaagtcccgttgatcgaggccgtacccgaatcaaataaacatgaaaatgca

SEQ ID NO: 13290 - DNA, 355 bp, Glycine max
  Peptide Sequence Number=SeqID_104975
atgcgaccacatgacattcaagaggattatgtgaagatgaaagcatttccattctctctggatgggttgatgttaatggacaagagtatgattgatgcagccagtgaaggcgctttaatggacaaaaatcttgttgttgcaagacaattgatttctaacatagcaaccaattatcagcaatatggtactaaaatggttgcaacatccaaggttgttgcaaatgaagcttttgtttttatggttgttgataagcaaaggttggagaacaaacttagagaattgacatcccttgtgagacaactagccattggtcaacaacaaaatgtgataatagcaaatgaaccaaggctatatg

SEQ ID NO: 13291 - DNA, 267 bp, Glycine max
  Peptide Sequence Number=SeqID_104976
atgttgcgaaactttacggattacgcaacaatgctctttttgacttctggaatgttgcggaactttacggattgtgcaacaatgtttcttttttcttccagaatgttgcggaactttacggattaccaaacgaagggggttaagtacctcgaggcggtcaagcgaaggttgcatgccaccaaacaatggtccccggacgaaattaggaaactatcactggtaatcgattaccaaatcagtgtaatcgattacacagattttttgtga

SEQ ID NO: 13292 - DNA, 410 bp, Glycine max
  Peptide Sequence Number=SeqID_104977
gtgtgacttctacaagtgcaaatgctactccaccatctccaaaaactgtaaggctcatggtggagatgattaaacttggtgatccaatgagaagaatgaataatgaagatgaagaaaggatggagagaatgagaaaggagagtcagggaagaatacacaggagtagtgaagctttaaatgtgaggattgaaaatatagagcgaagaagagatgatagatcatctaattcttctaatggagaagatgagaggtatgaagaggatgagggaggaaggaggaatgaaaggtatatggagagaataaatcatagaagatatggaggtagacaaagaaaggaagggattgagggagtgaaggtaaagatccctacttttaaagggacttatgatccaaaagtgtatcttgagtga

SEQ ID NO: 13293 - DNA, 333 bp, Glycine max
  Peptide Sequence Number=SeqID_104978
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggggggttacattggtgttggagaagatggtggtaatggtgttgtttcaatagatggaggaacggtaaaggttggacgagaattggaggtgtag

SEQ ID NO: 13294 - DNA, 553 bp, Glycine max
  Peptide Sequence Number=SeqID_104979
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacagcggataacaatttcacacaggaaacagctatgaccatgattacgaattcgagctcggtaccccatgcaagagtgtatcaccaccatgactccagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13295 - DNA, 378 bp, Glycine max
  Peptide Sequence Number=SeqID_104980
atggatttcttttccaatgagagttttgaatgccttcaggcatttcagaactcaaatctcattccttttatgtctttgaaattgcctgtttattctgaattagttaaagccttttattctaacctcgaaattcaagaaagcactttgatttctgaggtttttgggataaaaatggtcattgaccaatccctattctatgacttgacccaattatctagtgaaggtgtaccatttcaaggtgcagtgaaagatgattggaaatttgatttctctgtgcatgatgcccgccagttggtttacaccaaccaagtggatatgaccggaaggctgcttgtaggttcattggcttttgaaagccgcatccttcactatcttatt

SEQ ID NO: 13296 - DNA, 363 bp, Glycine max
  Peptide Sequence Number=SeqID_104981
gaatgtcctgaattgaagttatcctcccatggaaggaaacttcaaaaatatgggaggtctgctgctgagattgaagggttagttgatgctacaagattaagtcctctgatcgcatgttcattggacactgatgatcggggacttatattggcttttccggagaggtggcataaggaaactaacagtttccatcttccagtaggagaggtcaccgtcaccctcgatgatgtggcctctttgcttcatgtgcccatcacaaacaccttccacagcttcaagactcttcatgtcgacgaagcggtgttgatgttagtggaattacttgaagtcagtggagatgaagccagagttgaaacaatatag

SEQ ID NO: 13297 - DNA, 613 bp, Glycine max
  Peptide Sequence Number=SeqID_104982
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagcaccccaggctttacactttatgcttccggctcctactcgtgttagcacaaaggagagttgtgttgatcccttagggaatgacccagacacgggtgactcaagagaaatgcgggttagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13298 - DNA, 339 bp, Glycine max
  Peptide Sequence Number=SeqID_104983
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgtaaagaagtctgttccggctcggtgggatccggcttcgttgtctag

SEQ ID NO: 13299 - DNA, 549 bp, Glycine max
  Peptide Sequence Number=SeqID_104984
atggcgcctaccaggcaccctctggacccagataagtccaacagggccctgggatttcccgccttgatcacaagactctgccagtcgttcggcgtccccgtcacacctagcaaagtgattcggccgcccatcacccgagcttttattgagaagtactgcacgcagagacaggtccagggtgatgcaccacaggccgcggacgcgtcgccacctcatcaggctggtccaaccggatcatttgacacggagcagtatttgctgcatttggttcgccagcaggcggccaaccaccgggcacatgtacagacccatgattgtctttatcagatgagtctcagcctgcagagccagggctttacttcttttccgtgccctactccggaccagttcagggcagaggtcgcatggcctggagattggcctgaggcccaggcaggagaggcaccagcaggggcactagcagaggctcccgacgaggcagatgaggcccgcgaggacgaagagatgactgatttacttgatttcttaggagggagcggagccatatga

SEQ ID NO: 13300 - DNA, 1006 bp, Glycine max
  Peptide Sequence Number=SeqID_104985
gattacccgactggaaaacccaagaatttacagacagatagcagaccagctcaaacgtctgatcgaaaataacgaatttccgccgggcagccgcctgccctcggagcgggatctcgcccagcagttgcaggtcagccgcgcgtcggtgcgcgaagcgctgatcgcgctggaagtgatcggcctggtggacgtcaaggtcggcaacggggtgatcgtgcgctcgcaaacgccgctggcgccgtcgcaggagccggtgatggcgcaggccggccgcaaccaatgggcggagatcgacgacgaactgaatattgaactggatttcaacgccgagctgccgccgttttcactgctgcaaacccgcctgttgatcgaaccggagaccgccgcgctggccgcgcgccacgccaccgacgaagagctggcgggcatccgcgccgcctacgagcagaactgccgcgataaccgcgccggctccgccactcaccccggcgatcggctgttccacatccgcatcgcccaggccagcggcaacccggcctatgcgttcattatcggccacctgctcggccaccgttacggcagcatgtttcgcgtgctgcagcgccactatacgccggacgacatgccgcaccgttccgagcaggaacaccgggcgatcctggcggcgatcgaagcgcgcgacgtgcgcggcgcccgcaaggcgatgaaggcgcacctcgatgaagtgatcgccattttcgcccgcgcgcaccggggcctgagcgcattacactgggcgacgaataacgccctttcccgctgcattgttaaatggataacgaccgttgaagaactctgtctccgctttattgctggcgctgggcctgtgcgccgcgccgctggccgcgctggccacccccccgcagctggcttcgcaaatcgtcgaccagtatgccgaacatattttctacaacagcggcgccaccggcatggcgctggtggtgatcgacggcaatcaggtggttaa

SEQ ID NO: 13301 - DNA, 588 bp, Glycine max
  Peptide Sequence Number=SeqID_104986
atgaccacactcgctcagacatggagtgttctttcttactctaacttgatccccacctctcacacttctgacatcacactggaccaagccaagttgatttatggcattattatgaagatggacatgaatctgaactacctcatctcccaccagatttctatcattgcccagcatgactcctctaggcttggatttccagccttaatcacaactttgtgtaaagctagaggggtcacatcagattctagatccttggagagccttagccctgccattaacttggcatatataaagaagaactgttggaatctagatgatacaatagtgacatttagtgggccaagaaaggccaggggcaagagatctaaggctctccctacttcagtagcactagatgctcctgctccttcttcatttactttaccagatcctactacaacaacaccttcttcttctactccagctactcctgctcctatactagctcagtttccagtccatctcccagctttttctgcttctgcatcaaattttgtgtttactctagagatgcttcactctatgatgcaaaacctccatagagggtag

SEQ ID NO: 13302 - DNA, 600 bp, Glycine max
  Peptide Sequence Number=SeqID_104987
gatacaagttgtaccatttgtggtgaggctcatgaatcaggtcattttatttccattgaagaacgcactctggaagttcattacatgggaaatcagcagagacaaggatacaaccaaggaggattttcggggtaccagcaaggtccctataatcagcaagggcaatggagatcacaccctggcaatcaattcaataaggaccagggtggaccttccaacaggccacctcaacaagggccaaatatttttcagaggaccaccaaactggaggaaacactagctcagtttatgcaagtgaccatgtccaaccataagagtactgagtcagctctgaaaaaccttgagatccaagtgggtcaactggtcaagcagttagctgaaaagtcatccagcagctttggagctaccgagaagaatcctcaagaagagtgcaaagctgttatgacaagaagcaggaagcttatggtggctgaggatgaggatgttgttgctatgaaggagcaagttgctttgaaggacattactgataaaaagaagaatgaggtaagagatgagaggagtcagtggagagaaaaaaccaataattgttggaagggatga

SEQ ID NO: 13303 - DNA, 384 bp, Glycine max
  Peptide Sequence Number=SeqID_104988
atggtagcgcagttaatccatgatcgcgtggtgatggagtgcctagaggaagtttgggagaccctcgaaggcaatgagaggtgccgattctatggcacgattcgactcactgctacttcattggtacatccagaagtacccgcacgcacgcttcagcagcctgtggagtggattctacctacacctactccatatagactagtggagtcagtccaagtgatagaggtgtcatcctttgaaaatgatcctgaagaggacctagaggagttacctcctaagcttgctgtaaatgctcttgactttccagatgatgatgaggacccactccctaacgtggattctccaaaggatatcatgtcagcatctgaggcagacactacatag

SEQ ID NO: 13304 - DNA, 462 bp, Glycine max
  Peptide Sequence Number=SeqID_104989
atggattcttttgaagttaatgttgatgagaatgacaatgagagtattgatgtggatctgcatggaaatgttattcatgaagatgaacctattgagtctaaaatgtcaaaaaagagggctagaaattattcatcacatatgtggaatttttttgagaaacctgttatgcatagtgatggaaaagtgatgagcaaatgcaaatattgtttgaaagattatgtgggtggtgacaataagaatgggacttcaaccttacaacgtcgtatgggaaaatgtgatgtatatttgaagacgcgttctaatagtgatgttggaaatattattctcgatcatgctgggagattaagaaatatgaaaatagatcaaagtgtgaaaatattttcattaactctagatgatgcttcttccaatgataaaatgcaagactatttgaaggaaaggcttttgcatactaatggttta

SEQ ID NO: 13305 - DNA, 513 bp, Glycine max
  Peptide Sequence Number=SeqID_104990
atgattcaatatcattcctatgttctttccgcagcacctgatgtgtggaattacaatacttcttcatcggattcagttttgataaagaaaatcattcaaataagggactttattatctccaaagagctaagtacggaagaggccaacaagaggattcaatcttggagcaccaatgaacaattgcttgttggcaaagcctatgaatacattagaggtgtcaagcctactgttagttggaaatctctccaagtttgggctcacattcgtgatttggctcttttccataggcgtttcacttctttacagtgcattactgactctttaattaggggcagatccaaatcaggtgttcaaggaaaattacattgtttggctatagcaattacagtctactacatctggctgtctaggaacaagctgatttttgaagattatcaattttctgtaatagagattattagcaagattaagtttcttatgtatagacaagtgcacctgttgcatttttcttag

SEQ ID NO: 13306 - DNA, 246 bp, Glycine max
  Peptide Sequence Number=SeqID_104991
atgtggagtcaccaactgtcgcaacctacccttcgacgggagggcgacgcggggctcgcatgtgcgtcttccaagaaaggaattcccagcggagtcaccaactgtcacaacctacccttcggtgggagggcgacgcggggctttcgggagcgtcttccaagaaaggaatacgcgcggagtcgccaccaacgtttatttgaggaaaacgtcggaaaaaccggaaaagacgtagcctacgaactttaa

SEQ ID NO: 13307 - DNA, 258 bp, Glycine max
  Peptide Sequence Number=SeqID_104992
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggaagtagaacccaagcatattgacgatgctatggaagatgagaattgggtaaaagccatgcacaaggaacttgaacaattccagaagaataatgtctggaagcttgtagaactaccataa

SEQ ID NO: 13308 - DNA, 702 bp, Glycine max
  Peptide Sequence Number=SeqID_104993
atggctcccgatcggactcagctgcagaacatggttaaaaaggaaagcgagtcctttaaagagtacactcagcgttggagggacctggccagcgcaagtggccccttccatgttcgaaagggaaatgattaccatgatggtagacaccttgccgggaagtttgattatgtctcctccacaagtaccaacgctaggaggattggagaaactggggcaaaaaggaaggaaggagatacccatgccgtcacttcagcgcccgcatggatcaagccgccgaagatctctcacagtacccatcaatacgcgcaacatcacccgagctgctcagctcgtgccagggactcttccaactcggcaccaggagaccccctaagctacggctccaaccccgactcgcccggccggcaatgccccctttggcaccggttccaacgtgataaggaactttcccccgaggacaacattcaccccgatcccaatgacgtacgaagacctcttgccatccctcatcgccaaccagatggctgtgatatctcccggaaagatctaccagcctcttttcccaaagtggccgcccaggtccaagcctttgaaggacgtgacgacccccagaaggtttatctacgaggccctacaaaagggggggctggaggacctgttgcaacatatgatagaccaaggccgactggaagtcagcaatga

SEQ ID NO: 13309 - DNA, 393 bp, Glycine max
  Peptide Sequence Number=SeqID_104994
atggaccaccacggcaaaatagaggagaagcttgccgccctgctcgcccaggtgagctcagctagcccaggcgagccaggttgcttcctccagaagcaacaaccttctggaggaatcttctggagggcccaactttcgaagaagttacggaaacttacggattgcgcgaaaacacctcttttcgacttccgccacattacggaatttcacggatcgcgcaaacctgcttcctttagatttctgggacgtctcgggacttcatttattgtgcaaaaaaggacgcgaagtatctcaaagcggctaaccaaagattgcatgtcatcaagtaataatccccggacaaaattagggtatgacagttgcccctctttacctacctctcatcggagataa

SEQ ID NO: 13310 - DNA, 480 bp, Glycine max
  Peptide Sequence Number=SeqID_104995
atgccgtcggagaaggttccaatgctgccccacacgtggatgtggagttcgacgggcataggttccgaagagggccagcgcttcgagtttagccagaggaggagccaggcctcggggtttgacaaggaggccatcagccagctcatgtgtgttccggggaaggactttgcccacagcgtggtggggagatgggtgcggatcatgtgcactagcatgaccaccctcacacagatttggatgatgttgctactcagcaacatcctccccagcgaccataatttcgacctcccccggccaaagtgccagctagtctacaccatcctaactcagggatcacgcctcctagacacccaatggacccgaagaagtccaacagggcactcgggtttcctgctttggtcacgggcctttgccaattcaatggagtgtcggtcactcccaccaagcttatccggcctcccatcaacagggccttcatag

SEQ ID NO: 13311 - DNA, 225 bp, Glycine max
  Peptide Sequence Number=SeqID_104996
atgaagaataagaaggttgcagcagttggtgtctcgctaagtgagacatatgcgcttagtgagcaatatccgctaagcgagacatcagctcgcttagtaagtgaggagaatctgccatgcatgcacgcactcagcacgccatcagctcgcccagcaagtcatttgtttcttctggcgctcagcgtgcctgattcgctaagccaaaaatcactaactcgcgcttag

SEQ ID NO: 13312 - DNA, 294 bp, Glycine max
  Peptide Sequence Number=SeqID_104997
atggagacaaattatggtcattttgcaccttttgccatccagatacgatcgtgtccgatggcacgtagagaaaaattatggtcattctgcacctttcgtcatccagaggcggcgagcccgatgacatgcggagataccttatggtcatccgcgcctttcgtcaatcgagaagaacgagttcgacagtatcaggatgatgttggtcgttcggtgctgatcattttcaaaatttttgcaggttccggtggcggggagattgaccggccgaatgatgttccgctcgaacgaaattag

SEQ ID NO: 13313 - DNA, 368 bp, Glycine max
  Peptide Sequence Number=SeqID_104998
tggtacctggagatatgtcgtgggggtcaggagaccttggggacgtcaggcgagctcctgacagtcaacagataaaaggaacaaagaccacaaagcaagggaggcttgcgtggcttgaaaacgaggcctctggtaatcgattaccagtctgtgtaatcgattacacagaggaatgggtcactggtaatcgattaccagtgcctagagggagcttgggagaccctcgaaggcaacacgagcgcactgtggagtggatactacccacgcctacaccataccatctagtagagccagtccacgtgattgaggtgacgtcatccgaggaagatcctgaggaggaccctgaggagctacctcccaagcctgct

SEQ ID NO: 13314 - DNA, 148 bp, Glycine max
  Peptide Sequence Number=SeqID_104999
atgagaaaccaagaaggcccgaaaggaagaacacgaccacagctaagtattgagtgtgtttatagggcagcaatagtgagctcaagctccgaacaggtgaaaggaatcatcacgggtcaaatgcatgatcatgaaggacgagctaaag

SEQ ID NO: 13315 - DNA, 285 bp, Glycine max
  Peptide Sequence Number=SeqID_105000
atggagttgcagcagaagataaaggagaagagcaaggaagatgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctccaaatga

SEQ ID NO: 13316 - DNA, 525 bp, Glycine max
  Peptide Sequence Number=SeqID_105001
atgaccagaaggcttcttgccggttcattggcttttgaaagccgcatccttcattatctcattgtgcgtatcttgcttccaagatcttcaaaccttgcacaggaattgcgattaaattctccattgccatatccacacttagtcactctcttccttcaacactttaacatccctcttgattctgaaccttatgttccaatcaagagatccttcttaattggtgccgctgtgattgcatcctttggttaccaaaaagagcatgatggctcttgggtgaaaaagggtgctcaaccaaatgatggagaaggacatttacaaggtggagaagattcctctcttcttcaaaagattttggacaggttcgatggtcttcaaacctttgttggtgaaaggtttgatgctttggagttacaagtggacatgagatttgatgagatggattcaaggattaccaaggtcgaagaagatgtctcttacattcgcacaagctttgatctaccaccaccaccgccaccatcatcttag

SEQ ID NO: 13317 - DNA, 1971 bp, Glycine max
  Peptide Sequence Number=SeqID_105002
atggcaatgccatcgggaaatgcagtaatgccggaaaaattgcagtttccgggtggcggtggtgcccccggtggtggtagtgagatccacttccgccagcagtggtttgtggatgagagggatgggtttattggctggcttcgcagcgaattcgctgctgcgaatgccatcatagattctctgtgccaccatttgcgtgatgtaggggagcctggagagtataacatggttgttggggcaattcaacagagaaggtgcaattggactcaggtgcttcttatgcagcagtacttttctgtgtctgaggtggtgtatgcgctgcagcaagtgtcatggaggaggcagcagagggttgttgatccggcaaaaaccggtgccaaggagtttaggaagttcggtttggggtttaagcaagggcagcacaggtttgaggctgtcaaggatggttataattctagtgtagagtcttttggtcatgggacaaatgctgtggtggttgctggaggtgtggagaaaggggcttgtgtgaccgagaagaatggagaaattaaatctggtggcatggttgggaccatggataacaagaatttaggatctcctgaggagaggaaagatgctattacaaatcatcaatctgatggtattttgaagggctctaggaattctcaaggatctctgtccagctcagaatgtgaagctgtgggtgtaaatgaagaatgtgtatcaaattctaaagagaatgattctatcatgggaaaattttttattggcaacgagatgtttgatgggaagatggtgaatgtggttgatggactgaagttgtatgaagatttattggatagtactgaagtttcaaaacttgtttcattggtcaatgatctgagggttgccggaaaaagaggacaatttcaaggaaatcagacatttgtggtttcaaaaaggcccatgaaaggacatggaagggaaatgattcagttgggtgttcccattgctgatgcaccaccagatgtggacaataaagtagaatctatcccttctttgttccaagatatcattgagcgcctggctgcctcacaagtgatgactgtgaagcctgatgcttgcattgtggatttctttaatgagggtgagcactcacatcccaacaattggcctccttggtttggaaggcctgtttatacacttttcctgactgaatgtgacatgacttttgggagaataattgtctcagatcatcctggggagtttagaggtgctgtcaggctttctcttgtacccgggtcccttctggtgatgcaagggaaatcaactgatttcgccaagcacgctcttccttctattcacaaacaacgcataatcataaccttcacaaagtcccaaccaaaatgttccctgccaaatgattctcagcgacttgctccaccggcagcgtcccattgggcaccaccacagagcagatctcccaatcacgtgcgtcatcaattaggccccaagcattatcccacggttccagcaactgtagtactgccagctccatccatacatgcacctccaaacagtatgcagccattgtttgtgccagcaccagttgcacctcccatgtcatttcctacacccgtaccaatcccacctggttccaccggatggacctcagctccttcgaggcatcctcctcctcgaatccctgttcctggcacaggagtcttcctccctccacctggctcaggtacttcatctcaacacttgccatgtaccgtacctgaagtgaacccaagtgtggaaactttgaccgtgtcgggaaaggaaaatgggaaatccaatcataacacaaattcttcaccaaaaggcaaaatggatggaaatatacaaggggggcaagaaagcaatggaaatgcagatggaactcaagctgaacaagctgtagtagagaaagaacaggaaagcaatgacacaacggctgcaaaccattga

SEQ ID NO: 13318 - DNA, 246 bp, Glycine max
  Peptide Sequence Number=SeqID_105003
gcgaggctcacgggtgcactttccaaaggaggaatgatgcgcggagtcgccaccaacgaaggtattagcacctctcacgtcgacaaaagcggggctcttgctcctacgtaccctccatcgaagaggaaatcagacctacgtagttcttcctttaagagtgaatcaagtgattctttttacttgaaaggtgatcattttaaggcgtcggaccttaagaatgatccattttacttggaaagaaactga

SEQ ID NO: 13319 - DNA, 567 bp, Glycine max
  Peptide Sequence Number=SeqID_105004
atggaaaaacgccagcaacgcggcctttttacggttcctggccttttgctggcttttgctcacatgttctttctgcgttatcccctgattctgtggataaccgtattaccgcctttgagtgagctgataccgctcgccgcagccgaacgaccgagcgcagcgagaaacagctatgaccatgattacgaattcgagctcggtaccgaaggaatgatcgtaagaatttggcaagatatatccaattttccgccatttcaacctgggtggttaaatagaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 13320 - DNA, 544 bp, Glycine max
  Peptide Sequence Number=SeqID_105005
atggcattgccaaaagaaagaataggcatcttattgagactgctcggacattattacttcatgccaatgtacatgtccgacattggggtcttgataagcttgttgctcgagccatcaaatgtgttttccttggatattccaaattacaaaaaggttaccgatgttactctcctattcacaatcgtttatatctctgcagatgtaacattttttgaagaaaaaccatacttttctccctctatggttgagtccaatactcttcaagaagtttttcctattccctatcttggtccatcaccttctttgcaagaatcagagtcaactgtagattctaccatagatattcctaataatcctccacttgagcaaactcaaagatcacccatcgtatatcaacctcgtcctcgaattcttgtcgtagaacttgaaggtaatgaaagaccagttgaatcatgccctagtccaacggacaacccgaccatggacctacccgaagagaatcttgacttgctcattgctcttaggaaagatactcggtctacac

SEQ ID NO: 13321 - DNA, 541 bp, Glycine max
  Peptide Sequence Number=SeqID_105006
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgcccccctgacgagcatcacaaaatcgacgctcaagtcagaggtggcgaaacccgacaggactataaagataccagcgtttccccctggaagctccctcgtgcgctctcct

SEQ ID NO: 13322 - DNA, 770 bp, Glycine max
  Peptide Sequence Number=SeqID_105007
atgtattgaatgcaaccagcattacagtgactgatacacaaggtgcatcttcttcagcatcaatcgctacattggctgacgctaatgtactcagcagctcaacagccaatcctaacctcaaggaaggtgatgctaatggcaatacgcttactggcacaactggtgatgatcaattgtacggttatgctggcgatgacacgctgaacggtggtgatggcaatgacatcctgcgtggcggtgatggtaacgatacgctgaatggtggtgccggtaacgatattttgattggtggctccggtaacgataccctgactggtgggagcggtcgtgatatcttccgctgggagaaaggcgatgcaggaactgcgggcagcccggcagttgataacatcactgactttactttaggcagtgatgtgattgacctgagaaccttactgcaaggcgagaatctggctaacatctcaaactttgttcgcgtgactgtggatgctagcggaaacacaattttgcacattagcagcacaggcgggttctccagcggcttcaatgctaatgctgaagatcaaaccatcatattgcaaggtgtgaacctgcaaacaacctatggcactacagatagcgctcagattgtgactaacctagtgaacagcggcaacttggccattgatcctgtggcttccagcgcttctggtagtctgggtgcatttggtgcggatggcggccacgtacaaagcatcgtggtgggtgggggttacgtatacctataa

SEQ ID NO: 13323 - DNA, 395 bp, Glycine max
  Peptide Sequence Number=SeqID_105008
atgggtcaacttcaacggcaagccttccgtaaagcctatggtaagatttgggacctagctagggtagaagtctccacagagtccattgcctcccttgcccagtattatgatcatccgttgaggtgcttcactgttggggacttccaactatcacccatggcggaagaattcgaagaaatcctaggatgtctgtcctctagggggaaggaaaccatacctcttctcagaaacgaatgggccccgttcatagacgttctcgcactgttgatctttggaggagtcctcttttcgaatgtggatgggttggtggacctggcagcgatcgacgcttttctcgcctatcataaccacaaggaaagcccggttgtcgctatgctagccgacctatatgacac

SEQ ID NO: 13324 - DNA, 201 bp, Glycine max
  Peptide Sequence Number=SeqID_105009
atggcatcttcgtcgtcatgctcatcaagtatacaaactaggtctggtccaattgatggtgacgtgttgtggatgcaacccaagcatgtttcagaacatgtttggaatggggaaccagacaaaaaactacacatcagacgagtagtcctgacgtatcaaggtgaagaacaaataccagaggaaattgttcctttgctttga

SEQ ID NO: 13325 - DNA, 618 bp, Glycine max
  Peptide Sequence Number=SeqID_105010
atgtatgaatatcctaggataacccgtgcattaacgcgtaagcattcctttcaaaattcgtatggatattcatgctttgttggaaaaagggaaatggctctgaagaaactctccacgaagaggtctagaagagacgccacaggagaagggtccagtaccgcccccgagtttgatagtaatcgtttctggagtgccgagcaccagcagcgcttcgaggccatcagaggatggtcgttccacagggagaggcatgtccagctcagggaggatgagtatacggactttcaggaggagatagcttgcagacgttggacattgctggtgactcccatggccaagtttgaccctgagatagtcctagagttctatgctaatgcttggcccacggaggagggagtgcgagacatacgttcgtgggtgaggggtcagtggattccctttaacgcatatgccctcagccagttcctgggtgacccgctagttttggaggaaggccagcagtgtgagttcagccagaggaggaacagggccgacggattcgatgaggaagccattgcccagctgttgtgcacactgggccaggatttcgcccggactgctgcagggaggcgggtgtag

SEQ ID NO: 13326 - DNA, 204 bp, Glycine max
  Peptide Sequence Number=SeqID_105011
tggcatatccgagccaaggctcgaagtctgctagattgtggtggggaatttcatgtgtctcccccatggtttgagagatatgtgcctgatcagattgagttgggaggcaagccatatgatgggaaggcatgctcgttgtcataccctaatttcgtccggggacctttgcttgatgacatgcgacctttctttggtccttgtgag

SEQ ID NO: 13327 - DNA, 348 bp, Glycine max
  Peptide Sequence Number=SeqID_105012
atgaatcagattgtggtgtacgttcgacctgagcgggttcttcgacagtttggctaccttcagacggtccctccgccgccggtttgtgattctttgacgggtgatgatatagatgactggtggctgcatttttcagaccatttggtgcctttaagggagctctgtgcagttcctaaacaggtggtgccagattacatggagttgtttttccggatatcgcacccattcgtcacgcggaccgaggaaactgctgtgccgagacatccgcctccccctcatcatgaggagttcgtcgagccacccatccccgaggtttcagtcgcgaccgatctccctatgcattcagtg

SEQ ID NO: 13328 - DNA, 351 bp, Glycine max
  Peptide Sequence Number=SeqID_105013
atgggtttaggccagaatggtgatagcacgacaagcttggtgaagttctttgaaaactatgggaggttcggtctgggttacgagccaacacatgccgataagagaagggtcgccttagaaaggaaagaaagaagcctagcccatttacaagggtggagaccacagatggaaagggtccctatctgtgacattagcaagagctttgttagcgcgaggtggatgcatgagaatcaggttgttgtgctagataaagaaaccaaccaagagcagccaagctgggtgcagccgtgctccccgggtttggaattgaagaattggcgaatcatggagcgacccaagatttcggtatga

SEQ ID NO: 13329 - DNA, 570 bp, Glycine max
  Peptide Sequence Number=SeqID_105014
atgaaaggaatatcctatcgagggaatcatatttgcttcggaagatatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaaggttctcccgaatattgggtagctgtcgttaaacctgggaaaatactttatgaaatgggtgggggtaccagaaaatatagcaagaaaggctatttcaatagcatcatccaaaatgcctatacgaactcaatttcattatttcaggcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13330 - DNA, 546 bp, Glycine max
  Peptide Sequence Number=SeqID_105015
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtagcaccgtatcctcccatccgggagcttgccatgcctcaccccacagcagttgaaggaactcaagtcataaacgtggacgaagggtcacaaatccgagccctaatcgtctaccaagccaacatgggcagtgaatttgacatagatccgcgagacgacacctccaacagaggcccgaaacccatcaaaaagcttgtccaacaacaactcgaacctaaacccaggcagtgcatgcggctcagtggggacctcattagtcatgagcatcggcgggtaccgagctcgaattcgtaa

SEQ ID NO: 13331 - DNA, 381 bp, Glycine max
  Peptide Sequence Number=SeqID_105016
atggcgacagtggatccttggcttgagaatctcttgtatcgaaagtttttctggtggtggattcaagtgacgtatcctgtgggcggagcaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 13332 - DNA, 952 bp, Glycine max
  Peptide Sequence Number=SeqID_105017
atgggcagccgcatgctgaagcgctggctgcatatgccgctgcgcgacgtggccaccatcacgcgccgccaggaatcaattgccgaactgcagtcgctgagcgaagaactgcaaccggtgctgcgccaggtgggcgatctggagcgtattctggcacgtctggcgctgcgcaccgcgcgtccgcgcgatctggcgcgtatgcgtcatgccttacagcaattgccagaactcaatacccagttagcagacgtggccgcgcctcatctgaatgtgctgcgcgatcggatgggggatttcagcgaactgcgcgaactgctggaaagcgccattattgaatcgccgccagtgctggtgcgcgacggtggtgttatcgcgcccggctataacgccgagctggacgagtggcgcgcgctggccgacggcgccagcgactaccttgaccgcctggagattcgcgagcgcgaaaaactggggctggatacgctgaaggttggcttcaacgctgtgcacggctattacattcaggtcagccgcggacagagccatctggtgcctatccattacgtccgccgccagacgctgaaaaatgccgagcgctatatcattcccgaactgaaagagtacgaagataaggtccttacgtcgaaaggcaaagcgctggcgctggaaaagagcctgtatgacgagctgttcgatcgcctgctgccgcacctcgaagcgctgcagcagagcgccgcggcgctggcagaactggacgtactggccaacctggcagagcgcgcctggacgctaaactattgccgcccggtgctgcaggagaaagccgggattcgcatcactgccggccgccatccggtggtggaacaggtgctgaaagagccattcattgccaacccgctgtcgctttcgatgcagcgtcgcatgctgatcattaccggccccaacatgggcg

SEQ ID NO: 13333 - DNA, 297 bp, Glycine max
  Peptide Sequence Number=SeqID_105018
atggcatctaagaaaaggaaggcttcttctacaccttcccaagtcagatatgatcagtctcggttcacatctcaagaagcttgggagaggtacaccaatattgaggtgcctaggaaactactaccaaagaggaatgtggtagtttattacactgagttcgatgagttcaaggaggaactcgagagaagacactgggatgaggagttgactgattttactgatggcagcatagacgtcgccattgtgaaggaattttacacgaacctttatgaccctgaggataaatcacctaagtag

SEQ ID NO: 13334 - DNA, 572 bp, Glycine max
  Peptide Sequence Number=SeqID_105019
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttacactatcctcatgggctacttccagtgttgaggaggttgcttcaacaggtgtttaaagacagaaatgtggttgctcagcttgtgagaagagctgaaagagctgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 13335 - DNA, 385 bp, Glycine max
  Peptide Sequence Number=SeqID_105020
aggagtgcatgaagtagccaagaattcatctttatcaactgaaactaagaagcttgagggtaaacgagatgccttggttaacctggtaacccagctggccttgaatcagaagtttgtacctgttgcaagactctgtggtttatgctcctttgccgactaccacacagacctttgcccttctatgcagcaatctaaagcaattaaacagcctgaagtttatgctgcaaacatcttcaatagacctcctcaacctcagcagcaaaatcagccacaacagaacaattatgacctctccagcaacagaccatacgttcctccaccaatccaacaacaacaacaacaacaacagccccagaaacaacatacagttgaggcccctccgtaa

SEQ ID NO: 13336 - DNA, 645 bp, Glycine max
  Peptide Sequence Number=SeqID_105021
atggcaagaatagccaaggtagtcaaaatctcggcacaagagttggaccgagtaaagcaaaatagaaatgggatagtcggaataccaaggaagcatttggaggaaaaggtgaaggcattgggggatcaaggtgaatgggcttcattcattgacgtcttggcactattgatattcggaatcatcctctttccaaatttggatgggctagtggacctagcggctattgatgccttccttgcttatcaccatagcaaggaaagtcccatcgttgctattctagccgatgtctatgacactctcacacctctttttcgacgaagtaggcccgcttgtcccttgcaaggtcaccgcatatgcactgagaaagggaaagcaaattgggagcaactcttggctagtgtggtaggggcatccattagttggttccctcgatggaaggaagggaaaggtggggttttgtcctcatatgaaggattcccaaacattcccttgatacaacttggctaccctatgagaggagcaccgttggaggaaagcatcacgcctttcatcgcatggggttttagtgaccccaatgtgaagatacttcaaggagtccgcaaggcatggggtgcagtgcaaaggaaagataaagaacttaggtga

SEQ ID NO: 13337 - DNA, 345 bp, Glycine max
  Peptide Sequence Number=SeqID_105022
atggagtattttcttgagcaagtagcctggcctgaagctcaacttccactggtgagacccaacgaggatgctccgcctgagcccacacctgtgcaggtcaattcagagccagctgaccctcaatctccagtggtgaatccaccttcttcacctgagcttgaagtagtttcgccatcccctcctctgattgtcttttttgacgcatcatcagatgaagcggctgcccctcctgattcaccagttgcaaaaatagctgacccccctgtttccccaattggaggaattgttgatctttctgattcatcatctggagaagttgttgctctcactgactccccagtttaa

SEQ ID NO: 13338 - DNA, 135 bp, Glycine max
  Peptide Sequence Number=SeqID_105023
atgggtttgtcaggcttaaaggagcactcaaacccggtgacccccaaggcctacactccgaagagtccgtcagggcctctccctcctgattcaggtccaacccctaaaatcattttagcacacagacactgctag

SEQ ID NO: 13339 - DNA, 288 bp, Glycine max
  Peptide Sequence Number=SeqID_105024
atgtcaccatctaagatgcagattcgtagagagaaaggtatatgttacacttgtgataagaagtccacttcttcccataggtgtcctaacagacaatacttactattacaaatggatgatgatgacaatgctgagttgcaaccagatccttctcctgggaatgaagaagcattgggaagcttgagcttggaccatcattcatcttacaatgcactgaaaggttcctcaggtttaggaactatgaagtttagtggtacaattaatggcatggcagttgctccaaattga

SEQ ID NO: 13340 - DNA, 162 bp, Glycine max
  Peptide Sequence Number=SeqID_105025
atgacgatctcagactcattcaccgttggatcgtcggagcaaaaagaatcgcatgaagatagtccaaatggaggctttaatcctttctctgttactctgacgtttgggaactctatcagagcagtcggaggaaaaactgggggaatcttagggaaccgttag

SEQ ID NO: 13341 - DNA, 456 bp, Glycine max
  Peptide Sequence Number=SeqID_105026
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctggacaagaaagtatcgatgatcacatgggaagaactgggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 13342 - DNA, 189 bp, Glycine max
  Peptide Sequence Number=SeqID_105027
atgggagtttgtgtggggattgtcgataaaaccggaaaatggaaaatgagagagaaatgggagtttgagctgaatgagacaagaagaagaaaagcaagaggcatgaaggaacacatccccctttcgccagctggcgtaatagcgaagaggcccgcaccgatcgcccttcccaacagttgcgcagcctga

SEQ ID NO: 13343 - DNA, 426 bp, Glycine max
  Peptide Sequence Number=SeqID_105028
atgctttgttggtctaggtataagttagttgtcaagatggaacagaatggggagaaggcaaacttccatttttgggatgcagtatgtatcaaaatatttggtaaaactgcagatgaatatcgtcaagagttgattgcgagtggtgatgagatcaaggtgttccctgcgtgtgttgatcaattgttgggtaaaacttgggttgtcagattcaaacaccgtatacagatgcaccaatcatccgtgttggattttagtgaacaggaacatcatatacaatcagtgatattcacgctaggtctacaggatgaacagtgtataagcaacaagtcagccgctgttggtgctgcatcttcatcacaacaagattaccatcctacaccttcattgtcacagtcatctgaatatgatcctggaaatgctgccttt

SEQ ID NO: 13344 - DNA, 447 bp, Glycine max
  Peptide Sequence Number=SeqID_105029
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgtcttgaaggaggacgttcaactaagaagtggttcattattggtggtgttgttggggtcgggaaacctgtcgtgccagctgcattaatgaatcggccaacgcgcggggagaggcggtttgcgtattgggcgctcttccgcttcctcgctcactga

SEQ ID NO: 13345 - DNA, 180 bp, Glycine max
  Peptide Sequence Number=SeqID_105030
atgattaatgtgctgaaaagggagaatagaattctcagggccaatgttgatgcctccacggagtctctgttctacaagggagcaaataatggttcgatttttcaaaatatgattttgcgtatccctactttcttctttcgctggttgggttacacttcttctccaacaggatggcagtaa

SEQ ID NO: 13346 - DNA, 504 bp, Glycine max
  Peptide Sequence Number=SeqID_105031
atgccgatctccccctgcgaaagtatcggttggtctgtgccatctcgacataggggtcacgcctacaagacacctagtggacccggagaagtccaacagggccctggggtttcctgctctggttacgggcctctgtcagtcctacagggtgcccgttccccccagcaagggatcgcgcccgtaagacacccagtggacctggagaagtccaacagggtcctggggtttccagctctgattacgggcctttgtcaattctacggagtgctcatcgcccccaacaaggtcatcaggccccctactaaccgagctttcatcaagaagtattgcgccgccaagcaggcgcaaggcaagacaccacaacagcttggagttggacgacagcgggcaacagacgcaccgccgccacctccaaagcccctcagcttatccacaaaaaggttagagcactgcctacgacacatggtcgaccaattaagcgacccagtccaaagccaaaggtaa

SEQ ID NO: 13347 - DNA, 865 bp, Glycine max
  Peptide Sequence Number=SeqID_105032
caagattgcagctacggtcgaagatttggcgagagagttggatcgtatgaagcaaactcgaaatggcgtagtgggcctaccgtggaaatacttggaaggaaaggcaagggatatggcgaatcaagaggaatgggtccccaaggagagcccggtggtggctatcttggcggacttatttgatacatttgaccgaaggtgcgagaagaacagtgcacagattgtctactgcttacccgctctttgtgtgtggttggtttcacacctattccaacaagacataaggcaccgtgtccacttcaaagttatcgctcgcagcacaatcaactggtttcctcgatggaaggaaggaaaggagggagttctcttctcatgtggggactacctaaacattccgttgatagggacgaggggctgtattaactataatcctgcacttgccataagacagttagggtaccccatgaggggagcaccgaaggaagagagcctctcacctttccttgtgagagatttcagcgcgcaaagtctcaagattgtacaaagagtccacaaggcgtgggaaagcccattaaggaaagataaagaacttaggggcatccgtaatggcatcattggtgctccggaagaggatgaagaagtccaagctctaaaatcagagctaggaaaggcaagactcgccaaagaaaaattcaagtcagtcgctacagacatccggaaagagtgtgccgaattacgaaaggaaaatgcggctactgcaattgccctcgaacaagaaaccaagagggctcgcaaggaagagcatggccgagataaattccgaggagctttatgggacaacaacaatgagctcaaggggatcctctag

SEQ ID NO: 13348 - DNA, 890 bp, Glycine max
  Peptide Sequence Number=SeqID_105033
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatctccaatggtacaagggacagcaaaagtaacaggacctttacatttctgtggcaagcttcctcttatgggtgcacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13349 - DNA, 369 bp, Glycine max
  Peptide Sequence Number=SeqID_105034
atggtgaaagtggaactcttacgtgccgatcaacgtctcatttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 13350 - DNA, 63 bp, Glycine max
  Peptide Sequence Number=SeqID_105035
atggtgatttcataccatggagatgcagcggaagataaaggagaagaggtgagaggagcctaa

SEQ ID NO: 13351 - DNA, 888 bp, Glycine max
  Peptide Sequence Number=SeqID_105036
atgctaacgctgagggagaagtactatgatttcgaccagatttccagtaaggttttcaagtgcaggcgtgatgatcagtttttcaccatgaaaattgtctccattctgaacgaagaaaaccaagcgaacaacggggttccgtactggattataagagaaatctctattctcaaagagctggaccacatcaacattgtgaggttgatcgatgtgatgaccgatgggcccgacctgtttcttgtttttgagtatcttgacaatgaattccaagctgatttcctgaaaaatccaaagatgtttatgtacccacaaatgaaaaaagagtttctttatcaaattctcaatacagttgcgtatctgcatgctcgtaaaattcttctcagagatttgagacctgagaatattctggttaatgtcagaacccaagttctgaagattgcactctttggggcagccagaacatttgaagctcctcttgaggcttactctagcagtgtgggttgtctttcttataggtcacctgaagtcttgtttcagtttggctgcgagaaatactcaactccaaatgatgtctgggccgtgggttgtatatttggcgagatgcttcttcaccggcctctattctctggtccaagtgatgtggagctgctggatgagatatttaccttgcttggtaccccaacagaagaaacctggcctggagtgacttctatatgcggaacctgtgctttaatgggacctccacaacagcccaaggacctggcaaaagagtttccaatgctcaatccagatggtcttgatctactctccaaaatgctttgcctgtgtccaaattatagaatttcagctgaagatgctgttaagcacccatatttcaaaggagtatga

SEQ ID NO: 13352 - DNA, 567 bp, Glycine max
  Peptide Sequence Number=SeqID_105037
atggcccgcacgaagaaaactggacagatgacgtctgaggcaacaaaggaaatagctgacaggattataatacatgattctttggacgagcaggcgtcacagggatcgttcgtcccccatggacatcaggatattctgactgctgccattgggcgactagagcaccctgaccgtgttcgtgttgttggagccggtgtcaccataaagcaatactttggatcggcttcacgaacgtcccgcagttcttcctccatgcctcctgaagacctagaacagctgacccaacaaattagagaccaactggaggagtcaatcacagaaaaggtgactcgaaagctgatggtatccttcagccagatgcagtcccagtttcagtctcagatgcaatcacaaggacttgcactacctctagagccagaggttgctccctcaggtcctcgtgtcagcacaaaggagagttgtgttgctccctcagggaacgatctagggacgggtgactcagacaaatgcgggctatacattgaagaaaatccttcccgtagaaacatgcatgccgatataacatga

SEQ ID NO: 13353 - DNA, 99 bp, Glycine max
  Peptide Sequence Number=SeqID_105038
atggcatttagggtcatggaagctcgccgaggcaagctattgcttcaacctgaagtaaccttgctcgcccaggcgtgctgctggtgttcaacaccgtaa

SEQ ID NO: 13354 - DNA, 597 bp, Glycine max
  Peptide Sequence Number=SeqID_105039
atgaaagagggttctagttacatggtcttgcaggggatcttatgcagaaagttgcatgtccttcataagatgcataggatcaccagcaattcatggaataatacacttgattcatcaattaagttgattacgctaaacattcctcacactactcgtctggaccataaaacactgaagcttctcaaaaactggacttggcaatttgttgtgatacgtccagtgtgctcaatcttgatgataactctacagtatcttgatgtttatcccacttgggtcagctggataaacacagtcattctgaacatttcagtgtcactggcattgtattctcttgttgttttctaccatgtgttttctaaagagctggagccacataagcctcttgccaagtttttatgcataaaagggattgtctttttctgcttttggcagggaattgtgcttgatctcctggcagcactaggaataatccgatcccgttattcctggctagctgtggaacgcattgaggaaggctaccaaaaccttttgcaatatgcatacagtgctgctccatacaaagttaacagtgcaccttcagataaaaagtcaaagtga

SEQ ID NO: 13355 - DNA, 972 bp, Glycine max
  Peptide Sequence Number=SeqID_105040
atggttttgggtattgatgatgaatatggacctcagctttacaaatgtgatccagctggtcattactttggtcacaaggcaacaagtgctggattgaaggaccaagaggcaattaatttcttggaaaagaagatgaagaatgacccttcatttacatatgaggagacagttcaggaagtggctgcttctatttatgctttggctgatggaagcctcaatgactggtttggaggctttctatattcagctggacaacaggccaatgaagctgttcagggccaattaacctctctcagtttcactagtttggctgtaatttatggggcagggcttgtgaccagcctttctccctgtacacttagtgtcttaccactgacccttggttacattggggcatttggctctggcaaaagcagagcagaggttgtaggagattccattgcattctccttaggtcttgcaaccacattagcactgttgggtgttggagcttcatttgcaggaaaggcttatggacagattggccaaggattacctttggctgcttctggtttggctataattatgggtctgaatcttcttgagatcattgagttacggctgccctcattctttgacagttttgatccacgtgcagccgctgccaatttcccatccagtgtgcaagcctacctggctgggcttacatttgctttagctgcctcaccttgtagtacacctgttctggccactcttttgggatatgttgctgcatccaaggatcctgtgattggaggcagcttacttttgacttacacaactggctatgtttctcctttactcttggctgcttcttttgctggagcattacagagcttgctctcatttcgcaagttctcagcatggatcaatcctataagcggagcaatgctgttaggtggtggtgtatatactttcttagataggctgttcccagtcacaatggtgatgtag

SEQ ID NO: 13356 - DNA, 303 bp, Glycine max
  Peptide Sequence Number=SeqID_105041
atgacacaaaaccctaccttcttccctaggatagaaataatcaaggatcctttcttggattacaccaatcctaaaattcattatcagaaatcagcacttcttaaaatgcctcttgtcgcaacctacccttcggtgggagggcgacgcggggctcgagggtgcgtcttccaagggagaaaaatgcgcggagtcgccactaatgtttattcgaggaaaacgtcggaaaaactggaaagtcgacaagggtgtttcccttgctcctacgtattccttaattgtgataaggaaatcagacctacgtag

SEQ ID NO: 13357 - DNA, 2007 bp, Glycine max
  Peptide Sequence Number=SeqID_105042
atgaggggtcctttgggtgcagtaataggaagatacccatcaagtgatggagttacccaaatgggtggaattataaggcacaacaggaaatgcagggacatcactgttctagtgatcttcatagctttttggatagcaatgattgtcaactccagctttgctttcaaccaaggaaacccactgaggcttacttatggacttgactacaaagggaatgtgtgtggtgacaagcatgcacaccctggccttagtgaattggagctcagatattggcaaaatcctaaccaggtttatcagagtggattgaaggatagccaattcaaactggctgatgcccgcagtatatgcttgtcggagtgccctatgccttcggaagattcccttaattgggtgtgtgattatcctgaaggagatattcgtctttcgatgaaagattggattaataggaactatgattattttgagtttcttacaccggaaatgagaaactcctctcttcaactacagggtccatgttatcctgtaatatttcccagtgtaaatgtttactggagttgccaattcattgctcgggcatcaaatacatctttgaagcattggcagcagatgggtggagttaacatcaacgaagacattgttattgacaagtccattcacaagtctattaattctcggtcatctgtcttaaagagatacatggcagacataggaaaggcatggcctgtgttgattgtttgtggagggattttgcctctttttctgtctgtgatttggctgatgatgattcgacattttgttgctgcaatgccttggataacagttgtgctctttaatgttctaataatatctgtcacaatgttctactaccttaaagctggatggattggaaatgatgccatttctcccatcattggtgagcatgacccttacattagtgtatatgggagggagctgactcatatacgagttgtcactatacttatgacctctatcatggttgtcgccattcttacatcaattgctattgttcgccgcatccttatggcaacatctgtcctgaaggttgctgcaaaagtgataggagaagttcaagccctcattatttttcctctcataccatatgctatccttgcagtgttttacatgttctggatttcagctgctctccatttgttcagctctggcgaggttgttcagaataattgcaactctaactgttgcacatatgatcttattgcaaaacgggtaaaatgcgatcgttgttgtggttatagcattcattacacaccacatattggagttgccatccttttccacctatttgggtgttattgggctacacaatttttcatagcttgctcctcaacagtgattgctgggtctgtcgcgtcttattactgggcccgtggtgaaacatccaattgtgtttatacttgggtcaaatggtcctgtttggttaaacttctcaataagcaagcacttataagagaagaaaataagaatccagaaattccatttctttctgtcttttcctccatgaagaggcttatgcgttacagtcttgggtctgtggctcttggctctctgattgtatcatttgtagaatcaatccgctttctgcttgaagttattcgtcgtaagctaaaagtctcaagtcataggcatgacagctgcttaggcaaggctgcataccaatcttctcaatgttttctcaggtgtattgaatggaccatcaaatcagtaaaccgaaatgcttacatcctgattgctataacaggcaaaagtttctttagcgcttcttctattgcaacagaactgattatgaataatattctaaagattgggcgtcttaatgtgattggagatgtcattttgttccttggaaaactgtgtgtcagcctctcgtgtgctttgtttgcgttcctcatgttggacacacacaagtacaactctgctcataacaagacctcatctcccctcttacctgttgtggtatgctttctataa

SEQ ID NO: 13358 - DNA, 387 bp, Glycine max
  Peptide Sequence Number=SeqID_105043
atggaacttggcctcagatggaaggcgttgaacggcaacttctccaacgtgctcttgggcatcacattcaggcttgagacattgtcaatgagtactttggccataatgtgttccatgcatttgaccgacacatgtaaagccttctacagagatggtgaggtagttgttggctgtgatgttattgacgatcccctcaaagccttctacagagatgtcttgggctacatgagcttcattcaaaaccttcaccaacaaagctcggtgaggctcagagctcatgagcagctccaaaaaggagaccctagccggggtcttgttgagttgttcaatgactttgaactcgctttgttagataatgtggaggaactcgctggtctcctcgagtga

SEQ ID NO: 13359 - DNA, 63 bp, Glycine max
  Peptide Sequence Number=SeqID_105044
atggcgaaaggaggtttccaggccgaggacttagtcatgcctatggtggtggcagtcttgccg

SEQ ID NO: 13360 - DNA, 525 bp, Glycine max
  Peptide Sequence Number=SeqID_105045
atggacgtgtggggtgctaataccttccccgcgcgtaaatacaactcccgaacctttcacttaaaagttcgtagatcgcgtcttttccggtttttccgacgttttcctgaaataaacgttggtggcgactccgcgcgtattcctttcgtggaacacgcatcccgcgagtcacgcatcgccctcccgtcgaaggacgtttacttgggtattgatgaatcaatgattggaattaacgagaatgacacactttatgcctttttgtttgatcaagacatttggatgaagggacaaagactacatggtggaaatggtagcaaaaaggttaaaatcggatcaccaattttgcataggctaaatggtagtgatgcattactagatgccaatcactgttgtcgcaacctaccctttcgcgggcgagcgaggcaagactcacgggtgcgtcttccaaaggaggaaaatgcgcggagtcgccaccaacgtttatttgtggaaaatgtcggaaaaaccgaaggaaaccggtcatga

SEQ ID NO: 13361 - DNA, 1842 bp, Glycine max
  Peptide Sequence Number=SeqID_105046
atggcgttgattggactaagttattccactttctcgggaaattgggctgttgttatggttgtagttttatttgtttctacttctggactctatgttcagaaacctcacggtctactctctttattggatgaggagtcaaatttagccaaggcttctgatttaacatttgccaacaaacttaagcaccacctgaatgctaatccttgcttcaaaggagaaaaaggcagagctttccgtgttcgtcactatgcaggggagttgttctccaaaatgtttaaccagtctcaaatgcagagtgttgcaacaaagttcaagttggagagtaccacacctcactttattcgctgtataaagccaaatactaagcagcttcctggcatttttgatgaagtccttgtcctacaacagctcagatgttgtgaagttctagaagttgttagagtttcaagggctggatatcctactcgaatggcccatcaagagttttccagaaggtatgggtttctgctttctgaggccaatgtattgcaggatccattgagcatctcggttgctgttttgcaaaaatttaatatcccttctgaaatgtaccatgttggctacaccaaattgtatcttcgagcagggcagattgattcactggagaataagagaaagcaggttttacagggaatacttgggattcaaaaatgcttccgtggtcatcgagctcgtgtttatttctgtgaacttaagaatggagtgacaacattgcaatcatgtactgccattattcgtggagaaaatacaagaaggaaatatggtgttacagtgaagtcttcagtaacaatttattctagaatactggaggagatccatgcaatcatactattacaatctgtaattcgtggttggctggttagaaggggggatgctagtcacataaataggtcaaagagatatcctgaaaatgctaaacctaggtggaagtcctttatgaagataataccggaagtaaagacctatgatagggagtcttgtggaaggcattggagaataggggagtttgtgttgcttacattcgggcgatatgttgtcaaggatatgtatgatgaggaatcacttggtttccatttaagtagaagtaaaacggagtatacggaatgcatgttcaacgtcatgcacactagcattggctgtgagccggacttgtccaaagagccggttcagaatctgctttcagctttagcagatctccaaaggcgagttgacaaggctgatgcaattgtgaagcaaaaggaagacgaaaataccgaattgagggaacagctaaaacaatctgagaggaagaggatcgaatatgagacaaaaatgaaatcaatggaggaggcttggcaaaagcagatggcatctttgcaaatgagtcttgttgctgctagaaagagccttgctcccgagaatgcttcagttcagcctgtaagacgtgattttgtgctacctcgtggttatgattctgaagatgctacatccatgggatctcgaacacctggtgggagcacaccaatgctttctggtagtctatctgcctctgatgcagggagacaggtcaatggtacattgaccacagttggcaatctgatgaaggaattcgagcaggaaagacagaactttgatgatgaagtgaaagctttgaacgatgttaaaccggagcagtctgccaatacaaattcctttgaagagcttcggaaactgaaacagagatttgagggatggaagaatcaatacaagcataatgatattcagttttcaaactcatttgctgagaatagaaatgctggagaatccgcaaaattggcaaaatga

SEQ ID NO: 13362 - DNA, 2900 bp, Glycine max
  Peptide Sequence Number=SeqID_105047
tgtacattgataaaattgcccccaattgcactagtgatggtaatagggttggtttgactctcctcatccctctcgcggctaaaggtggtgggatgcgtacaaattcaagtataaaagagggtgtcattcacctaggcacattccaggcaaacaccttgatcagcatgtactctaagtttggcagcatcgagcatgcacaacacgtgtttgataaaatgcctgagagaaacgaagcttcttggaataacttgatgtcggggtttgttcgagtggggtggtatcaaaaagcaatgcaattcttctgccacatgcttgaacatggtgtcaggccaagcagttatgtggctgctagtttggttaccgcgtgtgataggtcagggtgcatgactgaaggggcatttcaggttcatgcccatgtgatcaaatgcggtttggcatgtgatgtatttgttgggacgagtttgcttcacttttatggtacgtttggttgggttgctgaggttgacatggtctttaaggagattgaggaacctaatatagtgtcttggacttctttgatggttggttatgcttataatgggtgtgtaaaggaggttatgagtgtttatcggcgtttgaggcgtgatggggtgtactgtaatgaaaatgcaatggctacggttattaggtcttgtggggtgcttgtagataaaatgttgggttatcaggtgcttggtagtgtgatcaaatctggattggatactactgtgtctgtggcaaactcccttatttccatgtttggtaattgtgatagcatagaggaggcatcttgtgtgtttgatgacatgaaggaacgtgacactatttcgtggaattcaataattactgcaagtgtacataatggtcattgtgaaaaatctctagaatacttttctcagatgcgttatactcatgcaaaaacagattatattactatttcagccttgttaccagtgtgtggctctgctcaaaatttgaggtggggaagagggcttcatggtatggtagtaaaatctggactggaatcaaatgtctgtgtgtgcaatagtctcctaagtatgtattctcaggctggaaaatctgaggatgcagagtttgtatttcataaaatgcgagagagagatttgatttcatggaattccatgatggcaagccatgttgacaatggaaattatccacgtgccttagaacttttgattgagatgcttcaaacaagaaaggcgacaaactatgtaaccttcactactgcattatctgcctgttataatttagaaacattaaagattgttcatgcctttgtgattcttcttggtctccatcacaatttgatcataggtaatgcattggttaccatgtatgggaaatttggttccatggctgctgcacaaagggtgtgcaaaattatgcctgacagagatgaagtgacttggaatgcactaataggtggacatgctgataacaaagaacctaatgcagcgattgaagccttcaatttgttgagagaagaaggtgtgcctgtaaactacattactattgttaatcttctcagtgcttttttgtctcctgatgaccttttggatcatggaatgcccatccatgcacatatagttgtagcaggctttgaattagaaacatttgtccaaagctccctaattacaatgtatgcccagtgtggtgatcttaatacaagtaactatatttttgacgtattagctaataagaattctagtacttggaatgccattctttctgcaaatgctcattatggacctggtgaggaggcactaaagcttataataaagatgaggaatgatgggattcatttagatcagtttagcttctctgtagctcatgccattatcggtaacttaactctactggatgaaggtcagcagcttcatagcttgattattaaacatgggtttgagtcaaatgattatgttttaaatgcaacaatggatatgtatggaaaatgtggtgaaattgatgatgtgtttagaatccttccccaaccaagaagcaggtcacagaggtcttggaacattttaatatcggcattagccaggcatggttttttccagcaggctagggaagcttttcatgagatgcttgatctgggactgagaccagaccatgtcacttttgtttcacttttgtctgcatgcagccatgggggtttggtggacgagggtcttgcatacttctcttcaatgtctaccaaatttggtgtccccaccggaatagaacattgtgtatgcataattgaccttcttgggagagcaggaaagcttaccgaggctgaaaatttcattaataagatgccagttccaccaactgacctcgtctggcgtagcctgttggctgcttgtaaaatacatggcaatttggagcttgcgaggaaagctgctgaccgtcttttcgagctggactcatccgatgattcggcctatgttctttattcaaatgtctgtgcatcaacccgaaggtggagagatgtggagaatgtgagaaagcaaatggaatcacacaatataaagaagaaacctgcctgtagttgggtcaagttgaaaaaccaggttactacttttggaatgggagaccagtatcatccacaaaatgcagaaatctatgcaaagttggaagagctcaaaaagattatcagagaggcaggctatatgcccgacacaagctattcattgcaagatacagacgaagaacaaaaggagcataatctttggaaccatagtgagagaattgctcttgcatttgggttgatcaatagctcagaagggatgcataccggtttcaccatttcagtagtggcaagtgttcctgttcggactattggtgatggattggattttgttggaaaaagtaattga

SEQ ID NO: 13363 - DNA, 555 bp, Glycine max
  Peptide Sequence Number=SeqID_105048
atgccaccaatcattcggccaggggagcagtacccctcatatgcccttttctacagggcgcgcacggatcctcatgagcttgcttccaagctctgtattccaaggcgtgaatttgttttaaatgctgaaggagcaccctggaagctcttgaggaaggatctaatgacactggcccagacttggagtgtgttatcatactccaacctcgcccccacttctcatacggaaaaaagagaaaaattggaaggtgtagcagctggagtctcactaagcctggccaatgtgcttagcaagtatcatccactaagcgagacatcggctcgcttagcgagtaagagtaatcttgaagggaatctgccatgcaagcacgagcccagcgcgtcaccagctcgcccagtgagtcatttgtctcttctggcgcttagcacgcctggctcgctcagccaaagatcacttactcacgctaagcgcgaaaatggtgctaagtgcgccttcgaggatagaatgccctttttaaagcctgaagtgaaagaaaagatagggcttggcgaatag

SEQ ID NO: 13364 - DNA, 243 bp, Glycine max
  Peptide Sequence Number=SeqID_105049
atggttattattggaattaaagttggttggcttgcagctggtgtctcgctaagcgaggcttgtgcgcttagcgagaatcgtgcgctaagcgaggcactcagcctgcttagcgagttgggtgaatctggaggagaatctgagaagcatctgagaagcatctgcgcgctcagtgcatcatcagcttgcttagtgaggcgtttgtctcttcccgcccgcccagctcactcagcagatattcactaa

SEQ ID NO: 13365 - DNA, 582 bp, Glycine max
  Peptide Sequence Number=SeqID_105050
atgttgattaatcattcaaacaatcacaaacaagtgttcctaactaaatgcagtgaacataaaatcaaaaaggattgggttgcctcccacaattcccatctaaagctttttcttccccatgtccactacacagctagtggtcaacatgaagggacgacccaagatcaaggggatcttagtgtcctcttcgatgtccatcactacaaagtcagctgggaaagtgaaattcttcactctaaccaaaacatcttcaataatgccatagggtctggtaataaaatgatttgtgatgagaatcctaaaactgtccaaatacagggacctatgaccaggagtaggaccaaacagtcaatggataccctccaacaaatggtaacaggcatacttagcaaggcccaagtggagaaggacgaagaccgaagtggaaaaggacgaagccccaagtggagaaggatgaaggtgcaagtggataaggacaaaggcccaagtggagaaggacgaaagatccaagtggagaaggatgaaggcccaaaagcaaaggcactactaagcatattaattgttgctgaaggcccagactaa

SEQ ID NO: 13366 - DNA, 240 bp, Glycine max
  Peptide Sequence Number=SeqID_105051
atggcccgggaaattggcccgaggcccaggcaggggaagcgcctgcaggagctcccggcgatgcagaggaaggcccgcatggatgaagagatgacgaaacttgctcggtttcttgggaggaagcggagccatgtgaccgagaaatttttggcgttatggctctcagttatttcgtcaccgttttttgcgacttaccattttcgtttgtttgtcgttcaccttgtggttagacgtaagtag

SEQ ID NO: 13367 - DNA, 228 bp, Glycine max
  Peptide Sequence Number=SeqID_105052
cctttggagcttgtccataagccctctttaatagtaggagggaatgtgcctattcctaagggcactcttaagatcattccaatactctactggaggatccctatgaatccttcattccctaacaagggaagtccactaatagagggcatacccttcaaagctaagggtaacaaatggaacttttctctcttcactatcttctccttgacggcgcccaacctcctctaa

SEQ ID NO: 13368 - DNA, 1125 bp, Glycine max
  Peptide Sequence Number=SeqID_105053
atggtggcgagagattgcaaaggttttcgtttcctcgttaggagttgggaaatagcaatgggggatggtaactatgatagaactttgagggagttctgtattccggattacatattagtgccgggatctgaggtgagaagtgtttcacatgtacctgcttgccctgtgattgttttcataaacaccaaaagtggtggccagcttggaggggagcttcttgtttcctatagtacacttcttaacagaaaccaggtttttgagttggggaaaaatgctccggataaggttctgcagaagctttatgctacattggaaacactcaagcacaatggagataattttgcagctgaaattcagaataggttgagaataattgttgcaggtggagatggtactgccagctggcttctaggagttgtatctgaccttaaattacctcaaccgccaccaattgctactgtgccattggggacgggaaataatcttccctttgcgtttggatggggaaagaaaaatccaaccacggatctccaatcagtggagacattcctaaatcatgtaaaagcggcaaaggaaatgaaaatagacagttggcatattataatgagaatgaaggctccaaaagaaggttcatgtgaccctattgcaccccttgagctgcctcatgctatgcatacatttaatcgtgtctcttcaacagataaactaaacttggaatggatgctcaagtatcttatgcatttcattctgagaggaaattacatccagaaaagtttaaaaatcagttatacaatcaggaatattgctcagttggcaaaggttaagataatgaaaaaaggtcaatgggaagatctccacatacctcgcagtataaagtcaatagtttgcctcaacttgcctagcttttctggtggactcaatccctggggaacaccaaataggaagaaatcaatttatagggacctgactcttccctatgtggacgatggcctatttgaggtagttggttttagagatgcttggcatggtcttgttttgcttgcaccaaagggacacggaactcgtttggcacaggtaggacatgtcggttttgtgatcataccagtagttttctttttttcttga

SEQ ID NO: 13369 - DNA, 408 bp, Glycine max
  Peptide Sequence Number=SeqID_105054
atggctcaattcctagggtttcctttgagaggaagagttcttggaggatcatcagctataaatggagggttttatagtagagcaactgaggaatttgtatgcaaagatggttgggacaaagagctagtcaaagttaactctcatgatgacaaaaagcccatgagaatgatttcaagattgagtcaagaacaattcaagaatcaagagaaagattcaagagaaggtacatcctttgtggtacaagtagagggtacatctacttggattgttgtgattgagaacaagagagggtacatctcttgtggatcagttctagtggagggtacatccactaggttgttcaaagagaacaagggagggtacatcccttgtggatctttgcttgtaaaaggatttttacaaggttga

SEQ ID NO: 13370 - DNA, 486 bp, Glycine max
  Peptide Sequence Number=SeqID_105055
atgggtatccatctgatactgtctcatcgagatcaggattggggtcggacacccaaaccgccagttccactggcgagtttggtctccgtgaacaaatcgccatcttcactggcgatatatgcatgcatagggaaccgccagtttgactggcgagttccactaggtaggggttcagttttgcagggaaaagtggttcagctttgcaggctttcagcttttgcaggggcaggcgtgggacagggaaatcaccactcctatgggcgagttagcctaaactggagttgccaacagtattggcgagttaggcgtgggagtcgcctgcgcttccgtgactgcaaccacattgtggagatcgtgtttgtggagatcgtctttggcacttatccattgagttcgtgtttgtcgcaaactgggctgcgcttctgtgactgcaaccacattgtcgagttcacgtttgtggagttcgtgtctgcgcttccatcgaag

SEQ ID NO: 13371 - DNA, 867 bp, Glycine max
  Peptide Sequence Number=SeqID_105056
atggataggctaaacatgcagattatcattgttgctcttgtgactagtgggaacaaagaaacatacatctggttgttggagcaattcaatgatgcaatgaaagttctaacgttgcttggcatattttcggttaatgattttcgttttgactacggtgatgaaacaaagcagacgtgttacaaagccattgagatgtcagcatttaggtcttttaccaaagagttgttctacattttcctccctatgtttaaaagagcttcattgtttagggtagcggattgccataagacgacaatgcattcaattttcattgttgttaagtatcattgtagtggtaagaggtggcttatgtcatattgtcctattgttgatgagtttagatgttgttgtttgagaatggagtccatgggaaagccatgtagtcacattttaattgtattacaagctttgttctttaatgaattacagtctttgaagtttagtagctggtcaaaggaagaaagggagggaatccatgctgtatacatgcatggatctaactattgggattcttacttgattggtagatattccacattggttgatctttcaagtcgattgaaacttaagcatggtgttgaacgatctccaaatcctgtctctaatgagcttgaaaatgttgaggttgatgttgaagatcctcttattttgcgtacaaagggaagtggtcgtacttcaaccactgtgcgtgggagagttatgaggatccaaaattgcaacaagtatggactgaatagacacaacaaaagatcatgtacgagtgtcccatctagccagaccgttgccaatggaagtaatagtgagggcattgtggcagaagatacatga

SEQ ID NO: 13372 - DNA, 480 bp, Glycine max
  Peptide Sequence Number=SeqID_105057
gatggtgacattgagaaagcaacggatgggatatttaacaatctcgatgcatcagtttccagtatgaatgttgccccatcaccttttgcttccattaccaatgatgttaacctacccgatggaggagggaaatatcgacttatggggattgtgagccacagtggaacttctacgcagtgtggccactatgttgctcacattttaaaagatggtagatgggcaattttcaacgacaacaaggctttcaacaaggtgaatatttcaaccattaagaggcgcaggtcgtttttgaatggccttaacatgccacctacttctgctgatgtgataatattcatgctacctttccttggtggcatgattttcgaagtgatagttttggtcattagggatgcaatcctaccttttcaaggacattggatagaagactccaagaagattgagtcagagatacaagagaaagtcctagggttcccatga

SEQ ID NO: 13373 - DNA, 771 bp, Glycine max
  Peptide Sequence Number=SeqID_105058
atggaagaaattgtttatgaaaggagaacaaaattggctcacggcatactttctggtaaatattctgttccggcatttgagaatgatgaaaaagaaaatgttgctacttcaactacaactgctaaacaagaagggatacgtccacatatgtttaaatctgtaatagctgccagccatcctgaattttcatctccgaggcaacaggatgctttagaatttttcctacattttcttgatcaagttgagcgagctaatgctgggaaagttgaactggatccatcgacgagtttcaaatttggtattgaagatagaattttgtgttcatctggaaaagttacatataatagaaggcatgactacattctttctctcaatatcccattacatgaggcaactaacaaagaagaattagaatcctttcacaaactgaaagcagagaaacttgcagaaggaaaggaaataaatgccaatgagattgtgcgtccaagggtacctttagaaacttgccttgcgaatttctcagctcctgaggagatacatgatttttacagtactgctttgaagacaaagacaacagcactgaagactgcaggtctgacctcatttcctgattacctggtgttacatatgcggagatttgttatggaggcagattgggtaccaaaaaagcttgatgtgtacattgatgttcctgatatcatagatatcagtcacatgcgcagcaaaggtcagcagtctggggaagagctattacctgatggtggtatgtaa

SEQ ID NO: 13374 - DNA, 495 bp, Glycine max
  Peptide Sequence Number=SeqID_105059
atggctgcaatcactgtggtaggaaaccctcaccacaccgctaaagtgggcacgattgactactttgagtggtgcaatattgttaaaaattgggcaagatatcaaaagtttagaaatgagacatggaaagttgtgagtgacaaacaatccaaagcttttgaggacttttactcagatcttggaacaaagaatgaagaatgtaagacatataagcttgccaagaataaggaaaggaaatcaaaacatttggatcaaaaaaaggtatttgtgcatagattaagaaaagagactaagaatgcagagaatcaatttagatttatgtcagggactcaggatagtctatataacagaagctatttatcttctattggggttgatggaaaggtaccaaagaaacaaagagacctacatagagttcttattgagttagagaaattatacaatcaagtgtcaagagacgttctgtggaagaaggctttcaaaaagaatgtatga

SEQ ID NO: 13375 - DNA, 153 bp, Glycine max
  Peptide Sequence Number=SeqID_105060
atgccttgcaaagaaatggctctgaaaaagctttccgcgaagagatctaggagggacgccgcggttgaagggaccagtgccgccctcgagtttgatagccaccatttcatgagcaccgagcaccagcagtgcttcgaggccatcaaaggatag

SEQ ID NO: 13376 - DNA, 783 bp, Glycine max
  Peptide Sequence Number=SeqID_105061
atgaattcgcttgtcgatttggaagctaaagtagttcaatcggcaaattggggtagcatcttgtcggccagagacttgctttgtggagtcaagcctacttcaaggtatgacaaaatttatgttgaaccttacaacccacagtttgtggctcgtcaatttggcctcactcaacactttcccatggcctttggaaccatgacctcgcctacttcttgtccttcactgtatgccaatgagaaaacaactagctttctcaattggtggcctactgtgaaagacgcccattttttcaaaaaaggttttcctctttaccttttgcaagccaatgattatgttcaacgagatcctatttctcaaactccaagccaaacccaaccttctcctcatctggtttctatttcaactaagaagaaaaggagttcctcgactggaatcaccattaatccttcaccagctctgccaactggggatggcccttccgatccaactatgttgaagtcaatttggctttcttttgcaaaagtggtcaaggctcccacagtttctgatgctagtcgccaactcctcaaccatatcaacatggaaatagtttatttaatctttaatcacaatatgcatcaatgtcgttatcactctactacaactgacttgaaacaattgcggcaattagaagctcaaaaatctacttatactaccaaatttcaagctaccaaagcagaacgaaaagttgatttggtaaagcaagagcgtctcaataaaaggattatcaacctgattgcttaa

SEQ ID NO: 13377 - DNA, 675 bp, Glycine max
  Peptide Sequence Number=SeqID_105062
atgccgttagagggtattacagtggttgctgatcttgatgagacaaagatagttgaatattttgacaggaagattgctcctgtgcccaaggctgaggggactgagtacgtggcttcaaatcaaaagtctccatttggaccaacgttcacaggagcaacatttgtgcaaccaaatggactaggattcaagatcaatggccactctatcagttgggcaaactgggagttccacgtgggatatgatattagagccaggccagtgatttcgctagcatcaatttatgacattcagcagcaaagcggtgaattcgggtttggccaatccatggtgtcacttgagcctttggctgattggccatccaatgctgcatttttggatgcatattttgcaggagaagatggtgtgctggtaaaaaccactaatgcattctgtgtttttcagaagtatgctggggatatcatgtggcgtcacatagaatcagaaatccatgatgaagagataagggaggttaggcctaatgtgagcttagtggtgagaattgtctcaatggtgggtaactatgattgtatcatagattgggagtttaagccaagtggttccataaaaataggggagaactctagacacactaattctagagagttctcaactctagagatccaaagagtattctag

SEQ ID NO: 13378 - DNA, 636 bp, Glycine max
  Peptide Sequence Number=SeqID_105063
atgtgcatgttgtgtatttggagtcagtcagactgggaggtacgcctggggagtggctgctctggtgcatatgtacgaccagctgaacgatgcctctatcagcagcaaccggcaacttggcgattacatcacactactgcatgtaacacacatgtttttctttcgttgagtgctggatttacgagcacttttcctcagtcgcagagttcactgctgattaggactacgacgaggattcctcgcgtgcatcatcgaccggtccgggacttccatttgatttcatgctatttcggtctcctgcgttgggggcctgttgctgtttattatcgaccagagagggtcgtgcggaagtttggatacacacaggccattcctgctctgcttgtcgattcatgggtgtcgtatgatgatatacacgacaggccacgcatcagaccctccgcagccccgagtcgtcccttaggccccacatctgcgaggcccgctgtggaggagcctagacatgcagtggaagttttccatggaattgctgagaggttagagcgccatctgagtctaagggtgatcacgctaggctcatcaacacatgatgatggaagcttgcttgtggggcttctatggaggctggatctttga

SEQ ID NO: 13379 - DNA, 294 bp, Glycine max
  Peptide Sequence Number=SeqID_105064
atgatgcaatcctacccagcaagggcattggatagaagactccaagtagattgggccagagatgcaagagaaggtcctagggttctcatgagccttgagtttctaactatgactgttgaggttgtggctaaaaaggagacacaagtagctgaggttgttgttgttgttgagacccagaaagaggagaaggttgctgaagaaaatgtggaaccaagagagtcatcagtggaagaatccaaacccaagatggtggacaaaagctcttcttccaaggaaaagcaactacctttctga

SEQ ID NO: 13380 - DNA, 606 bp, Glycine max
  Peptide Sequence Number=SeqID_105065
atgaggattgtcattgaactctgcattcgaaaagtggacaaccacatgcctaccgcatccgcacggaggcagcgagtccttgtgactgcggcacacgatgagctagtggtccctgcgccaaatgtagaggttgacgtatttctggatgacccgatggcaccagctgatgtagaggacactggggcagacattcccacagacacaggcgcccaggctgctgaggatgagcatgaaggattttcgggtggtccgagcgacctatctgtgctgacccaatatgcggatcactttgcttgcagcgagcgtcctgagttgaagttatcctctcacgggaggaaggtccatagtttaggcaggcttgtccctgccattgagggactagttgctgggacaggactaagtcctctgatcacgtgttcgacgtctagtttccatctccctgtgggagagctcacgatcacactaggcgatgtctcctcgattctacatctgcctgcggttggcgacttgcacgcctttcagcccttgcacatggatgatgcggttcagatgctggtggacttattgatggtctccgcagaggctgccagagctgagatagggtag

SEQ ID NO: 13381 - DNA, 270 bp, Glycine max
  Peptide Sequence Number=SeqID_105066
atggagtacatagacaagccaattattactctattggagggaatccgattttacataagttccagaattgtcaagttgaggactatcctcatgaggttgtcgcaacgtgcccttttgcgggcgagcgaggcgaggttctcgggtgcactttccaaaggaggaaagatgcacggagtcgccgccaacgtttatttgtggaaaacgtcggaaaaaccgaaggaaaccggtcaaaatgaaaattctaagttcgggagttgtatttacgtttga

SEQ ID NO: 13382 - DNA, 336 bp, Glycine max
  Peptide Sequence Number=SeqID_105067
atgaaccaggtagtgatgaacaacaaacaaacccagaagggtgcttcaggggttgcgattgcccgtgaaatcatgcgacaacttggaggtcacctccaagaatccataagcttcgtgagctttgtggttgtcactggccaaataaagttaaaaatcgcaaaccgtttcatgaagttctcaaacgttgacacatgtcagtcaactgatgatagtgatgaagaagatgaggatgaggacgaggacgaggaaagagagagtgagaatcaagtggctccaatgtcttttggttttgtcacatcacccctaacgatattagtttatcatttgagcgattga

SEQ ID NO: 13383 - DNA, 567 bp, Glycine max
  Peptide Sequence Number=SeqID_105068
atgaagaagaactattggaatcttgatgatccaacagtaactttcagaggacccaggaaagccagaggaaagagatctgaggccccttccacagcaccatcaaaggcaccaacaccttcttcttctacacttcctcccttttcatccactcagatttcagtgattcctcctgcacccacacaaataccacttccagctcctctctctgcaggtccagcagattttgttttcactcctcagatgcttcacttcatgctccaaagcatccatagagggcagtccatcatcatgcagagcctccagggcttaggtttgccctccattatgagcatggaggagtttgatgaacaggtggcctggccaggagaccagccttcttcctctagagggggtggggcctccacagcccaggagcctgtgactgaggagccaccagcaccagcaccatcaccagctgcagaggaggagaccactccagctcagaccctacagccatctccaccatctgtacctgctcttgaggagattcagccatcagcactagatcttaatgaagaccagccatag

SEQ ID NO: 13384 - DNA, 777 bp, Glycine max
  Peptide Sequence Number=SeqID_105069
atgcagacccaccagaaccctcccacactggattccgacccgcagctcccgcagatcaaaatccaccacccctcctccccgcgccatcaccacccctcctccgccgccacccccacccccaccgccggcgcacgccgcaaaatcggcgtggccgtcgacctctccgacgagagcgcctacgcggtccgctgggccgtgcagcactacatccgccccggggacgccgtgatcctgctccacgtcagccctaccaacgtcctcttcggcgccgactggggctcgatcgacctctccatcaacactgaccccaactccgacgaagacgccgtcagcgccgtcaacagtaacgaccacgccaacgccggcaacagcaaacgcaagctcgaggacgacttcgacgccttcacggcgtcgaaggccgcggatctcgcgaagccgttgagagaatcgcaaattccgttcaagatccatattgtgaaggatcacgacatgaaggagaggctgtgcttggaggtggagaggcttgggttgagcgcggtgattatggggagtagagggtttggcgctgtgaggcgtggcagcgatgggaggcttgggagtgttagtgattactgcgttcatcactgtgtttgtcctgttgtggtggtgcgttatcccgatgataaggatgtggttgcggcggccaccacggcctcggccgtggtggcgctcaaggacggggatgagggcgagacggtgatccagccggtgccgcacaagaaaggtttggggctttga

SEQ ID NO: 13385 - DNA, 438 bp, Glycine max
  Peptide Sequence Number=SeqID_105070
atgtcgcgaaactttatggattacgcggtgatgggtgttaagcgtcttaaagtgatcaaccaaggtgcgaataaccgtaaggtgtctccgcatgctaccagactctcggatcgctggatagcaaaagataaccgtaaggtgtctccgcatgccaccggattctcgggtcgcaggatagaaaaaggtgagactaaatggatgcagatgaccacattggtctctgtgtgccatcagacttggggtctccaaatgatgagcttaacagtgaacggatcttctttcttaggagatcccactgcttctgagggcaaggatgaaaattcttatcctgggtcaaggtttatggccgatgagttgagattttggctcaaaaggcttgtagaaaggccagacatgatgtatgtcagggtgttggtttggccagtggttcagggataa

SEQ ID NO: 13386 - DNA, 690 bp, Glycine max
  Peptide Sequence Number=SeqID_105071
acttggggatcccttgtatcgaaagtcttcctcgcagtgagtccaagcagcgtgtcccgtagatggagcggtggtgcaagtactgtagggggaaatgtgttggagtacaagtgtgaggtgaagtcccacatcggtgtggtgtcaagtttccttatgtggtggcttgtggtccataatgcagtgatttctctccttgaatctccccaacaattggtatcagagttgatggttcgacttggtggccagaatggtaacggcgcagcatgcctcgcagatggagcggtggtgcaagtatcgcaggtggctagaatttctatacttatggatgggggagatgtattggagtacaagtgtgaggtgaaatccgacatcggcgatggatccttagccttggggatcccttgtatcgaaagtcttcctggcggtgagtccagacagcgtctcccgggtggctctaatgtcaagtttccttatatggtggctcgtggtccacagtccgaccatttactgaagcacattgatggtaaagtggcgcctggaggaactgagcggttttgtcgatgtttcaacaccaatggaatcatggagtattggttggagagtgctaatttggatgagatttgccaggagactagggtgcaagatccttatattgttgaactcaaattgcttaaaactaaaatggcctag

SEQ ID NO: 13387 - DNA, 303 bp, Glycine max
  Peptide Sequence Number=SeqID_105072
atggaaccatacttcaaagcatgcaaactatacacttactgtgttgttgccatccctgatctagtcttgatactagtgttcaaaatgagaatgaagggtcttcctgtgcaaggtcttcctttgcaagtgatggcaggggagatgaacgagtcatggaatactcagcaacaacatctctggaagatggatatgattttcaatggtgtatttctcaaaggtaacaaagccacaatgaacatgctgcatagagttgagccctatgtgacttatgggtatgttaacttccctgccatacttatttaa

SEQ ID NO: 13388 - DNA, 93 bp, Glycine max
  Peptide Sequence Number=SeqID_105073
atggtgatagtggtggcgatgacaaaaatggtcatgttggtggcaatgacggtgattatggagacatcatggtggtggtgtaaatcttattga

SEQ ID NO: 13389 - DNA, 588 bp, Glycine max
  Peptide Sequence Number=SeqID_105074
atgcaaaatcaggaacttcattttggcaagagctacttaatagaaaattatcacggggaacctgagctacaatcttacaatcaaaatgaagcagaaggacgtcccaatctggacaaattgttgatgcaattcaaggaaacaactgaatccactcaacaagcaatagctaatgcagaaattcaggttgggaagctggcagaagaaatgactcaatttgtggccagacgagaagaagactttgtagaggttgcagctcaagaggaaagccatgcaaaagagcatgattcaaaagaaaaagatgaggagaaaggtgaggaaaaagcacatcaagtggaggagtacttacaagtagacattcagccagaaagtatcctccaagtcaagacctttcctcatcaactgattgtcaaggaggaaagacatggagaacatgataattccttaagcatcattctttccttgatcaatgacacctcttctacaatgatttggaaggtgcttccaaaatacatgaagttcatggaatttctagctaaaaggcgaaactgcaaggaagatgtgttctttgtgaccttcatgccaccttga

SEQ ID NO: 13390 - DNA, 189 bp, Glycine max
  Peptide Sequence Number=SeqID_105075
atggatgtcgcgctaagcgagctcaatgcgcttagcgatccgcgctcagtgctttatcagctcgttcagcgagtcgtttgtcaccttcctaggcttagcgcaagattggcactgagccaaaattcacttactcgcgctaagcacgacattgaggtcaggaagtcctttttaagcctgatttgcgcataa

SEQ ID NO: 13391 - DNA, 426 bp, Glycine max
  Peptide Sequence Number=SeqID_105076
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttttgctcaaaaggagctctgaaatctgaaataattggacccaaccttggcccatgggctcagaaatctaccctaaggttcatgagaaccctagggccttcttcagcagctctagcccaatcttcttggagcctcttgctcatggttctagtgattggtcccttcctagggaggattgcatcaccttatctatcaactattgtagaacctgatgagcaaataacaataacaattgttacacatgcaatggctttccaaaagagtattgtttag

SEQ ID NO: 13392 - DNA, 951 bp, Glycine max
  Peptide Sequence Number=SeqID_105077
atgcggtggcattttcgcaatttaaatcaactttttgagagtgttaacagcgaactacgacttttcattttcactccagagaggatttcgtttctggttcctcttcccctccgccaccgtcctccaaaccctcgcgttgtccaagccaagcgccacttcgtccaaggcgcgcagctcctcgcccaagccagaagatccaaaagcgcttccgccgcaacctccctcgccaaacaggccctagccgaggtcgagaaggccctcgcgctcgaccccaaggacgctacctcacacctccagggcttcagcaccaacgcgctcgatgctctcgatgccgcgttgtcccctcttgccgcggggaaacaaaatgggagaagaagcgaagaaggcttatgtagaggctttggagttggagccatagtcaaatgtggctcaagaagcgctcagcaggttgggtttgtcgtaatcgcactcaattttgacaaggcagtgcctgagcctgaggaaccaaagctgaacaccgactgtcctgatcagtgtaaatcaaaaaacgcagattctgcaggtgaagctgaggatgatgatgattttattactaatgaggttaagaggaggctgaaagaattgagaagaaacagttttatggtgttgattcctgaagaagattcctacccggaggaaggggaggaggaagaggaagagggagagacgggctcaaatgaatggagggatgtggaggcagaaggtcaacaatggtggcgtggttttgatgctgtgtttgaaaagtactgtgaaagaatgttattctttgatcggatgggcactcaacagcttagtgaagttggcaaagtaatgattggagaagttgaagaacaaattgagtatctggaaaagttggtgccaaactggatctacaagaaattggttgctacaggagatactgtgtactggtga

SEQ ID NO: 13393 - DNA, 93 bp, Glycine max
  Peptide Sequence Number=SeqID_105078
atggcattagcaaggagaagatgtgcaaaagaaggcacagtccatccagaaacaaaacactgcccctcacgtgttgtctcgtgggagttatga

SEQ ID NO: 13394 - DNA, 906 bp, Glycine max
  Peptide Sequence Number=SeqID_105079
atggacaagtattgtccagtgtcgagagataaccttgacaggtgtgagaattgcaagtctttcaagcttgttaaacaagcttggacaagtgttgtccagactacttatgtcaagttgttcggggtggacatgcttttagttttgcaggcaaggagtgtgcaacacatgcatagtactcttgcatacatgtcactcgtggagtggtgggctaaacgcgcatccaccgctaagcgcagcttcaatgcgcttagtgcgacaaaagaatctggaagggcatcatcatcaaagtcgcacgctaagcgtgagatcagtgtgctaagcgcaacaattgtcttcagccaggctcagcgcatgactggcgctaagcgcgagggtggcactaagctcaatggtacaatgcccaaggcacagaattccacagcacaccataatgcctattttgggaaaagagctctggaggcagcaagaggagcagcttttgcagagatacctagtctaaacctaggagggctgcctaaattgagcctagtccaacaagagggatctgaggacaaagctttgattgattcagtccaactagggatccaggcctcacaggaaagctttatcacccatggacgccaagatctgttgactgctgccattaggcgaccagagaaacctggttgtgtctgtgctactggagtcggtgccacgatcaaacattactttggattggggcttgcactgcctcctgagtttgaggttggtccttctactgttcgtgacccagacacgggtggctcagagaaatgtaggttgtatgttaatgagaatctccccgcttggttgcctttggaagagtttatgaggaagttagagatgttgatgctcgaattcatgtacccattcaagaggttcagttag

SEQ ID NO: 13395 - DNA, 318 bp, Glycine max
  Peptide Sequence Number=SeqID_105080
atggaaggtattccatatgctaatgttgtagggtcactgatgtatgctatggtatgtattcgccctaacatagcacatgtagtgagcctacttctatggaggctggatctttgggcttcaatgaggtccttcaatggtgattttacaccatggagatgcagcggaagacaaaggagaaaaggtgagagaaggcgccatccactagggaataagccatggaagaaggagcttcaccaccaagaatgtgccttggataaaaagcttggagaggatgcttcaatggaggaaaagaaagagagagggggagcacgaaactga

SEQ ID NO: 13396 - DNA, 300 bp, Glycine max
  Peptide Sequence Number=SeqID_105081
atggctccgaagaaactctccacgaagaggtctagaagagatgccacaggagaagggtccagtgccgccccagagttcgatagtcatcgtttccagagtgccgagcaccagcagcgcttcgaggccatcaggggatggttgctccacagggagaggcgtgaggagatagctcgaagacgttggacaccgctggtgactcccatggccaagtttgaccctgatatagtcctagagttctatgctaacgcttggcccatggaagagggagttcaggacatgcgttcgtgggtgaggggttag

SEQ ID NO: 13397 - DNA, 102 bp, Glycine max
  Peptide Sequence Number=SeqID_105082
atggtggctattcagttgactgttgatttgaagcctgatttgccaagggaagcagagagaattaagaagtgcaaaggtaggcattcaggtactgtcatctaa

SEQ ID NO: 13398 - DNA, 474 bp, Glycine max
  Peptide Sequence Number=SeqID_105083
atgtttttggtggcgttagtgtcgttgtggggagtgagggtgtcgttttggggagtgggagtgtcgtcgtcggaggtggaggtggagcaggaagaagaggagagtaaacggtcgttggagtcctggaaaaagcaagactcggtgtcgtcttcttcgtggtcgtggtccacggcttcttgggtcatggcttacggggcattcccatttggatcaaccaacccgaagaaggagatgggaatgggtcggatcgttaaacggatctatgtccgtggaagagtgaggaatgcggtgagaaagagtttgttttgtgagaatgtgagagattgggaagaaaggaaggcctgtggggtgagtggtgcttgctgggtgggtcctgctgttgtgttgtggtgggttggagtaggcagtgcgttttttgggggatgggggactggagagagaagatgcgtttacggagaacttttttctttataa

SEQ ID NO: 13399 - DNA, 1803 bp, Glycine max
  Peptide Sequence Number=SeqID_105084
atgacgacggatgatgatggtggtggcggaattggggagggtaatgtcaatgtcagtaatgtggttgatgaaactgtgcaagcgtgtacgattagggatttggataatgggaaggagtttgtggtgaaggaggatggggtgtggaatgaggtgaaggaggtgggcactgggaggcgtctgacagtggaggagttcgagatgacggtggggcattcaccgattgttcaggagctcatgaggaggcagaatgtggaggaaggtggtaatggggagggtgtggatggtgatggtggtggtggtggtgttggtggtggtggtggtgatgagggggatggtggcaaggtgaagaggaaagggggctggtttaagtttatgagtttgaagagtgttgtggtgggtcagaaagagaggcggagtggggatgagagggatacgtcgtcgtcagagaaggcgggtggccggaggtcgagttcagccacagatgatagccaggatggtggtggtttggttcatgggggtgagagagtgagggttaggcagtatgggaagtcatttaaggaggttacagggctttatagtagcccgaagattcaggctcatgagggatccatttggtgcattaagtttagtttggatgggaggtatcttgctagtgcgggtgaggattgcatgatccatgtttggcaggtttttgagtcagagaggaagggcgagctgttggtggagaaaccggaagatgggaatttgaacatcatgtttcttgtgaatgggtcgccagagccttcatctcctggcatggacaataattcggagaagaagagaagggggaggttgtcagttagcagaaaatcgttgagcttggaccagttagtggtgccggaaactgtgtttgcactcactgaaaaacctgtttgctcctttaagggccatctccatgatgtgcttgacctttcttggtccaagtctcagtttaatcctgttgatgatagatacttcattagtggatctttggatgctaaggttcgtatatggagcattcctgatcgacaagttgtagattggactgatttacatgagatggtcactgctgcttgttatacgcctgatggtcagtttgttcctggaagttcatcagaagtacttatcacttcttctgattctcgaattcgacttgttgatggtgttgatttggttcataagtttaaagggtttcggaatgcaaatagccaaatttctgcctgcctcacagcaaatggtaaatatgttgtctcagcaagtgaggattctcatgtatacatctggaaaaatgaagctgattgcagacctaacaggagtaaaggtgtggctgtgacaagcacatatgaacattttcactgtaaagatgtgtcagtggccattccttggccaggtatggatgatacatgggagatgcatgatccatattttgcagaagaacctgagcttgatgatgatggggatgaggtcttttcggccaatcatcctcctactcctgtagaggaaaatctatgttctgagggttcccaatttgcttcaggttgcaatagcagtccacttcatggaaccattgcaagtgctacagatagttattttcttgatagaatttctgcgacatggcctgaggaaaaacttctaactacaagggaccgaagccctcaggtaagtgtggatttatctaaaggggtgaatcaaaacatgtcagcctggggtatggtgattgtaactgccggccttcaaggggaaattaagattttccaaaattttggattgccacttggtatataa

SEQ ID NO: 13400 - DNA, 619 bp, Glycine max
  Peptide Sequence Number=SeqID_105085
gtgcaccctccgcacagagaacaaaatcttcatgggtgtcaaatatgtcaagggaggggaactctttgccaaggttgtaaaggggaagatgaaggacgacatctccagaaagtgctttcagcaactcattagtgccgttgatttctgccatgaccgtgatgtcactcaccacgatttgaaatctgaagagatactcctcacattgtgcgacacgtcggcctatgtggcaccaaaggttctcaagaagaagggctacgatgggtccaaggcgtgcgacacgtcggcctatgtggcaccaaaggttctcaagaagaagggctacgatgggtccaaggctaatatatggtcttccgagggccaaaagttgatctctaatttactcactatggacccacgaaagaggtattctattcctgacatcatgaaggaccctaggtttcaaattgggttcatgaggcccattgctttttccgtgaaggagtcagtggtggaagataacattgatttcaatagggatgatgttcctaatgtgaattgtaatagcaatggtggtggtaatagcaacaacaacgatgatgaggaagtgattatggtgtaccattgctggaaattgtcttag

SEQ ID NO: 13401 - DNA, 249 bp, Glycine max
  Peptide Sequence Number=SeqID_105086
atgggggtagccaagtccaaagatcttcttctatggtgcatgcatcaactccttaaggctaattcaggtcttttgtccatctgcaactatcaacaaataggactcaggaagcccaataagggaaagagttatatatgtgtgagctcccgtattacatgcctggaggtccactttggctttgatgaggctcactttgatgagtgctttactgctcgggatgctcggatatttgagcaccacgccacatag

SEQ ID NO: 13402 - DNA, 336 bp, Glycine max
  Peptide Sequence Number=SeqID_105087
atgagtgaggaagaaatagaggatttttcattgattcaaggttttccttccctagacgtgccatttaggagaactggagacacggggcaaaaggtgtgtgaagtggtggtgcatgtgagcttatatggtgccactacgacctatgtcattgcctctaccaccagcatcagctttatctttctgttctacatatatctaatggaagcaagttttatcaataaagagagaattcaaacatttgcttttggtacaaggattcctgctgcttgtcagagtgggaggtcctctgaaatttttccaattatgaagggagtgttgctgcatataaaagcttag

SEQ ID NO: 13403 - DNA, 258 bp, Glycine max
  Peptide Sequence Number=SeqID_105088
atgactttgcatggtgatactaagcaagctagacctaagtggattgaagttaagagtcaccttcaaaccggaggttacgaatatggatattacgtgatgcattggatgtggaacatagtaagtggagagttgaagaatgattggaccatgtggtttggtgatggcatgccattggacaaggacaccatgacaacaattcgcaagaaatggacaacttattttttaaagcataaagagatgcggtgtaaaaaggcttaa

SEQ ID NO: 13404 - DNA, 287 bp, Glycine max
  Peptide Sequence Number=SeqID_105089
atgatgttcttctatttccaaaaataaaggtagcccaagctaatttgattggtaaggttcctgctaacttttgtgccatcccagggatgaaggaggtttgggataagtctcttcctgggagtgcttatgtaggaccagggtcttgggggacccttcaagattggggtttggtggtcttgggtgagactcagttggtaactttttgtttggcttttatggcaatatgggacatgcttctattttgcatgggttggaagtttgttggaatcaaggttgctgcaagttaa

SEQ ID NO: 13405 - DNA, 270 bp, Glycine max
  Peptide Sequence Number=SeqID_105090
atgaaactggccaaatacaatctaaaggcccaagtggagaaggacgaaggcccaagtggagaaggacaaagcccccgagtggagaaggacttatcttcctttaccggaagtggcgtctaccccgacttatcttccttcaccggaagtggcgtctaccctgacttatcttccttcactggaagtggcgtcatccaaatcttcgtagcctgtatcaaacgatccgctcctactcaggttcacatcatctggtatcagagcttcggctcttga

SEQ ID NO: 13406 - DNA, 294 bp, Glycine max
  Peptide Sequence Number=SeqID_105091
atggacctaatgatgagaatccataaactggccaaatacaggctaaaggcccaagtggagaaggacgaaggcccaagtggagaaggacaaagcccccgagtggagaaggatgaaggcccagaggcaaagacattatcaagactattaattacttatcaaggtaatccttgtggcgtttaccctgacttatcttccttcactggaagtggcgtcatccaaatctccgaagcctgtatcaagcgatccgctcctagtcaggatcacatcatctggtatcagagcttcggctcttga

SEQ ID NO: 13407 - DNA, 159 bp, Glycine max
  Peptide Sequence Number=SeqID_105092
atggatcacgaagatgatgttgatgcactcaacctagaaacccttcatgatattgagcaactctatgactatttgatgttggaaaaggaagtcgattggaagcaatggggtatttacgagatgatttccttttctcaaaaagaaattacctccaattag

SEQ ID NO: 13408 - DNA, 1290 bp, Glycine max
  Peptide Sequence Number=SeqID_105093
atggggatagatgatctcatgtatcaattgtccaaactgttagcagatgtcaccaagcctaagcttcgtagggtatacagaccagctgaaccaaggccatgtgatttcggaaagagccacatagtcgaattcagttcaggcgtatttggttccgttgtatcagttgatttcaggaccggttcaactaattcagccaaatctgaattagctagctcagccgaattcaaattggctaggtcagctgaatttgtctatctagttcagtcgaattcgaatcagctagttcatccaaatttgaatcaactagttcagacgaatgaggttcaggtaggaccagcactagtacatttgagttatgctcaaataggacaaaatttgcaggtactgaataagttaccaaatcaacataacatacaaaatgggttggttcaattggctaaaggggtcatccagtgtggcacaaaatacatgtttgcaaaacatattgatgatggtttggggaagcaaccatggagtattactccacctacctctgctgatcaacatggatttcagcctatgaccttatgtgagaagcaacccaagacaattgtcatgcagaattcggctcagtcagcaacttcttcaattgttgaaccaggcatgttacaagtctacggtggaaaggaaaaccgaaatgagtaccataagcttcaattgttcccactatctttaacaagaactgctttcacttggtactcttgtttgccctctaatttggtacaaagtttggctaatatggagagggtaccggagacactatcagccgaggaacttgctaagctgggtgaaccaaccaaggctaagagtgatgtaccaatcattaccccaaatgagctctctaaggctgatggttttttctttggtttcccaataatatttggaaagatggcttctcagtttaaggcttttatagatgaaaccggagatctatggaaagcagaacaacttgcagccaagcctgctgggatcctcatcaccacctgttgccaaggtggtggaaaagagatagtacatactgcaatcactcagctggaaaagcatagaatgatatatgtttcaacagaaattggatacatatactgtactggcatggtcaaggagaacgaggtggaagagaaaggtgaaggtacgtatggtgcaggaacttataatggaagggtgacgaataggtcagagttggcggatgcattccaacgaggggtttgtattgccgtcatcacaaagatgttcaaggaagctgctgcataa

SEQ ID NO: 13409 - DNA, 285 bp, Glycine max
  Peptide Sequence Number=SeqID_105094
atgcttcctttcaactctcgacaggtaacgaaacttcacggattgcctaacgatgggtgtcaagtacctcgaagcggtcaagcgaaggtcgcatcccaccaaacagatggtccccggatgaaattagggtatgacaccatccatctgatgatgaagcctggaaacactttgatcggaatgttcaactcggtttatgcacagatggatttaacccatatattcaagcatcctcttcaccttattcttgttggccaatcattgttacctcgcacaatcttcctctag

SEQ ID NO: 13410 - DNA, 414 bp, Glycine max
  Peptide Sequence Number=SeqID_105095
atgtatgaccaagtgaaggtgcaaattgcaaagaagaatgaaaactatgccaagcaagccaacaagaaaaggaaggaagtggtacttgaacccggtgatgatcctggacatttgaggacaaatgttttccaagaaggagggaatgatgagaatcatgaaactggccaaatacagtctaaaggcccaagtggagaaggacgaaggcccaagtggagaaggacaaagcccccgagtggagaaggagtttctctcttgttgaaccaatatcagacttatcaaggtaatccttgtggcgtctaccctgacttatcttccttcaccggaagtggcgtctaccctgacttatcttccttcactggaagtggcgtcatccaaatcttcatagcctgtatcaaacgatccgctcctacttag

SEQ ID NO: 13411 - DNA, 381 bp, Glycine max
  Peptide Sequence Number=SeqID_105096
atggaggagaagaaaaagaaaaaagtggaggaagctgctcaatccggaagcactgacatcgtggttgatcctccatttcccatcagacgacacgtgaagtggaagatggcctgcaccaagaaaactggccaaatgacgtctgaggtagcaaaggaaattgctgacaagcttgattcgttggaggagcaagcctcacagggttcctttgtctcccatggatgtcaggatgtacaaactgcaaccattgcgcaaccaaaacacccttgtcgtgtgcgtgttgttggagccgatgtcatgatcaaacaatactttggaccggctccaaggacctcctgcacatcttcctccatggctttggaagacctggagcagctgacgtaa

SEQ ID NO: 13412 - DNA, 960 bp, Glycine max
  Peptide Sequence Number=SeqID_105097
atgagtcatcgaaaaagtgaaagggctcatccactttcaccaccgctattggccatcgacgtcacagactctctggagcacccacgataccagtacctctttccttatcatttccttgatcatctactttattctcttcagatgatcaacgtctatgaccctaagtacctagacttagatttctatggtgagacatttgattactatcaagtgtttcaaaattctggcttagttgattttatgtccttaaagctgccttattatcctgaacttaagtttgactattccagccatgatgcttgtcgaatggtctgcaatgaccaggcagatatgaccggcagattgcttgctgggtcattaacatttgactatcgcatcatgcattatataattgtccgcattctgcttccccattcttctaacctagctcaagcctctgaggaggacttgattttgatgtgggcttttcttatcggccgtcagatcgattgggcccatttggttaggtaccgtatgtataaggcattatgtaccaatgcacctcttctgtatcctcagctagtcactcttttcctttgtcattttcaaattcctcttgatgatgaaccttttgttcaagtcaagagatcttttgccattggtgctggtgcggtagcgtcttttgggtaccgtaaggatatgggtggacagtggcttaggaaacaagatgtgcaacaaccaatccctgatgagcacactccatcacctccgccacagcaagatgattcctctgctctcatgaatgaagtcctttatgaactctgtgggcttcgagcattcgttggtgattgtgccgatgccatgtatgctcgcctggatgccatggatgcacgtttcgcaagaatggacacccgcatcactcatcatgaagacgatatgggtttcattcgccattgttttgattactcggctgatccatag

SEQ ID NO: 13413 - DNA, 405 bp, Glycine max
  Peptide Sequence Number=SeqID_105098
atggtcaattataaagatgaaagcaccaaatttctcctgtgggatcgtgaatgcactgaattgattgggcagtcagctgatgaagtcaacagcctcaaagtagaagatggtgatctggatttaaatgcctccccaaaagcacttgataaactactgggtcatctgctcgccttcaaagtcaaaatccagctgcagtataaaaattctgttgttttgaaatgctcaactgatttaagtttaattaatgatgttctggatatgtttcctgatgttgagacatgttcaaagattaaagttacaacaccgtttgattctaatgatcctgtccacgatgaatctcaatccatttctataacagcagaccatgatccatttattggacttcccttgacaccaacaaaatga

SEQ ID NO: 13414 - DNA, 345 bp, Glycine max
  Peptide Sequence Number=SeqID_105099
atggtggttcctagtaagatagttccaaagacacctttgaattgtggacaaataggacacctaggcacctgcagtatgagaatttttgaaactgaaaatgcaaggttcattgaaaatgatgaaatcaatgggagtacagttccacgagaagtggaaattaaagaagttagagtgcaagtccttttagcttgtgcctctagtagtaaggcgattgcttcttttagttgttgttacaaaattaatgaagaggagcaacccaataatgaacccatgatgcataatgaacctattatgaaagaaccacaagaagtagcattaaggaggtctcaaagagaaaggagataa

SEQ ID NO: 13415 - DNA, 666 bp, Glycine max
  Peptide Sequence Number=SeqID_105100
atgggaacacttaagctgaagcttgatattgttttgggtcgaaagaacctgattgatatgttcttcttgggaaccatagagatgcatggacgaatggtgctgttgatcctagcattggaacagctgcactacttgatgttgctcgttgattttctgctctattgggctcggggatccactgagtgggttcaacaaaaccttaataatcttcgttccaaagctgtagcataccttaatgtggactgtgctatgcaaggtcttggttgctttgttggttcaactcctcagctagacagtcttattcttgagattcaaaggctcagtggagttgattctgattttgctccatttgtgcagcacgcagggttgtacaaaaacacgttgagcaacttgatagaccagaaaatttctctacatccattaaccctttcaattgaagaatctgcttctgctgccaaagaagccgatgatgaattaaagcgagcattgaatgatagactaattgcggaaaaaggcttcttggatgcagatggacttcaagcatctctcggatttctgattctatcactaggtcgtcggctatcatcaattcaatatgagatttggagggttgccaaagcaattcgtagagctgctggtgctgcactcagtggagaattcacctaa

SEQ ID NO: 13416 - DNA, 294 bp, Glycine max
  Peptide Sequence Number=SeqID_105101
atggcacgtattgatgacaagataaaatccattgatggatctaaagaaactctgaaacttgctgtaaggataaccaagctctggtttgttgggacgccgggtaggtctgaacaagctgagatgatcatcgttgactctgatccgttagttagatatttttatgattcacagggtgatcaaatccatgtggtctgtaagcaagaccagttaaagacatggaaaatggatttgaaggaaggttgtacttatgtgatgcacaattttagagtcagcaagaatgatggacagtacaga

SEQ ID NO: 13417 - DNA, 264 bp, Glycine max
  Peptide Sequence Number=SeqID_105102
atggactcgggaaggttccaagttagtgtactaggtgacaactaccccagtaaaactttcttggaagaaatatggttcttggggcaagtagtccccttgtacttgtcaaagtccggcaccttgaacttgggaggggtgacgatattgggtactaggaacaactcttctaggttaggggcccttgaaactcagcctcctgcctctatttataggagaaaaggggaggtggttgccgcccaaaggcttcctgaggaagatttctga

SEQ ID NO: 13418 - DNA, 330 bp, Glycine max
  Peptide Sequence Number=SeqID_105103
atgactagccctctcgatgagtcaatctcttgctttctcataagggtggacccttgggtactagtacctattgccttcagagagctacatgccctcgttgtaagagggctgcatgcccttgccttcagaggactgcacgtccttaccttcagagggcttcacgtccttgcctttagaggactgcacgtcctcgctttcagagggcggcatgtcctagcctttagagggctacacgtcctcgccttcagagggctacatgtcctcgccttcagagggctgtatctcctcgccttcagaggactacatgcccttgccttcagaggactgcac

SEQ ID NO: 13419 - DNA, 309 bp, Glycine max
  Peptide Sequence Number=SeqID_105104
atgaatatgcacaaaacaacaaaggggacccctaaggctcgcccaggcgagctaaggcttattcttgaagtaactggctcgcctaggcgagttggttccttcaccctgaagtcatttgggggtccaggcaagccagaggctagcctggacgagctagggtccaggaaactcaaggaaaagacccttttgcttccttttttggtatctttcgcattcttgatcaaaacactgaatgatcatctgtttcacactgtaactggcgttcaacactgtaagttgactagcaaggatcaaaagatcaatgaatga

SEQ ID NO: 13420 - DNA, 267 bp, Glycine max
  Peptide Sequence Number=SeqID_105105
atggaacaacataacttttaccaaactcagattctcaataaaatggtgcttgagattgtaagtggacttaaggctgtggattttaggcaacctgaggtgctattggtaaacaaggttgatgaatttgaggtgagaaaaaggccactagaggcattagcatatatgggactaaatggagagtacaatttgaaggagttaatgagattgctgaaaaaggtgccaggtcagagtctgaatgacataaatcagttgcagcatgtgagataa

SEQ ID NO: 13421 - DNA, 207 bp, Glycine max
  Peptide Sequence Number=SeqID_105106
atggaggtggttgagcttccactgcggcgagggattgcattcgaggaggcgagaaatgacaagtcattgagggagccaaatagggcattttgggagagatctagggaggttaatgtgaaggaaaacttggagtgggagaaaggaggcatggcggcgggaccggagagttacatcaactctaatgaaattgctcaaatcgatttttaa

SEQ ID NO: 13422 - DNA, 387 bp, Glycine max
  Peptide Sequence Number=SeqID_105107
atgctcagtactgctgaaagtgaagaggctaacgtgaaaggtgcacattacgtgaactcattgccaggccctcattatcaggtgttatttcagcacctatcacttttatggaaaaatcaagatctcaaacctacaaagaatcaatcagtcagtctacgaggaacaacaccaaatagatctggtactaatagacatcaaatagaaatgtgctacaaaaagttgccaattgaattgcggcgtttggcatcggttatagcacaaggccgaaggatccagaaacaaagccacaaggaagggaaaaatgatcttttcatgaagattgctgaccttaaatttgcccaggccagcatccagctcgcctgggctaagatgaaacttcagccctaa

SEQ ID NO: 13423 - DNA, 207 bp, Glycine max
  Peptide Sequence Number=SeqID_105108
atgggaaatggaattatggaaacttcccataacttgaaagagctatatagtctttctgttgatatatggagtttgggatgcacaattcttgaaatggcaacatcaaagcctccttggaatcagagcctatttgaagagtatgaaggggttttaaatatcactatagaagcagaccttggctgctataggggatgttgtagtaaatag

SEQ ID NO: 13424 - DNA, 996 bp, Glycine max
  Peptide Sequence Number=SeqID_105109
atgactaacattccttatccacaacctgaggttttgcaaactatttataaagttttaaccacatttaaagagggatcaaaggtgtatggtaagaatagtgaagagtggtttcaaaaagaagaagacgaaatggtgggatccattgctaggacattggaagaagaggtcaagtttatggcctcttcttctaagttctgggctgaggaagcctcgctttggcaggtgctatgtgagcttttggaaactcatccagggctggagttcctgcagagcacacctgagtttcaagagagatatggtttgtcttccatcttggttataaccttgcatttagggaatgaatcactaaatgagggtggaatgctttttgtggacaagcaccctaaccttagggtccgtgttgttcatgggaacatgtttactgttgctgtcatactcaatgagatccctcaaggtgtgaaagaggcgttcctaaaaggagcgacatccaggcttggaagagcaattgctctctacctttgccaaaagaaagtcaaagttctggctgcagtttacaacataggagctataagtgctgccttccttgccaacattgccaaaactgatgcaaaagtaagcttcaatggaaattcatatcacttatccgcatggtctttgagcatcttaccagactgcaagagtgtagtgcttaatacggcaaagattaactctgcatctatgatttcaagcttcacaactgaatctttaaaagaagaggttggctctttggatgattctggctcgggatggagttggattagtgaacctatcgatatttcaaaggctcattcattctcaaaattttggttactggagcaaataaatacaactgcagatagaagtgttcctcaagatatatacattgatcttgatgctgctactgaaactgtccttcacattgaatcccttggtcatactcttcatgctttaataaatgggatgcttgcagctaaataa

SEQ ID NO: 13425 - DNA, 867 bp, Glycine max
  Peptide Sequence Number=SeqID_105110
atggggtttgtagcttatgcagatgatgtggtaaaggtcagtgttgaaaaagtttttgacggtgatgctcaagtcctgtacccgacgtcagaaattaagtatgtcaggaaaacccttgacacattcattgcatggccgacacaacttgggaaacttgtatcatatgaggattctcatattagtcccaagctattggctggacctgttcaaaggtcaaatgatgttgctacagatgacccgttacgtgacttgattaagagcctgtatgatatttacgagaagcctgttgagtttatgtggaatgggactaaatttgggattctgaatgtagatgcatctttattcttaacatattctgatgtaaatgaaataatatcaggtgacaaatgtttgaacatagctatactacagttgtggatgatgtttttggatgagtggtgttcaagcttgggtcatggttcggtgtatggattcctcgagccccaatccatacacaaagcaaaggatagatgtgttgaatgtcaacattacattcaaacatgggtgaaggattcccaacgagaggtctatctcggagcttacttgaatcatgcaatgaagacattaaagactactgtggatggtaaaactgatcaagttggtcctcagtggattgaagtaaagagtcatgttcaaagaaaaggctatgagtgtggctattatgtcatgcattggatgtggaacatagtaagcaggggtttaaagaatgattggaccatgtggttcggcgatgggacaccattggacgtcgagaccataacaacaattcgcaagaaatgggcaacatattttgtaaaagttaaaaacacaaaattgagaaaggtgtag

SEQ ID NO: 13426 - DNA, 336 bp, Glycine max
  Peptide Sequence Number=SeqID_105111
atgaagatggaagcaaacaaaacaagaaatgaattgaaagtctcggattcgaaaacttaccagttgaagactaaagaaggaacgaagaacggtgaagaatggcggaaaatcttcacggatttgctcacggaaacgtctcggaagcgtaacgaaagcacctcaggagaaatggagaggtgcttgccgcctagaggcttcttgaggaagatttatgagcgcaccccaattactaagttcaccccccttttcgtactttacagaaaagttacggaagtcttacaagagagtttcaaacttgattttcctcttttttcgcttttctttcaccaatattaa

SEQ ID NO: 13427 - DNA, 129 bp, Glycine max
  Peptide Sequence Number=SeqID_105112
atgaacattatctcaaaaatcccaacggtgaaggtttggtgggctgcgggagaaagaaatggttttggggaggaggagagggaaaacgaaaatgagggaaagaagaggcaccgtcagtgtgaaaactga

SEQ ID NO: 13428 - DNA, 321 bp, Glycine max
  Peptide Sequence Number=SeqID_105113
atgtgcaatgcctggaaagtgttcagcagactacatggagtggtctacatgatatctcatcccttcatgagtccggcacaacctggggatcctcctagacatccgcccgtggtgcacgatgacacatttgttgaaccaaatgttggtcagcacctggtggcggtagtggctatggacgaagcacccgaagatgcatatgctgatgaggcttgccaaccaatagctaaaaagctggaaaggttgctcaacctaaggatagtaactgaaggagcaaaagcatacactgccaccgaagaatgccttaggtcacaagaggtgtga

SEQ ID NO: 13429 - DNA, 651 bp, Glycine max
  Peptide Sequence Number=SeqID_105114
atggaacatcttgagctgaagttatcctcccatggaaggaaggttgagaaatttggcaggtctactccagagattgaaggcttaatggctgccataggattaagtcctctaatcatatgtttgctagacactggtgatcaaggacttatgtctgcttttgtggagaggtggcataaggaaactaatagtttccattgccagtttgagaggtggctatcaccttgcatgatgtggcatcgttgctgcatctacctattacagagtggaagctatgcatggggagctgctacactggtgcatatgtatgagaatttgaatgatgcgtctaagagcaccgccaaaaaacttgcaggatatatcactcttttacaatgttggatctatgagcatttttcttctggttcttcttctattgttgttgaggattatgatgagaggaaaccacgtgcctgtcattggaagtctgggaaggaattaccgatgtcgacgtatcgtaagcatttggatagattgacgtctgatgtcgtgtgttggatttcgtatggtgactattgtgcattcacagagtttaaggttatctctttattttctagacatattgttcgctcctctgcgatgctaattggcaagtgtaccgagtcgcacaagtaa

SEQ ID NO: 13430 - DNA, 135 bp, Glycine max
  Peptide Sequence Number=SeqID_105115
atgaagaacaagacgacgactacattggcggtcattggtggcgcgaacgacggcggtggaggcgcgacaatgaagatacttacacaaagagaagacgcaagcagtactgtagcgggagaaggaaggaaacgttaa

SEQ ID NO: 13431 - DNA, 153 bp, Glycine max
  Peptide Sequence Number=SeqID_105116
atgaagaatagggcacctgagacctcaattttagacgcagaacacgagaagctgggcaacagggggagaacgaaccctagggatgaaggagaggatgagtatgattcaacattcagcgtagcacaaagagaacaacacacgacaattgcctaa

SEQ ID NO: 13432 - DNA, 282 bp, Glycine max
  Peptide Sequence Number=SeqID_105117
atgtggtttactctcatcatttgggacgtcaagcacgcatcaaaggaaggcactcgcattgctcttgatgagaagtttatttggattaacatatttgaagactttgcatcgtgggacttggctttggagaaatacgaaggggtgcaaggattgaaagtggggatacttgtgtggttattatatatgattgtgcgaaaattgacaagaggagtgtgcgttttcttcaagagcgtgagggagaaagtgacgagagaggagtatgcatttacaagggtaatttag

SEQ ID NO: 13433 - DNA, 462 bp, Glycine max
  Peptide Sequence Number=SeqID_105118
atggcttatgctaatcacctcggcgaagttgtctccatgaagcaagcgtcgtcgatggaagtttcgacgcgagatttgctcctagagcttcttctcactcgcaaagagagttcagacgcagaccttgctcatgttgatggaggattttcccacactgtcgtagacctggtggtgatggtgggtttgtcttcagaggtggaagggtcaaaggggttgatgtgggagataaggatgttgcgaaactcgtcttctaagtgggccacggcgatctggatggcggagttgactttgttggaggaggcggagacggagacagaggagagggaatgttcaaccactctttctctctctctctttatcgttgttgaagacctcgatgacattgggaagaggagaaaggaagaaggacaacaagaagaagacagcgagccagaggagaggaacgaacacacacatttcaaa

SEQ ID NO: 13434 - DNA, 270 bp, Glycine max
  Peptide Sequence Number=SeqID_105119
atggtcttggggtacttcatgtgtctcccccatgggttgagagacctgtgcctaaccatattagggttgttggctctcaatgagtatgtgagtggagttattgacattctcatcgagagcgtgtgtaacattgggtggtgtacagttaggaggcaagccatatggtgggaaggaatgcttgttctgaaaatacacaaaatgggggccgccgtacttctgaacgcttcgcctccctgccctaccatatccgagactggaagatttacttga

SEQ ID NO: 13435 - DNA, 165 bp, Glycine max
  Peptide Sequence Number=SeqID_105120
atgtcaaaatttctattccttggattatggggtcgagttggggcagaagatggaagtaaccagcttgcaaaagtcaaggtcaagtatggaagtaaccagcttgcaaaagttgggcaaaagatggatcgagtttacatagcttctttggctactaccaacacatga

SEQ ID NO: 13436 - DNA, 996 bp, Glycine max
  Peptide Sequence Number=SeqID_105121
atgaaaaacaagagagaaaagaaaaaggaaaaaagagtggaagaaataagtcaagatgaaagagagaaaataagaggggaagaaagaaggaaaatactaaaagagttaagaaaagaaaagcatgcctcctatagtagtcataactcttgcaagagcctaagtgaagaacttcgtgactattatgaaggaaggcataggtcacatcttagacctcactcccataggagagaaaaggaaagaaagcctcaagaggataacattaacctcccatacttccatgggaaagacaatgtagaggctaacttagattgggaaataaggatagagcaacaacttaaaaggaagtctacttcaaaatcttatgtctctcactcttatctaaagaaagaccaaggtcaaggaatcttaggggtgactccttctaagcccaaagatgataaggggaagacaatagaaaagcaaccccgtaaggctagtatgcaagagaagactagttccatgaatgaaagtgaagaagtaaaaggggaagaatctagtgaagagatctacccccaagaagaaggacaacctttaatagttaaggaggagtgtaaggaggtaagtgtctcctccaagaggttagctaagaaggaaagacattttgaaataaagacaaatattaaagaaattttccctcttagacaacctccacattttgtcctttgtaaaaagacacttgttagcattgccacacctcttaggcttgagtttattcctcaagtaaaggagttgttggatgagggtttggttcgcaagagcttaaatccttgtgctttgttggtgcccaaaataggggttcccatgaactctaagagaataaaggtcattcctgaatggcccactccaccaagtgttgaggaaaaaagcccagagtttcaagaacctcgggatttgaggtcaaatccttttcatgggggagggaatgatgcaatcctatcccgcaaaagcattggatag

SEQ ID NO: 13437 - DNA, 84 bp, Glycine max
  Peptide Sequence Number=SeqID_105122
atggctgaaatgggaaaaatggacgtggaagtcaacttgacggacaagggagtggttgaagggatgatagccatgatctcttag

SEQ ID NO: 13438 - DNA, 1398 bp, Glycine max
  Peptide Sequence Number=SeqID_105123
atgttgaagatggaacttataaaatgggttccctatgttgtggttgttgcttttctagtttttgttaatgggtcatttgccttgtacactcctcctgatagatatctaattgcttgtggctcttctcaaaatgtcacctttcaaggtcgcacttttgttcctgattcacagcattcttcacttgtgatgaaaactgggaattctgttattgccagttccaattctagtagtgcccctcttcctatttaccaatcggctcgggttttcaccgagaaagcttcctataggtttaagattcagcaagaaggtaggcactgggttaggctatatttttcccctattccaaactctgcccacaacttgacttcagcttctttaacagtggttactgatgattttgtactcttgagcaacttcacctttaggaaattcaatggttcttatatgttcaaggagtatgcaatcaatgttacctctgatacattggttgtcaccttcattccttcgaatggttcagtggcctttgtcaatgcaattgaagtcgtgtcaatgccgaatgagttgttttttgatcatgcactggctgttaacccgccagcaacattcagtggactttctgaacttgcctttgaaactgtttatcgcttgaacatggggggtcctttgattactgcccaaaatgacaccctgggtaggacttgggtgaatgataggaaataccttcatgtcaacagctcggtcctaaatgtgtcggtgaatccttcaagcattaagtatccggtggctgttacacctgagactgccccaaattgggtctatgccactgctgaagcaatgggggatgctaatgtaaatgatccaaatttcaacattacttgggtcttcaatgtggatccaaatttctcctatttcatccgggcacacttttgtgatattatgagcaagtcactcaacactttagtgttcaatgtgttcgtaaattctgacatagctcttcaaagctttgacatctcatccataactaatgacttggctgtgccgtactacaaggactttgttgccaattcctcagcagactctagcactttgactgtgagtgttggaccagatactgtggcagacttcccaaatgccactatgaatggattggagataatgaagatcagcaacacgttaaagagcttggatgggctttattcagttgacagtcttcttccaagttcacattctaagaaaaacatggtaggagtaatagttggtttggctgttgtagctcttgctgctgtagcaatggttggtttatgttattgctgcttgatgagacgcaaatcagagtcatccactcaacagggccattcatggctgcctttacccctttatggaaactctctaccatga

SEQ ID NO: 13439 - DNA, 596 bp, Glycine max
  Peptide Sequence Number=SeqID_105124
agaatgctcaagttatggtccttgcagcaacttatcgtccttcagaacttgatgaagcaatacttcagcatcttcctcaagcctttgaaattggagttccagaccaaagggagaggattgaaatattgaaagttgtcttaaagggtgagagggttgaagacaacatagactttggtcatatagctggcttgtgtgagggttacactagtttagatctatttgatctttgcaagaaagctacctattttcctattatagaactactgaatgaagaaaagaaaggaaaacgatctcatgatgtgaatgtggagagagtagctgccaagaacagtgtcataatcacagtagaggatgttgctcaaatcttgttgaatgtggtgcaagtcaccaaagaagatgatacaattcacaactaccaagttgatggtgtccttgggaggacttatagggatgattttgagaacccaacaaagcctggtgtggcaatgcttgttgttagaggagaggacaaacacaagaccacctctttgctttctccaaattgtgcttcttgtgtcttttcacaacaaaacttacataagaatgagcccactaaa

SEQ ID NO: 13440 - DNA, 645 bp, Glycine max
  Peptide Sequence Number=SeqID_105125
atgtctaagtttagtcctttagtcaatggtcatcaagtcatccctctgactaaggacgacatcttcaatgttgggatgataatgatgcaatgtggactgactaaccaatggccaagctacccccctggaatttacatcaaaccaaccaccaccatcaagttcatgtcgaatagagttgctctgaggtggcctccattagacctcaggaagaagaaatgcaaggttcctcctcgtctcgcatccacatccgagtacaacaaggaagacatctccaattatatgtgcatggtcgatgcagttgaacctccactggttgaagccacttcccagcctcaacccctcttggacaatgcacccagaataatcaacacttctagtactcaacgtgagataaccccctcgaccatcgttgctccaactgatgtatctgaggaatgctttcaagaattgttgcgccttcaacaggtcaatctagaagaaactatggaaaaaaggctgcctccctccgttgaacctcctccgccatcaccaattactacctctgcacctgcaaccactacaaatcatgtgcctatgcctccgccttcaccaccaaaatcaccaccatcaaaccctccacctcttgccactgagggttgtctatga

SEQ ID NO: 13441 - DNA, 431 bp, Glycine max
  Peptide Sequence Number=SeqID_105126
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggacaaaaaaggctgcaccggtgcctcagcagaatatgtgaaacaagatatattccgattcctcgctcactgactcgctacgctcggtcgttcgactgcggcgagcggaaatggcttaccaacggagcggaaatttcctggaaatatgccatgaagatacttaacagggaagcgtttccccctggcggctccctcgtgcgcactcctgatcctgcctttcgggttactggagtcattccgctgttatggccgcgtttgtctcattccacgcctgacactcagttccgg

SEQ ID NO: 13442 - DNA, 869 bp, Glycine max
  Peptide Sequence Number=SeqID_105127
tccggtcaaaatcgtatccggacctcagtgagcgcagcagcgttcttagggggtatctttgactacgatgccaagaaagaacgcctcgaagaagtaaacgccgagctggaacagccggacgtctggaacgaacctgaacgcgcgcaggcgctgggcaaagagcgcgcctcgctggaagcggtagttgaaacgctcgaccagatgcagcaggggctggaagatgtgcagggtctgctggagctggcggttgaagccgacgacgaagagaccttcaacgaagccgtggtcgagctggacgcgctggacgtgaagctgggtgaactggagttccgccgcatgttctccggcgaatacgacagcgccgactgctacatggatattcaggccggctccggcggcaccgaagcgcaggactgggccagcatgctgctgcgcatgtatctgcgctgggcggaagccaaaggcttcaaaaccgagatcatcgaagagtccgaaggcgaagtggccggtaccaaatcagccaccatcaaaatcataggtgattacgcttacggctggctgcgtaccgaaaccggcgttcatcgtctggtgcgtaagagcccgttcgactccggcggtcgtcgtcacacctccttcagttcggtatttatttacccggaagtggatgacaacatcgacatcgaaatcaacccggccgacctgcgtatcgacgtctatcgcgcctcgggtgccggtggtcagcacgttaacaaaaccgagtcagcggtgcgtattacccacctgccgaccaacattgtggtgcagtgccagaacgaccgctcgcagcataagaacaaagatcaggccttcaaacagctgcgtgccaagct

SEQ ID NO: 13443 - DNA, 411 bp, Glycine max
  Peptide Sequence Number=SeqID_105128
atggaagaaggatatgttaccaataatccacctttgttcaaaggagtcaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13444 - DNA, 731 bp, Glycine max
  Peptide Sequence Number=SeqID_105129
ttggcccagggcttccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcatgcttacatggttctgttcctgctacagatcggattgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13445 - DNA, 872 bp, Glycine max
  Peptide Sequence Number=SeqID_105130
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagccgtccaggaagttgccagcaatggcttcgcgaggggcaaagctaatgctgtgcacaaacccgtcgaatttgggccagacctggctcaggtcggcaaacatgcgggcaatctgctcgtcgctggccacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13446 - DNA, 447 bp, Glycine max
  Peptide Sequence Number=SeqID_105131
atgaaacagtggaatgccaaatggaatgtcaaatggagtatcaaatggagaccaaacggagaccaaaatagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13447 - DNA, 300 bp, Glycine max
  Peptide Sequence Number=SeqID_105132
atgactagtacccgtcgcttatgtgccgatgcggtcggccttcagcactggggagcaccgtcagtattatcaccatcccctcctctccccagacctctggcaacaaccctacctaacgcacgacctaatcttctagtcttaatcatgatctacaaatggttctctatacctgaagttaagatgatggacaagtgtacagatcatgctccagaagatgtaccagaagctctggacagatcatgtgggacactctacaagttacacatgagggaacaactgatgtcaaaagatctaggataa

SEQ ID NO: 13448 - DNA, 726 bp, Glycine max
  Peptide Sequence Number=SeqID_105133
ctggaaaacgcggtgcgcgggcgtgccgataccggttttggcgtgatgagcgaagaagagctgaaacaggcggtcgctgcggcgcgtaagcgtggcgaaaaagtggtgatgaccaatggcgtgttcgacattctgcacgcgggtcacgtttcgtatctggccaatgcgcgcaagctgggcgatcgtctgatcgtcgccgtcaacagcgatgcctcaaccaaacgtctgaaaggcgaaacccgcccggtgaacccgctggaacagcggatgatcgtgctgggagcgctggaagccgtcgattgggtcgtgtcgtttgaagaagatacgccgcagcggctgattgccgggatcctgccggatctgttggtgaaaggcggtgattacaagccggagcagatcgccggcagtgaagaggtatgggccaacggcggcgaagtgctggtgctcaactttgaagatggctgctcgactaccaatattatcaagaagattcagaaagatagcgacaacgcaataaataacccgattaagcgcatttttcgtacaaagtacgttaagaacttcgattttctggcacgtagtttcgccaggatgcacgcgcaaggccattcggttgatcttcaggctattgtcggcaatatggatgaggaacatcgtgaatggttttgccaacgctatgagctttattgtcgtcaggtgaatagcccggccgagttagagcattaa

SEQ ID NO: 13449 - DNA, 366 bp, Glycine max
  Peptide Sequence Number=SeqID_105134
atgacgggattctaccacgacatcacactccattatgataccaatgagaacggcgttgccccgcttggctgtgaaaggtacacattgattatccggaagatcaatactgctccaacgccatggcctagaacgtttgatgctccgtcaaaccatacggtccatttgtcccgcttcgtctatttgtcctcaaacaagggcatgatgtcctcatccggaactcgggattacatctattccccacatggaaaagggccacggtgtggtcatgacattcagaggatgtggcggagcattgacattgtctacgaacgcttgacacttgtggcatttccttacatggacgcagcagtcacttttccatggtga

SEQ ID NO: 13450 - DNA, 97 bp, Glycine max
  Peptide Sequence Number=SeqID_105135
ggtgcggataaccgtaaggtatctccgcgtgtcatcgggcccgccgcctctggatgacacaagggtgcggatgtcaaagtgtatcaatctcgcacag

SEQ ID NO: 13451 - DNA, 399 bp, Glycine max
  Peptide Sequence Number=SeqID_105136
atgcacacacaaagtttcacaattccacactttcctaaaataggcctaactcacaaaaacagtccccagtggagtcaccaactgtcgcaacctatccttttgcgggcgagcaaggcgaggttcacgggtgcgctttccaaagtaggaaaatgcacggagtcgccaccaacgtttatttgtggaaaacattggaaaaaccgaaggaaaccggtcatgaagaatattccagattcgggagttgcatttacgtttgaggaaggctcgacaaaagcggggctcttgctcctacgtaccctccatcgaagaggaaatcagacctatgtagttctttctaaaggcgaatcaagcgattctttttacttggaaggtggtccttttaaggactggaccttaaaatga

SEQ ID NO: 13452 - DNA, 835 bp, Glycine max
  Peptide Sequence Number=SeqID_105137
ttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtgaagcagcaaaagataccaaaaacaagactcccacaacttgatcttcgtattcagacgaaaatcttgaattcccttgatcacaacttgagctctgataccaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13453 - DNA, 771 bp, Glycine max
  Peptide Sequence Number=SeqID_105138
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacggactcaacgtcctccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13454 - DNA, 493 bp, Glycine max
  Peptide Sequence Number=SeqID_105139
gggcaaaggaagagctagctcccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcatccgctgttatggccgc

SEQ ID NO: 13455 - DNA, 854 bp, Glycine max
  Peptide Sequence Number=SeqID_105140
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgatgttccaactttggcagacataccaataaaaacagctagaacagcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13456 - DNA, 309 bp, Glycine max
  Peptide Sequence Number=SeqID_105141
atgattgaggccatgatgagcataaaggagataatagaggtcaatgcgactgcaatagccgctaccaacaccattgcagaggtggacctgcccccccccccccccatatggcctcaaccaaataaatcatccaaccccagatatggtaggtctggaagggaaaaagttgggaggtacgggcgaccctcatttagtgcgaaaaacaaaaatgtcttccccccatatggcttgcctcccaactataccccccccaatgtggcgtacactcccaatgaaaatgtcaataactccgctcctatactcatttag

SEQ ID NO: 13457 - DNA, 480 bp, Glycine max
  Peptide Sequence Number=SeqID_105142
atgagtatctcatcctccaccgcttcaaccagaatcaaatatccaattgtgagaccacctgcaatcatccaattcagagcaactttccacaatgatcagacattcatagaaatacccccattttaccatgaacaatgggcacccaattacccacacgaagttcagttcaaatacaatggagcaacctacccaatacgagtccaacaacaccgaggcagatatttttttgcagatggactcgcagacgtcagggcagatttaaaaatctacgagtctattatcatgaacttctttgcctacgatgataacaccattttatatctacattttacacctcccctgaatcaacagacatgtggtagacagatacttcattcccgtctacatgcctggacaactaaaataacccaatatatactgggtgctccccaaccactggaaatcccatcacatgcaaggaaatatctgaaacaatggtga

SEQ ID NO: 13458 - DNA, 648 bp, Glycine max
  Peptide Sequence Number=SeqID_105143
atgaattcctcctccatttatattcttgtctttgtccagctttggttgttcagcttcccatgcagagagagtgtgtgcatcccaagtgagcgtgagacacttttgaagtttaagaataatctgaatgatccttcaaataggctttggtcttggaatcataatcataccaactgttgccactggtatggagtcctctgccacaacgtcacttcccatcttcttcagcttcacctcaacacttcacctcctgctttcgatgattgggaagcatttgaagcttatcggagatggagctttggtggagagataagtccttgtttggctgatttaaagcatttgaattacttggacttgagcggcaattatttacttggagaaggtacgtcaattccttctttccttgggacaatgacttccttgactcacctcaacctctcttatactggattccatgggaagattccatctcagattggcaatctctctaagcttcgatatcttgacttgagcttcaattatttagttggagaaggtatgtcaattccttctttcctttgtgcaatgacctcctccttgactcatctcgacctctcttacactggattcagtgggaagattcctcctcagattgggaatctctccaattag

SEQ ID NO: 13459 - DNA, 567 bp, Glycine max
  Peptide Sequence Number=SeqID_105144
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgtgttttcccagtcacgacgttgtaaaacgacggccagtgaattgtaatacgactcactatagggcgaattggagctccaccgcggtggcggccgctctagaactagtggatcccccgggctgcaggaattcgatcgtggcggacagcaccacctctcctactgtagatctatccatcactgaggctgctgccaaagaggatgtttttgatggcactgactatcaaacacaaatgctatgctgtttgcgtgctctcaacatcaagcttatcgataccgtcgacctcgagggggggcccggtaccagcttttgttccctttag

SEQ ID NO: 13460 - DNA, 149 bp, Glycine max
  Peptide Sequence Number=SeqID_105145
ttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtga

SEQ ID NO: 13461 - DNA, 519 bp, Glycine max
  Peptide Sequence Number=SeqID_105146
atgattatgaggagccaagacatttatagtagccaagatgaggctactacttcaccttcctctagtgaaagtgaagaagtaaaaaaggaagaatctagtgaagaaatctacccccaagaagaaggacaacctttaaaagttaaggaggagtgtaaggaggtaagtgtctcctccaagaggttagctaagaaggaaaggcattttgaaataaagacaaatattaacgaaatttcccctcttagacaacctccacattttctcctttgtaaaaagacacttgttagcattgccacacctattgggcttgagtttattcctcaagtaaaacagttgttggatgaggtttgtgatcaaggggttcccatgaaccctaagagaataaaggtcattcctaagtggcccactccaccaagtgttgaggagaaaagcctagagtttcaagaacctcgggatttgaggtcaaatccttttcaagggggagggaatgatgcaatcctaccctgcaagggcattggatag

SEQ ID NO: 13462 - DNA, 414 bp, Glycine max
  Peptide Sequence Number=SeqID_105147
atggatggtgtctttgtgatgcacaatggtaggcgtacttgtccattagaagatttccccatgtcgcctaacaagagcaagattaattgggaggagcttttggctagcatgacaggttcaacaattcgctggttcccaaggttggaggaggtgcctaatgtgttatgtcgatgtggagttttccctaacgtccctttgatgggaacaaagggttgtgtcaacaataaccctatgctagggatcagggctaaaggggaagagacgaacagaaaaaggtaccaaggagctttgtccggcaatagtaacgaactcaagctgagaaaggcagagagggaccaagcaatagcagaaaatgtgacactgagagatgagttgaaggattgttgtgtgtcaaaggaaatcttgaagaagtag

SEQ ID NO: 13463 - DNA, 129 bp, Glycine max
  Peptide Sequence Number=SeqID_105148
atgtggaccaccacgggggaggagtttgccccccagctcgcccaggcgagctcagctcgtccaggcgagcaaggttgcttcctccagaagcaacagccttctggaggaaggatctggaaggccggctag

SEQ ID NO: 13464 - DNA, 670 bp, Glycine max
  Peptide Sequence Number=SeqID_105149
atggtgcgccagcgtctgctgaaccgctttaccagcgaaataacggaagggaatgcgatctaccgcctgacgccgttaggtattggcattaccgactactatattcgccagcgtgaattctccaccctgcgtttgtcgatgcagctgtcgattgtggccggcgaactgaagcgggctgcagattccgcggatgagggcggcgatgaattccactggcatcgcaacgtctttgcgccgctgaaatattcggtggcggaaatcttcgatagtatcgatctgactcaacgcatcatggatgagcagcaacagcaggtgaaagacgatatcgcccagttgctgaacaaagactggcgcgcggcgatttccagctgcgaactgttgctgtccgaaacctccggcactctgcgcgaattgcaagatactctggatgcggcgggcgataagctacaggccaacctgctgcgtatccaggacgccaccatcgcgcgcgacgatctgcattttgtcgaccgtctggtgttcgacctgcaaagcaagctcgatcgtattgtcagctggggtcaacaggctatcgacctgtggatcggttacgatcgtcacgtacataaatttatccgtaccgccatcgatatggataaaaccgcgtttcgcccagcgtttgcgtcagtcg

SEQ ID NO: 13465 - DNA, 588 bp, Glycine max
  Peptide Sequence Number=SeqID_105150
atggtaccgggccccccctcgaggtggacggtatcgataagcttgatcgccccaggtctccaggtcggagaagttgacgccatcgttggccaccttgtcgcgatcgaagttctcgaccagcgaattgccgcccttctggatgatgttggcgcggaacaggcgggcggtaccgttgagcttgcgcttgtgcaatcgaattcctgcagcccgggggatccactatttctagagcggccgccaccgcggtggagctccaattccccctatagtgagtcgtattacaattcagtggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcaccctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtatctgaacaggagggacagctga

SEQ ID NO: 13466 - DNA, 312 bp, Glycine max
  Peptide Sequence Number=SeqID_105151
atgtcattcggtatatgcatgagtggagtcaaaccttgggtcaagggtccagctatgcattccttgagccacagtcgttggtggtttcaaaggatacatgtgatgaatgccaacaatatcttgaaagatggattaaggaatctaactgagaggaaacctgatatgcatatcaaagccgcaattaatagtgtaatgaccaaattaaagacgagttcgtctcctaaaagtaaggcagcaacacctaagtggattgaagttacgtggtttggtgatgagacaccgttggacaaggaaaacatcacaacaatttga

SEQ ID NO: 13467 - DNA, 222 bp, Glycine max
  Peptide Sequence Number=SeqID_105152
atgaaggctgacatggaggccatgaaagagaaaatggccacaatgatggaggccatgttgagcatgaagaagataatggaggtcaatgtggttgtagttaccgctaccagcgccgttgctgagatggacccgactcccccatctggcctcaaccaaataaatcatccaacctcggatatggtaaatcaaggaggcaaagagttgggaagtgtcataccctaa

SEQ ID NO: 13468 - DNA, 723 bp, Glycine max
  Peptide Sequence Number=SeqID_105153
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttttctctgtggttgcaaacacactttcacatattgggaatgtgaagaagccttggcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13469 - DNA, 396 bp, Glycine max
  Peptide Sequence Number=SeqID_105154
cggaatgacaccggtaaaccgaaaggcaggaacaggagagcgcacgagggagccgccagggggaaacgcctgcctatggaaaaacggcgagttatgcctagtgcctgatgtcgtcatccctctgaagttcaaggatcttcctgcagcccgggggaatccactagttctaagcggccgccattccgcggtggcagctccgaattcgccgagcgtagatcagcccgcaccgatcgcccttcgcgcacagttggcgattcatcctgaatgcagcgaatggcacgacagcgtttccctgatggaaagcggcgcagtcgtctggcacccgctttacacttgccgcgctgatgttccggtcggtatgcttgtgtgccgaattgacgcggataaccaattccc

SEQ ID NO: 13470 - DNA, 487 bp, Glycine max
  Peptide Sequence Number=SeqID_105155
accagctagtgctgagagactagtggtccatgttgatcctgctactggcaaggccgacagtggacgtgacgtacgagaactagaaggaggtccctactacgtagaaggacttgatttgggaggatattcagaatttgaaatcctagaggcttctgaaagtaggacgaaaaaggagttacttcagactgttggcgagagatggaggcagtttaaattagacctcatgaggaaatgggcccttgcaaccgatcaagacggtgtggacgacactatctgtgagaaatacaacataagcaaggaaaatgggcccagttttgccagactcacagagacccttcttgggaggatgtgcgaaaaaaggcataggcgatccataaacagaacactgccccttacgttttgtctcgtggggaagaagttggaggatgctgcacagtcaggaagcgttgatggtgtcatcgaccctccatcccccgtcaaacgccac

SEQ ID NO: 13471 - DNA, 340 bp, Glycine max
  Peptide Sequence Number=SeqID_105156
aacctatgttccaatcaagagatccttcttaattggtgccgctgtgattgcatcttttggctaccgtaaagagcatgatggctctagggtaaaaaagggtgctccacccattaatgaagaaggaaacataccattaggaggggattcctctcttcttcaaaagattttggacaggttcgatggtcttcaaacctttgttggcgaaaggtttgatgctttggagttacaagtagacatgcgattcgatgagatggattcaaggatcaccaaggtcgaaaaagatgtctcttacatccgcacaagctttgatctaccaccactgccgccaccatcatcttag

SEQ ID NO: 13472 - DNA, 285 bp, Glycine max
  misc_feature (108)..(108): n is a, c, g, or t
  Peptide Sequence Number=SeqID_105157
atgacggtgaaacctcggacacatgcagctcccggagacggtcacagcttgtctgtaacgggatgccgggagcagacaagcccgtcagggcgcgtcagcgggtgttgncggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 13473 - DNA, 1117 bp, Glycine max
  Peptide Sequence Number=SeqID_105158
atgactacgactgataaaaaatatattgtcgcgctcgatcagggcacaaccagctcacgtgccgtggtgctcgatcatgacgccaacatcgtcgccgtctcacagcgcgaattcacccagatctatccgaaagccggctgggttgaacacgatccgatggacatctgggcctcacagagctccacgctggtggaagtgctggcgcacgctgatatccgttctgaccagatcgccgccatcggtatcaccaaccagcgtgaaaccgcaattgtctgggacaaagagaccggcaaaccgatttacaacgccatcgtctggcaggatccgcgtaccgccgactactgtaacaagctgaagaaagagggtctggaagagtatatccagcacaccaccggtctggtgattaacccgtacttctccggcaccaaggtgaaatggattctcgaccacgtggaaggcgcacgcgagcgggcgaaacgcggcgaactgctgttcggtaccgtcgacacctggctggtgtggaaaatgacccagggccgcgtgcacatcaccgatcacaccaacgcatcgcgtaccatgatgtacaacatccacaagctggagtgggatgcgcgcatgctggagattctggatattccgcgcgaaatgctgccggaagtgaaaggatcgtccgaaatctacggccagaccaacattggtggtaagggcggcacgcgtattcctatcgccggtatcgccggtgaccagcaggctgcgctgtatggccagctgtgtgtgcagcctggcatggcgaaaaacacctacggcaccggctgctttatgctgatgaacaccggtaccgaagcggttacttcgacgcacggtctgctgaccaccatcgcctgcggtccacgcggcgaggtgaactacgcgctggaaggtgccgtgttcatcggtggtgcgtccattcagtggctgcgcgatgagatgaagctgatcagcgatgcgggcgactccgaatacttcgcgatgaaagtcaaagacaccaatggcgtgtacatggtgccggcctttaccggtctcggcgcaccgtactgggacccgtatgcgcgcggcgcaatcttcggcctgacccgag

SEQ ID NO: 13474 - DNA, 105 bp, Glycine max
  Peptide Sequence Number=SeqID_105159
atgtcgcggaaatttacggattacctaatgatgggtgttaagtacctcgaggaggtcaagcgaaggttgcatgccaccagacaatggtccccggacgaaattagg

SEQ ID NO: 13475 - DNA, 611 bp, Glycine max
  Peptide Sequence Number=SeqID_105160
cccagcttggagcgaacgactacaccgaactgagatactacagcgtgagctatgagaaagcgccacgcttcccgaagggagaaaggcggacagggggaaacgctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccgtctcggtttcggaagggcgtgcacattcccttgctctcacgtccaaagggaaattgtgggtctggggctctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13476 - DNA, 166 bp, Glycine max
  Peptide Sequence Number=SeqID_105161
tgctttaaaaggtcttgatgatgctccacaacctaaatcaaaggctcctactaggtggattgtcgtcaagtattttaacaatcctagaccattggagccagagagattaaaggcaatgtggatccaatgggaacagtattatcttcgagttagagttcatagctag

SEQ ID NO: 13477 - DNA, 378 bp, Glycine max
  Peptide Sequence Number=SeqID_105162
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggaactatggtgcccacttctccaatgtgtcagttggtgtttatggtccagttcaattagtagcactaaagaataacactgaggtagtcaaggatatcaccaataatacattgaattataaggtgggattacatggtgagattgtgaaactatacaatccagaaaacaataaaggatggaacacaaatggtcttccaacttatagagtatttgtttggtataaggtataa

SEQ ID NO: 13478 - DNA, 234 bp, Glycine max
  Peptide Sequence Number=SeqID_105163
atgttttgtcttcgcgtgccatcggacttgattgtctttggagagcaaagaagcaaaaatggtgcggttaaccatggtttgtcttcgcgtgccatcgaacttgattgtctctggatggaaaagaaggttgcggatgacaatgttttgtcttcgcaggccatcggacttgattgtctctggataggaaaatgggtgcggatgaccatttttgtctcctcgtggcctcggacttga

SEQ ID NO: 13479 - DNA, 264 bp, Glycine max
  Peptide Sequence Number=SeqID_105164
atggtagttgcgctcagctcaccatttgggctgagcacgcatccaagcgcaacttcagtgcgttgtgcgcttagcgcgacagaagaatctggcagtgcatcaatatcaaggccgcgcgctaagcgcgagatcagtgcgctaagcgcagcgattggtacgaagaaaaggcagatttttgtagagaattctagagcacaccacagtgcctatttcaggaaaagagctctggaggcagcaagaggagcagcttttgcagagacctaa

SEQ ID NO: 13480 - DNA, 171 bp, Glycine max
  Peptide Sequence Number=SeqID_105165
atggagatgcagcggaagacaaaggagaagagactaggtagcttccttgagaagctttctttagaaaacttccttgagaagctagagcttagctacacacactctctcataactaagctcacctccttgagaagcttgcttaagaagattcctaaaaaagttagagcttag

SEQ ID NO: 13481 - DNA, 1875 bp, Glycine max
  Peptide Sequence Number=SeqID_105166
atgataacgtggaaagacctatacacggtcctgaccgcagtggtccctctctacgtggcgatgatcctggcgtacggctcggtccggtggtggaagatcttctcaccggaccagtgctccggcataaaccgcttcgtggcgatcttcgccgtgccgctcctctccttccacttcatctccaccaacaacccctacgccatgaacttccgcttcatcgccgccgacaccctccagaagatcatcatgctcttcgcccttgccatctggaccaacctcaccaaaaccggttccctagagtggatgattaccatcttctccctctcaacccttcccaataccttagtcatgggaattccactcctaatcgccatgtacggcgactactccggctcgctcatggttcaggtcgtggtccttcagtgcatcatatggtacaccttgttgctcttcttattcgaataccgcgccgcgaaaatcctaatcatggaacagttccctgaaaccgctgcctccatcgtgtcgtttaaagtcgactccgacgtcgtttcgctcgacgggagggacttcttggagaccgacgccgaagtcggtgacgatgggaagcttcatgtcaccgttagaaagtcgaacgcctcgcgtaggtcgtttatgatgacgccgaggccttctaatctcactggggcggagatttacagcctcagctcgtctcgtaacccaacaccacgtggctcaaactttaaccatgcggatttcttctccatgatggggtaccagcctcgccactccaatttcacggccaatgatttgttctcctcgcgtggacccactccgaggccttctaatttcgaagaaccctcaatgcctcaggcggtgacggtagcttctcctcggttcgggttctacccgtcccaaaccgtgccagcttcgtacccgccgcccaacccggatttttcctccgctactaaaaacttgaagaatcaaagtcagaatcagaatccgaaccagagccagagccagaattcgcaggctccggcgaagggtgcccacgatgcgaaggagctccacatgtttgtgtggagctccagtgcctccccgatgtcggagaatgccggactcaacgtctttagcagcacagacctcggaacctccgaacaacctgaccagggtgctaaagagattaggatgttggtggctgataataatgcacacttacgaaatggtgaagccaacaacaaaggtggtttggaggcagtacttggtgtggaagacttcaagtttccggtgaatggcgaagaacaagttggggaagaaaaagaagggctcaacaatgggcttaacaagttgggctcaagctccacggtggagctccaaccaaaagccaccgtagccggcgaggcttccgccggaaaacacatgcctccggcaaatgtcatgactcgtctcatactcatcatggtgtggagaaagcttatccgcaatcccaacacatactctagcctaattggtgtagtatggtccctcgttgcattcagtaataatcaaagtgatcttgtgttcaccttgttgggaataatgccacccgacacgtggggcccgggctataaactaggtcactttgcggaggacaacggttctggtctgtttatggcacttcaacccaagataatagcatgtgggaactctgtggctacatttgccatggccattagattcctcactggtccagcagttatggctgcagcttccatagcagttggcctccgtggcaccctcctacacgttgctattgttcaggctgcacttcctcaaggaattgttccgtttgtgtttgctaaggagtacaatgtccatccagccattcttagtacagcgtaa

SEQ ID NO: 13482 - DNA, 240 bp, Glycine max
  Peptide Sequence Number=SeqID_105167
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcaccacatacaccagttaacccttcgtccattatgcatgaacgcaagttaggctcagagacaattaatcgaacacgaagcgtgcactaa

SEQ ID NO: 13483 - DNA, 501 bp, Glycine max
  Peptide Sequence Number=SeqID_105168
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggttgcggatgatcttaccgatgtcggcgatgtggagtccttgcagttcgacttggctacagttgaagctgccacagacagattctcagatgagaacaagattggccaaggtggatttggggtggtttataagggtgtcttccctaacggacaggagatagctgtgaagaggttgtcagtaacctccttgcagggtgctgtagagttcaggaatgaagctgctcttgtggccaagcttcaacatagaaatttatgtagtggtaccgagctcgaattcgtaatcatggtcatagctgtttcctgtgtgaaattgttatccgctcacaattccacacaacatacgagccggaagcataaagtgtaa

SEQ ID NO: 13484 - DNA, 477 bp, Glycine max
  Peptide Sequence Number=SeqID_105169
atgattagtgttttcgttcatgcatcctccactcatgagtttggagtcatgcgtagtgattgcttagtgcaattctccattctcaatgctatttatgagccccatgaattatgtgttcgttcatgcttcctcacatacaagtttggagccatgcgtagtgattgcttagtgcaattctccattctctaccctttttcgaagcctcatgaattgcgtttttgttcatgcgtccttgtcgcaacctacccttcggcgggagggcgacgcgagactcacgggatgcgtgttccacgaaaggaatacgcgcggagtcgccaccaacgtttatttgaggaaaacgtcggaaaaaccggaaaagacgagatctacgaactttttagtgaaaggttccggagttgtatttacgcacggggaagggtgtttccctttgctcctacgtattcctcaatttgggatgagaaaatcagacctacgtag

SEQ ID NO: 13485 - DNA, 237 bp, Glycine max
  Peptide Sequence Number=SeqID_105170
atggttgattctcgtgatagcaagcgtcagtgtaagtgtggaagcaatgccttccaaggttattttgatgatgccaaagaatcaagagttaagcaaagtttcaagcaaagattcaagaatcaagtttcaagattcaagattcaagaatcaagtttcaagaatcaagaagaatcaagatcaagattcaagactcaagattcaagaatcaagagaagactcaatcaagataagtattaa

SEQ ID NO: 13486 - DNA, 249 bp, Glycine max
  Peptide Sequence Number=SeqID_105171
atgaagtatatgcaaattgtaatgatcatgatgaaggtctatgggagaacactcacatgtaattgtgttgtatcaaagatcatgggaacaccgccaaggtcccctccgcactcagatggtcattcagagcctacgtctaggaagagtaaacaatcaacacggctaagaaggttgactttaagaactttgcatcagcaaagaccaacagttaacgtcgaccctacaattgggagaggatcaggcccataa

SEQ ID NO: 13487 - DNA, 165 bp, Glycine max
  Peptide Sequence Number=SeqID_105172
atgaggttcatgagtaggcttaggagacagttattgatgacgtatgtgttgacacccagggttttccaggaacgtccagagttgaagttgtcctctcatggaaggaagatacaaaaacttggaaggcctgctccagagattgaaggcatagtggctgtgacatga

SEQ ID NO: 13488 - DNA, 601 bp, Glycine max
  Peptide Sequence Number=SeqID_105173
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgaggtttatgaattgtccaatccgtatcagttttacaaaaggaaaaaacgagaattacacctgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13489 - DNA, 600 bp, Glycine max
  Peptide Sequence Number=SeqID_105174
atggagagaagtatgatagatgctgccagtggtggagcccttggagacatgactcctgctgaagccagaaatttaattgagaagatggcctccaactcccagcagtttagtgccagaaatgatgccatagtcattagaggagtgcatgaggtagctacaaacccatctgcatcatctgaaactaagaagcttgaaggcaaactggatgcattggttaacttggtaacccagctggccttgaatcagaaatctgtacctgtcgcaagggtttgtggtttgtgctcctctgctgaccaccatacagacctttgcccttccatgcagcaacctggagcaattgagcagcctgaagcttatgttgcaaatatttacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaaca

SEQ ID NO: 13490 - DNA, 493 bp, Glycine max
  Peptide Sequence Number=SeqID_105175
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccgg

SEQ ID NO: 13491 - DNA, 507 bp, Glycine max
  Peptide Sequence Number=SeqID_105176
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggacacctgggtctggagagctgactctagtggaatcttctctaccaaatctgcttaccaagtgctaaaagttgagtag

SEQ ID NO: 13492 - DNA, 279 bp, Glycine max
  Peptide Sequence Number=SeqID_105177
atgagaaagcgccacgcttcccgaagggagaaaggcggacaggtatccggtaagcggcagggtcggaacaggagagcgcacgagggagcttccagggggaaacgcctggggggcggagcctatggaaaaaagaaggggacctctagagtcgacctgcaggcatgccttgctggccgtccgttttacaacgtgcgttatcccctgactgggaaaaccctggcgttacccaacttaacgccttgcagcactgataccgccctttcgccgcagctggcgtaa

SEQ ID NO: 13493 - DNA, 117 bp, Glycine max
  Peptide Sequence Number=SeqID_105178
atgccatatccacaacacaacaaactcaacaacaacaacggcgacatagctagagaaatgctagaagtgaagagtgaaaacccacaaaagggtaccgagctcgaattcgtaatcatg

SEQ ID NO: 13494 - DNA, 612 bp, Glycine max
  Peptide Sequence Number=SeqID_105179
atgaagcgcctggagaagatcctgcgcgaagagttcgtgggcatcggtaccaacgtccagtcgctggaaatgggcccgccggtgggacgtccgatccagtaccgggtcagtggcaaggacatcgaccaggtgcgcaagcatgcaatcgagcttgccaccctgctcgacgccaacgagcacatcggcgagatgatctacgactggaacgagcccggtaaggtgctgcgcgtggagatcgcccaggacaaggcgcgccagttggggctgtcgtccgaggacgtggccaacgtgatgaacagcatcgtcagcggcacgccgatcacccaggtcaacgacaacatctacctgatcaacgtggtcgcccgtgccgaagacagcgagcgtggctcgcccgatactctgcagaacctgcagatcctcacccccaacggcacctcgatcccgctgctggccttcgccaccgtgcgctacgagctggaacagcccctggtatggcgccgcgaccgcaagccaaccattaccatcaaggcctcggtcaacggcgacatccagcccaccgacctggtggcccagctcaagcctgaaatcgaccagttcatcgacaagctgccg

SEQ ID NO: 13495 - DNA, 577 bp, Glycine max
  Peptide Sequence Number=SeqID_105180
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccttatgatggatataatggaaggcaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13496 - DNA, 345 bp, Glycine max
  Peptide Sequence Number=SeqID_105181
atgcgtctaccggggaaggagagtctgctgatgaaatctcccataaccataaatgagattttggatgttagcatttcgtttctaaatgaccatttagaggaaacactgggttcgacaaaaatagaagaaatccactcaaagtgtatcaatcttgcacaggacttcccttgggaatgggttcttttggggagtttttcggcttttgattatttttttgccttttccttttctgttttggttttgcgtgaggcgaacaagtcaccgacgcacaggattttggttggtaatcaaagggagaagaccactttaggtcatggtttccttttctttcttttgttcatttga

SEQ ID NO: 13497 - DNA, 561 bp, Glycine max
  Peptide Sequence Number=SeqID_105182
ttaggccaccacttcaagaactctgtagcaccgcctacatacctcgctctgctaatcctgttaccagtggctgctgccagtggcgataagtcgtgtcttaccggcgccacgcttcccgaagggagaaaggcggatcctctaggtcgacctgcggtgcaagcttggcactggccgtcgttttacaagcgtcaggtgacttgggaaaccctggtctttatagcccaagcgttaatcgccacctctgacttgagcagtcgatcccccttttgtgccatgctgggggcggataatagcgaaaaacgcccagcaccgatcgccctttcccaacaggttgcgcagcctgaatttggcgaatggcgccttgatgcgatacaatctgctctgagccgcatagttaagccagccccgacaccgagcgcaacacccgtgacgcgccctaggaagcggaagagcttgtctgctccatcggcaaaccgccttacccgcagcgttggccgattccgggagcttaatgcagctggcacgacaggtttcaccgcacctggaaacgcgcggcagtga

SEQ ID NO: 13498 - DNA, 447 bp, Glycine max
  Peptide Sequence Number=SeqID_105183
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagctccccattgtgacccttctatacagtcgataggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 13499 - DNA, 360 bp, Glycine max
  Peptide Sequence Number=SeqID_105184
atggatcacgaggacttgttcaggaaactgtctttggtgggaaacttggctctgagtatttcgagtcactggcgcaaaagattttggctggtaatcaagaaggggaccgcttcatgtgtcgcaagctgttggatttcccctgtgtcgcaacctatccttcggcgggacggcgacgcaagggctcacgggtgcgtcttccatgggaggaaaatgtgcggagtcgccaccaatgtttattcgaggaaaatgtcggaaaaaccagaaaggtgtggtctacgaactttaactgaaaaaggttcgggagttgtttttacgcacggggaaggtattagcaccccacgcgtccgtcacaagggatga

SEQ ID NO: 13500 - DNA, 1119 bp, Glycine max
  Peptide Sequence Number=SeqID_105185
atgagtcatgattcatctagtgttaatggtgagggtactagtcataaggaccctctatctagaatattagatgagttgagttctctcaagttatggaaagaaaaactagaaagaaaagaaaaaggaaaagagagggtaaacataagtcaagatgagagggaacaaataagggaagaagaaagagggaaaatactaaaagagttaagaaaagaaaaacatgcctcctatagtagtcatgactcctgcaagagcctaagtgaagaacttagtgactattataaaggaaggcatagggcacatcctagacctcactcccataggagagaaaaggaaagaaagcctcaagtggctaacattaacctcccatacttccatgggaaggacaatgtagaggcttatttagattgggaaatgaaggttgaacaactctttgttttccatcatacaagtgaggaaaggaaggttcctttggctacccttagcttccaaggggaaagaaggactcatggggatcctccaacagagtattggaatgacttgaaaagtgcccattatcgtaacctacccttcgacaagcgagcgcacggaaaaatagaagcacgtcttctcatgaagaaaacgcgtggagtcaccaccaacgtttattcgaggaaaatgttagaaaaaccaaaaagaggagttgcccttgctcttacgtatcctcaggaagtccattttggggcaggggaagcttgcccaggcaagctgatgcttagccctaaagaaatgagctcgcctaggcaagctggttgcttaggtatgaagctatttcatggctcaggtgagccagatgctagcctgggcgagctagggtctagaaagatccaaaaaagaccattttgcccccttccttgcgatcttgctattcgaaaccggacaccagagaaaatagaggaagtgaaatcgaaaaagcataaagacattgacattgaaatatcgaaagcatctagcaaaagacatcgcagtcttacaaaagacattgaagtcatgttgtcataccctaatttcgtccggggaccatccgttgttgggatgcgaccctcgttttcccacttagaggtatttgtcacccatcgttag

SEQ ID NO: 13501 - DNA, 285 bp, Glycine max
  Peptide Sequence Number=SeqID_105186
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtacagggttaggtggaggcggaatgggggttggttgtggagttggggggtaccgagctcgaattcgtaatcatggtcatagctgtttcctgtgtgaaattgttatccgctcacaattccacacaacatacgagccggaagcataa

SEQ ID NO: 13502 - DNA, 135 bp, Glycine max
  misc_feature (123)..(123): n is a, c, g, or t
  Peptide Sequence Number=SeqID_105187
atggattttggcttagcgcgcttctctcgcttagcggatgagttgaagcggttgcttgatgacctggagcggtgcgccactgagtgtcgcgcttggcgaatgctcgctaagccagtagattgngttagtgagaag

SEQ ID NO: 13503 - DNA, 465 bp, Glycine max
  Peptide Sequence Number=SeqID_105188
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctaaaactctcgagacaatagcacttgctcaaacctaa

SEQ ID NO: 13504 - DNA, 294 bp, Glycine max
  Peptide Sequence Number=SeqID_105189
gtcgactctagaggatccccatgtagagccagggcttcgcttctttttcatgccctactccagaccagttcagggcagaggttgcatggcccggagattggcccgaggcctaagcaggagaggcacccccagaagctcccggcgatggagaagaagcccacgaggatgaggagatggccgatttgcttgacttcttgggagggagtggagatacgtgactgggagatccccagattcatgttttctttcatatttcttttgtcatttttattctatgttattgttttgacttga

SEQ ID NO: 13505 - DNA, 118 bp, Glycine max
  Peptide Sequence Number=SeqID_105190
atggcttctccactagcctcgcctcctcctcctcctctttcacctcctcctcctcctcctcttccttccgacgcatcagcttcgtcgtctggcgtgaagcagacacggaaagcctcac

SEQ ID NO: 13506 - DNA, 846 bp, Glycine max
  Peptide Sequence Number=SeqID_105191
atggccagaggaggaaccggtccgatgagttcgatgagggaggccatcgcccatttgctatgtataccggggcaggatttttcctggactgctgccgggagacgggtgcggatcatgggcaccaacatgaccaccctgactcagatctggatgactttgctactcaacaacatccagcccagcgatcataattctgacctccccctgccgaagtgtcagttggtgtacgccatcctgacacggatgagcattcacgtggctcagttaatcgctgatgccatctatctatttgcaggtatggcgcctaccaggcaccctcttgacccggataagtccaacagggccctgggatttcccgccttgatcacaggactctgccagtcgttcggagtccccgtcacacccagcaaggtgattcggccacccatcacccgagcttttattgagaagtattgcacacagagacaggcccagggggatgcgccgcaggccgcagacgccccgccacctcatcaggctggcccagctggatcgtttgatacagagcagtatttgcggcatttggttcgccagcaggtggccaaccaccgggcgcatgtacagacccatgattgtctttaccagttgagcctcagcctgcagagccagggttttacttctttcccgtgccctactccggaccaattcagggcagaggtcgcatggcctggagattggcctgagacccggacaggagaggcgccaacagaggcaccagcagaggctcctgacgaggcagatgaggcccgcgaggacgaggagatgaccgatttacttgatttcttaggagggagcggggccgcatga

SEQ ID NO: 13507 - DNA, 270 bp, Glycine max
  Peptide Sequence Number=SeqID_105192
atgacaggggaatggagaaggaagagagagaggagacgccacttcaaggagaagatgagtctagaagaagctcaccaccataggaggccatggataagagcttggaggaagaaggagatgaatgaagggagaggaagagaagagcacctatggttcagcccactaatccaagatcaagtccaagattcaccactaagtgtgcttaggtgtcatgaggcatataaagcatgtaggacatgcacaaagtgtgactatatgatgtggcaatag

SEQ ID NO: 13508 - DNA, 222 bp, Glycine max
  Peptide Sequence Number=SeqID_105193
atgcagcatgtgactagccagcaggcggctaatcacagggggcagagtcaggaccctagtcctttcccttggcctacccccgagcagttcagggccacagttgcctggcccagagatgaggccgattttgagacactggcaggacccgcagggacccctggggacgacgaaggatctcagaaggacgacaatatgaccgacgtgctggatttcttcacttga

SEQ ID NO: 13509 - DNA, 375 bp, Glycine max
  Peptide Sequence Number=SeqID_105194
atggagatgtccaatcttgcattgaaactcaagtcacttaagttagaacttggtgaagacctgctcatgcacttcgttttgatctcgcttcctacacactttgggcaattcaaaaaaaggaagaagactaagggtgttacggaagggacttctcagcaaaagaaacaaaagaaggatgacgaatttacctgttacttctgtaagaagtcgggacacatgaagaaagagtgtcccaagtatgtcgcatggcgtgtgaagaaagatacttggtggggttgcctgtggagccgactaccaagtgatgatgaaaggttcatctttgcgggtggtggcaagaaggttgcagtagaagctattggaacttttagattataa

SEQ ID NO: 13510 - DNA, 576 bp, Glycine max
  Peptide Sequence Number=SeqID_105195
atgacgttgctacttagcaacattctgcccagtgaccgcaatgccgatatccccctacagaagtatcggttgggatcgtgcccacaagacacccagtggacccagaggagcccaatagggccctgggatttccagctctggttacgggcctctgtcagtcctacagggtgcccgttccccccagcaaggtcacaccatcatgacataggtaaggatcgtacccacaagacacccagtggacccggaggagcccaacagggccctggggtttccagctttggttacgggcctctctgtcagtcctacagggtgcccgttccccccagcaagcgcccacaagacacccagtggacccggaggagcccaacagggccctgggatttccagctctggttatgggcctctgtcaatcctacagggtgctcattccccccagcaagggatcacgcgcgcaagacactcagtggacccggagaagtccaacagggtcttggagttgccagctctgattacgggcctctgtcagttctacggggtgcctgtcgcccccagcaaggtcatcaggccccctactaa

SEQ ID NO: 13511 - DNA, 405 bp, Glycine max
  Peptide Sequence Number=SeqID_105196
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgaattcgatgtgcggcaagtccttatgcggggtcagttgaaacatggatgctagagtggcaagcgcatcgaccatttgattctcctctcgaggaatgtgatgaagaagatatcatcgaaataccctatcaattttctgatgtaagcctggtagggtatcaacatgtgatccctggtctcccattcttctttcaattggtggatcacaaaggctga

SEQ ID NO: 13512 - DNA, 219 bp, Glycine max
  Peptide Sequence Number=SeqID_105197
atgcctttctcgaggacacagacggacaaatcagcgtttctttggcgacacatttgcttgagtcgtatcgctgccgataagcatgcgagaccggcaccgatgatgacgacatcgtactcgatggagtccctgtcggaggatgtggtgcagaagctccgagaagttggaaccttgatctgctcgttgattgcctatttagagtcatctacacagttctga

SEQ ID NO: 13513 - DNA, 350 bp, Glycine max
  Peptide Sequence Number=SeqID_105198
atggggacaaggggttgcatcagttacaatcccgttcttgctataaggcaacttggctaccccatgagaggggcaccactagaggaagagctcgcgcctgtcatttcacaaggtttaaataagaccaacatggagacacttcagaagttccgcaaggacaaagaactcaagggcagtaacaataggcccatcggtggctaccgtaagtggttgaaagcccacatgcaaggtttggattggctcccgagtttgagaaccgctaaaagggaggaagttgaggaaccggaggaagacgaagaggtgcaggcccttagggcagtactcgagcaaacccaaacagtcaaagaaag

SEQ ID NO: 13514 - DNA, 519 bp, Glycine max
  Peptide Sequence Number=SeqID_105199
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactattcgtcttgagttcaacccg

SEQ ID NO: 13515 - DNA, 534 bp, Glycine max
  Peptide Sequence Number=SeqID_105200
atggcatctcaacgggttctgatggtagtggatatgcaaaacggcgtattcgagacgccgcgtgtcgatcgcgaacgctgcgtagcgcaaatcaatcgcctgattcacgccgccgatagcgttattttcattcagcacgctgaagcaggcggcctggaagaaggaagcgaaggattcgcgctgctgcctgaactggcgcaacccgccggggcgcgctacgtcaccaaaacggcctgtgatgcgttttataaaaccgatcttgaacaggtgctgcgcgagaacggaactcacgcttttgttatctgcggctgcgcgaccgattattgcgtcgataccaccatcaaaaacggcgccagccgcggctacgccatcaccattgccgaagatgcccataccaccgccaatcgcaccgccgccgaggctaaaacgctgatcgctcactataacgaggtgtggcggactttcaccctccccggtaatccattacgcgtgaaacccgtagaaacaattcttgccgaatggcagacgaactaa

SEQ ID NO: 13516 - DNA, 216 bp, Glycine max
  Peptide Sequence Number=SeqID_105201
atgcctatgacacatttgatcgaagatgcgagaagagcaatgcaaggattgtctgttgcacaccctctctttatgtacggctggtctctcacatttttcatcatgaaagtagacccgtcaatcccctacaaggtcaccgcatgtgtgcctagaaaaggaaagcaaattgggagcagctcttggctggtatggagaattataagcaattgggcttga

SEQ ID NO: 13517 - DNA, 336 bp, Glycine max
  Peptide Sequence Number=SeqID_105202
atggagcagtggtggttcgttgttgactgtagtaacctcttgatattgcacatggccaccatattcataaccataataattattaatggtagtactagaagaagccacaataatggactatggtggatgatggaactgatggcagtcgcttgcaagtctactatggtcattctgaccaaaaagggaaagccaaaaactgatatttggattgctgcattttcctcccacatctcacttaatttgtttgccctagtttacaaaacactgagtggtaacagattgttcatactatatcaccatgatgcattcatagcatatctaaggaaggatcaatga

SEQ ID NO: 13518 - DNA, 195 bp, Glycine max
  Peptide Sequence Number=SeqID_105203
atgtccatccaatcaactttagatgatattgataaattaaatatggatgaagatgaggatgattatgtgccacaaccatcaaccaacaccatggaagatgtgaatccaaatgaaagtaatatgggtgatgagtctcattcttttgatgaagaaggatcacctaaagttgacccaacattaacttcttggatataa

SEQ ID NO: 13519 - DNA, 117 bp, Glycine max
  Peptide Sequence Number=SeqID_105204
atgtccttctcgttaagaggaaagtggtggtatgtggcgtgggcatcgattccaccctcaaccagatcttgcattattgaaaggaaagaagatatggtgattggtgaattgatttaa

SEQ ID NO: 13520 - DNA, 651 bp, Glycine max
  Peptide Sequence Number=SeqID_105205
gccatgctggaacgctacatcgcgccgttgctggccgagggcgcggacaccctggtgctcggctgcacccattatccgctggtgcaggcatcgatcgaagatgtggtccggaggcatacggatgcgcaggtagcgctgatcgacaccggcgacgccgtcgctcgccagctgacgcggctgctggaagcctcgaagctgctgtgcgaagccggcggccagccggccagccttaccggcttcaccactgccagcggagaggcgctacgggcgtccttcaatactctgctggggcaggatccggcccgagacagagaagtaagacagtggtggctgtagctcagttggtagagtccaggattgtgattcctgttgtcgtgggtcgcaggcttctgccgctggcccatccaaatccgcagaggaggggggctctcgtctttcctgcatgcctgcagacgaacgacgccttcctgctccgttgggcaggggatagccacaaggagcgggggatgacaaagcgagcttgggctacaggatgggttttcttgatttgcggcgtagctttccaacctgcgtttgcagagcagggatgccctgacggattcaccccgaatgctgcaggaacgccaggacagcagtgcatcccgattggag

SEQ ID NO: 13521 - DNA, 432 bp, Glycine max
  Peptide Sequence Number=SeqID_105206
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggctgggagaggtcccacagcctggatccatctcatggactcccaccatagacctactatcctcttacaattgaaaaagagatgccccacctcctcctgctcttggccacagagaagacaagcagtgtcctggatgatcacacttcttcttatgagattagccctagtggagagcctatctttaagaagccttcaagtgaagactgcagatcttgggggaattttcatcttccaaattaatgttgaggttctcacatcagaggctggagtagaggggttcatcaatagtctgtaa

SEQ ID NO: 13522 - DNA, 306 bp, Glycine max
  Peptide Sequence Number=SeqID_105207
atggagcgagatgagaaaagatttgaatactgtttctgctattcttcagaagaaaacaatgtggaagaggataatgagggtggaattggtgttgtggatgcgctagagtttttgcaaatttcaatcggtgaaatcaaaagaaaaatgaaaaagaagaagattgcaatttacgggagtcgatttgatgaagaaatgagtgagataggaaggtttggaggtttgggaatggaggaacgttgcaaggaggaaggggctgcacaggggtttctagaaaatgtgatatttatagagcaggacgcgtgttaa

SEQ ID NO: 13523 - DNA, 225 bp, Glycine max
  Peptide Sequence Number=SeqID_105208
atgaagtcaggtgacatgcgggggtaccgtatggttatccgcacctttcatcaaccaggggcaaacaaacccattgacacgcagagactaatgtcatcttctactctttctgtcatcctgacccgtgaagtcaggagattaagggaagagaaaatgcaaactcagttttatactggttcggccacacccttgtgcctacgtccagtccccaagcaacccgcttga

SEQ ID NO: 13524 - DNA, 381 bp, Glycine max
  Peptide Sequence Number=SeqID_105209
atgccgggaagcagacaagcccgtcagggcgcgtcagcgggtgttggcggttgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgacagggggagcagaaagctga

SEQ ID NO: 13525 - DNA, 138 bp, Glycine max
  Peptide Sequence Number=SeqID_105210
atgtggatggaccgatttgctcttaccttgaacgggagtcaagaacttccccgattgctagccaaggccaaagcaatggcgaacacctactctgcccccgaggagatccacaaacttctcgactattatcttgactag

SEQ ID NO: 13526 - DNA, 426 bp, Glycine max
  Peptide Sequence Number=SeqID_105211
atgcctgcaggtcgactcctagaggatccccgccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 13527 - DNA, 615 bp, Glycine max
  Peptide Sequence Number=SeqID_105212
atgccttatgtggaagccgcagaggagtcattagaaaccgctttccagtcttttgaggtggtaagcatttcctccgtggactccttctctgggcaagcttgcctgtccgatgcagcagtaatgatggcccgagttatgttggggaccggttacgaacccggaatgggtttaggaaaagacaacggcggcataactagcctaataaatgccaaaggaaatcatgggaagtatggtttaggttataagcccactcgggcagatataaagagaagcatcgcgagaagaaagagtggtggtcaaagctcgcggttgagacaagaaagtgaaggaagcccgccctgccacataagtagaagctttataagcgcgggtctgggagacgaaggtcaagtggtcgcgatatacgaagatgatgttccgagtacattggatttggtacgaccatgccctcctgatttccagctaggaaattggcgagtggaggaacgccccggcatttacgcaacgagcataatatccgatgacgagtccctggaggtactaatacctgggacccgcttatcaactccgagcaagaaacgaatcaaacggaagatgaagggaacgaggatgtag

SEQ ID NO: 13528 - DNA, 291 bp, Glycine max
  Peptide Sequence Number=SeqID_105213
atgacattaacctataaaaataggcgtatcacgaggccctttcgtctcgcgcgtttcggtgatgacggtgaaaacctctggacacatgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 13529 - DNA, 246 bp, Glycine max
  Peptide Sequence Number=SeqID_105214
atgtcggcttggcggttccaacaaaagatttccctccaagtcacctactatttcataaatgctcccacaaatgaaagtttgagatcatcacaggcaccaatcacacggtacaaaaattgcaaggaccccagctcgcccaggctagcatctggctcgcttgggccatggaattacctcttggctaagcagccagctcgcttaggcaagctcattacttcagggctaaggttcagctcgcctgggtga

SEQ ID NO: 13530 - DNA, 378 bp, Glycine max
  Peptide Sequence Number=SeqID_105215
ttggggattgtcgctcgtgataaggtcgacgtgacatacgagacttggaagcaagtccctgctgctcagaaggatttgatatgggaggatattcaggatgaatttgatatccctaaagcatctgacgccgacaaggatagtgtggatgacattgtttgtgaaaaatacaacattagcaaggagaaatgggcacagttttgtcaaacccacagagacccctcgtgggaggatgtgcggaaaaagacacaggccatccagaagcaaaacactaccccccacatgttgtctcgtgggggttatgaatatttagaacagaagctgatggctgagaaaaaaaaagaaaaaactggaggaagctactccatctggaagcactaa

SEQ ID NO: 13531 - DNA, 372 bp, Glycine max
  Peptide Sequence Number=SeqID_105216
atgaccccaacgcaagggtacttcaaggagttcgcaaggcatgggatgcggtgccaaggatggacaaagagcttaggggaaatagtaatgggatcatcggcggctatcctcccaaagctaagggctacgagagaggaagaggccgaagctccgaaagagaatgaagaggtacaagccctaaaggcggagcttgaaagagcctgggcagtcagagagaagttcaagtcagcggctatcttaaacgagactgaagggaatatgtggaccatcatcgatgagtacaaagagaagctaaacctagcggcgactcacgagcaaaggctagaggatgagtacaccaagatatcagcggaaagggaagcaagggaaagg

SEQ ID NO: 13532 - DNA, 249 bp, Glycine max
  Peptide Sequence Number=SeqID_105217
aataaaataatctgccctcttcaagtccaagcccaattctggattcaagcccaagcccaattcattaaaatagctgaaaggaaagatattgagctggtagaggaggaagaaacacagattggtgttgatcgttctagtgcaacctctaataaatttgagatttataaggaggaagcagggaatgcagcacagaagcataaagcaaagagggtggagaatgtcaatgctgatgcaaaagccttttggtga

SEQ ID NO: 13533 - DNA, 150 bp, Glycine max
  Peptide Sequence Number=SeqID_105218
tttagggctaaggtcgcatggcacggagattggcccgaggcccaggcaggggaggcgcctgcaggatcccccgccgatgcagaggaagcccgtatggatgaggagatgacggacttgctcgatttcttgggaggaagcggagccaagtga

SEQ ID NO: 13534 - DNA, 156 bp, Glycine max
  Peptide Sequence Number=SeqID_105219
atggcagaaatcaaccaagggacggatgcaagtggggatggggtcacgaccgaccaatcgttgccccttcccggcgctaaacaagcagagaacgtcgctgcaaggcagcccagtatcctttggggttgcagtttcttttactattgtctgttttaa

SEQ ID NO: 13535 - DNA, 106 bp, Glycine max
  Peptide Sequence Number=SeqID_105220
atgggtcgatcccggagatgcggatgctcaaacttggagagggccaagcatgggtcagattcggtttctctgcagtgtggcgattgggctcgacggtgctgtgtcg

SEQ ID NO: 13536 - DNA, 279 bp, Glycine max
  Peptide Sequence Number=SeqID_105221
atgacttccgcatctcaaggtttcagtttgcattcatttctgacaacgatagctgagaaattggatgattccaactatctacactggcgacaacacgtcgaaccagtcattaaatcgcataagctgcagagcaagtatgtcagagatctacttcataaaactcaaatggctgaggcacactctatctctactcctatggttacaaactgcaaactgtccaaacatggagctgatctatttcatgatccaactctctataggtcagtagtgggtgcctag

SEQ ID NO: 13537 - DNA, 460 bp, Glycine max
  Peptide Sequence Number=SeqID_105222
gggggcggagcctatggaaaaacgccagcaacgcggcctttttacggttctggccttttgctggccttttgctcacatgttctttctgcgttatcccctgattctgtggataaccgtattaccgcctttgagtgagctgataccgctcgccgcagccgaacgaccgagcgcagcgagtcaccacccagtgtggcgccaccaagtcattcacacacttgaactggtgacactctttagagtgacaccatcaagtggagctaagttgactgatgccaccaatttcctacgtgacagatccagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13538 - DNA, 600 bp, Glycine max
  Peptide Sequence Number=SeqID_105223
atgaccatgattacgaattcgagctcggtaccccgtagccctctgaaggtgaggacgtcccgtcctctgaaggtgagggcgtgcaaccctctgaaagcgaggacgtgtagtcctctgtcggttagagcgtgtagccctctgaaggtgaggatgtgtagtcctctgaaggtgagggtgcgtggccctctaaaggtgaggacctacagtcctcttaaggtgagagcctgcaaccttctgaaggcgaggacgtgtagtcctctgaaggtaagaccatgtagccctctcaaagtgaggacgtgtagtcctctgaaggttagagtgcgtagccctctaaaggtgaggacatgtagtcctctgaaggtaagagcgtgtagccctctgacggtgaggacgtgtaatactttgaaggtgagggcgtgtacccctctgaaggttaggatgtgtagtcctctgaagttgagagtgcgtagccctcaaaaggtgaggacgtgcagtcctttaaaggtgatagtgcgtagcgctcagatggtgaggacgtgtagtcctctaaaggtgagggcgtgcaacaatcctaaggcggcaacgtgtagtcctctgaag

SEQ ID NO: 13539 - DNA, 213 bp, Glycine max
  Peptide Sequence Number=SeqID_105224
atggaattcagatacatcgagattgatctcggggtattcaaggattatcacaaaggagctatatcgaaaaggtacttaaaaggtttggcatgcaggaatataaatccgaggatactccagttgctaagggagacaagtttagtctcaaacagtgcccaaaaggaaatttggaaattcaggaaatacagaagattccctatgcatcagttgtag

SEQ ID NO: 13540 - DNA, 159 bp, Glycine max
  Peptide Sequence Number=SeqID_105225
atggcctctggtaatcgattaccaaggggtgtaatcgattacaaggcctggaaatggagtcaggatgttgaggtggcctttggtaatcgattaccaatgctgtgtaatcgattacacagagtaatagggcactggtttccatgttctgaagctgtgtaa

SEQ ID NO: 13541 - DNA, 243 bp, Glycine max
  Peptide Sequence Number=SeqID_105226
atgaaggattcattgatcaacattgaaaatcttgggagtctcttcaactctcccttctttgatacctctgttaaaattgcttatgggcttggccttatcttaggtgaaccctctaccttctttatcccttttcctcctcttcctacagagtcagttgatgaaccttctacagttcaggaggatgttccacatgttcgcatcccaactcccattgtcgttgttgttgaacgcaccctcatctag

SEQ ID NO: 13542 - DNA, 282 bp, Glycine max
  Peptide Sequence Number=SeqID_105227
atgaagtttttttatgctttttgcaaacttgccaaagttattcaaaatgagaaaggttttaatattgtttcaattagaagtgatcatggagaaaattctttggaagatgaagatgtaggttttcaggataaggacactgcacttgaaggtgaatccaaagttaaagagcttgaacaaagcaaagaaatcattgccacaccttctattggtgaaatatcaaaggaagtatctactcgctctagactcaagattttatgcaataacatgacttttgtttcttag

SEQ ID NO: 13543 - DNA, 369 bp, Glycine max
  Peptide Sequence Number=SeqID_105228
atggatggagttgtcttcgctctttccactcccaaacttaatgttgctaataaagccagtcaacttcaacaatgggttcaggccaataagactacttgggcgaccactgagtatagaggcttgccgagtccaagtagtacatatgtcccccaagctatgaagggttatgagcgctccgacgggggtaggattctttcaccagaggttcgttcaataggggaaagttataaggacggtccctctcaccatcacaatggctcagaagccactaatggtcaagtttctggtgttcccgttggtggcgccacccttgttggtggtgtcattgctactaaaagagggctcttccctaactctgacatatgttaa

SEQ ID NO: 13544 - DNA, 426 bp, Glycine max
  Peptide Sequence Number=SeqID_105229
atgagaaagcgccacgcttcccgaagggagaaaggcggacaggtatccggtaagcggcagggtcggaacaggagagcgcacgagggagcttccagggggaaacgcctggaattgaagaatgtgtcagggggggagcctctagagtcgaaaaacctgcaggcatgcaacttggcatggccgtcgttttacaacgttcgtgactggaaccttgctggcgttacgctcacatttcccgaacgaccgattgcgcagcctgagcatggcgagatggcgcctggatgcggtattttctccaattacgcatctgtgcggtatttcacaccgcaatggtgcactctcagtacaatctgctctgtgccgcattcagttaatgccagcggcaccgacaggtttcccgaccggaacagcgccgctgacgcgccctga

SEQ ID NO: 13545 - DNA, 402 bp, Glycine max
  Peptide Sequence Number=SeqID_105230
atggctccacctaaagaaatttcgaccctcatttaccacagtggtcacattgtagacgatccagttcaaggatcgacataccaatgtacgaccccaatatttttttacgccagtcgttctattacttttacacaattcattcgaaaaattaacaatcgtcttcctactcgagcaactgaacaagttgctcaattgttatttcgtgtccctatttcaattcatctcagtcaaacacgtctaaagaatttgagaagacatggtacgcataaacggagaagatgcactggccacatcttggggatattcgtgcgaataagccaagtgcagctgaatggcttgatcaattacccaaacaaaaatgggtacaatgctttgatgaggggaaacgttggggacatatga

SEQ ID NO: 13546 - DNA, 363 bp, Glycine max
  Peptide Sequence Number=SeqID_105231
atgaccaaacttggtctctgcttgtcatctgctctggatgacaaaagggtgcggataaccgtaaggtatctccgcgtatcatgggtgcagaatgaccaaacttggtctctgcttgtcatcggacacctgtgtctggatgacaaaagggtgcggataaccgtaagaatgaccaaacttggtctctgcttgtcatctgctctggatgacaaaaaggtgcggataaccgtaagaatgaccaaacttggtctctgcttgtcatctgctctggatgacaaaagggtgcggataaccgtaaggtatctccgcgtatcatgggtgcagaatgaccaaacttggtctctgcttgtcatctgctctggatga

SEQ ID NO: 13547 - DNA, 150 bp, Glycine max
  Peptide Sequence Number=SeqID_105232
atgacgaaagacaacgattgtacctcaaagccttacactagggcaacgaaaggcaccatgcaaaaaccatctcgtgcatgtagaaggcagtccggcagagttggtgcagctagtgctctgtcttcagacattcggtatttagtggaataa

SEQ ID NO: 13548 - DNA, 246 bp, Glycine max
  Peptide Sequence Number=SeqID_105233
atgaccactcttacacagatatgggtgatgttgctacttggcaacattctgcccaacgaccacaatactgatcttctccccctacggaaggatcgcgcccgcaagacacctagtggacttgaagaagtccaacagggtcctagggtttccaactctgattataggcctctggatcgcgcccgcaagacacccagtggactcggagaagtccaacagggccctagtgttggatcaaggggcccctag

SEQ ID NO: 13549 - DNA, 342 bp, Glycine max
  Peptide Sequence Number=SeqID_105234
atgggtattttagaaatcaagatattatattttcaaagctttaaattaagcataaattcaaaaagaaagggggagaaagagatgagtgattgtcatcatcaaaaagggggagattatggaagcaatgacttccaagattattttgataatgccaaagaatcaagagttaagcaagttccaaagaatcaggagtcaaaaagcttcaagaatcaagtttcaaagaatcaagattcaagaataatcaactctcgagattcaatcaagtttcaagaatcaagattcaagaacaatcaagatcaagattcaagaaccaagagaagacttaatcaagataagtactaa

SEQ ID NO: 13550 - DNA, 306 bp, Glycine max
  Peptide Sequence Number=SeqID_105235
atgtttatacggataaccactcgggtatctccgcccgtcagcgtgactcaaatgttcgagtatgacagatcttgtgagcgtacggaagatgacgtaaatctccgcgtgtcaacgggcttgtcggccgcgattgacgaagggcgcagaagacgatgcttgtcggccgcgattgacgaagggcacagaagacgacgtcagtctctgcgtgctatcaggcttttcgtcttacagacagcaaaaaagaatgtttatacggataaccactctggtattccgcccgtcagcgtgactcaaatgtcagtatga

SEQ ID NO: 13551 - DNA, 447 bp, Glycine max
  Peptide Sequence Number=SeqID_105236
atgcataaggcattgcgatcaaatgctccactcccatatccccatctgatcaccttgtttctacaatattttaatgtccctcttgactctgagccctttgtcaaagtcaagaaatcattctctatcggtgcgaatgtagtctcctcttttggataccgcaaagagagggatgggtcttggatgaagaaagacgctccagtacaggccgcagaagaccactctccatcaccacctcctcagagagatgattcttcatctcttatgcataacatacttgacaggttggatggactccacactttcgtcggagagcgctttgactcgttggatagtcgtattgatgccatggatgcacgatttgcagggatggacacatgtatcacaaaacttgaggaggatgctagttatgttcgtcagtgctttgaccttccaccaccatcctcatag

SEQ ID NO: 13552 - DNA, 228 bp, Glycine max
  Peptide Sequence Number=SeqID_105237
atgacggtgaaaacctctgacacatgcagctccgggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 13553 - DNA, 246 bp, Glycine max
  Peptide Sequence Number=SeqID_105238
atgccatggagagatgcttatgcgatgcatgatatgaatgcatttacggacatgagagcccggaaaattatctcttcttacttttgcattcggtggtgcagtgccccatatgcgcaacagggggatgtacatagcatggcaatatcctcagataatcataccacaaaggcgtacatgacattcaggttatatgcatggcagtgtttaaaaggcacgcagtgtgttcgcttcgtgctcctattttag

SEQ ID NO: 13554 - DNA, 279 bp, Glycine max
  Peptide Sequence Number=SeqID_105239
aacgggaccaagtggtttaggaagccggaccggaagacctatagccgaggatactctctaagtgaaagactccacttttttaggatgcaatcctaccccgcaagggcattggatagaagactccaagtagattgggccaaagatccaagggaaggccctagggatctcatgagccttagggtagatttcaagcccatggaccaacttctcaaggaagttttctcaaagaagcttttcaaggaagttttctcaagaaagcttctcaaggaagctacctag

SEQ ID NO: 13555 - DNA, 345 bp, Glycine max
  Peptide Sequence Number=SeqID_105240
gctggggagaggaaatgttcccattttttaggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttccccggactgtggaacaaaggagtatcccgaacctacaccgaggtattgacggcgattctcaaatatcgcagaactagaacagaaatgggatacgatgagataggaatgcaatag

SEQ ID NO: 13556 - DNA, 207 bp, Glycine max
  Peptide Sequence Number=SeqID_105241
atgttctattttcttgtatgcaaggaagatctactgcaggatatagaagcagtagcaactccagaagaagaacctcgatcttccgaggcatcttctagttttcctattgcagggcattctcatatagaacctattgaagacccaatcatggctgaagagccaagaagagtaaccctggaggattattcaagttctactgtgccataa

SEQ ID NO: 13557 - DNA, 315 bp, Glycine max
  Peptide Sequence Number=SeqID_105242
atgcacgaacagctcttggaaatcaattcgtggggctccggactcgatggtggaggatgcatgaatggaaatcaattcatggggctccgaataagatttgatggtggaggatgcacgaacagcactagaaaatcaattcgtggggctccgaactcgatggcaatcaattcgtggggctccggactcgatggtggaggatgcatgaatggcaatcaattcatggggctccgaataagatttgatggtggaggatgcacgaacagcgctaggcaatcaattcgtggggctccggactcgatggttaaggatgcatga

SEQ ID NO: 13558 - DNA, 622 bp, Glycine max
  misc_feature (4)..(4): n is a, c, g, or t
  misc_feature (48)..(48): n is a, c, g, or t
  Peptide Sequence Number=SeqID_105243
gaancggaagagcgcccaatacgcaaaccgcctctccccgcgcgttgnccgattcattaatgcagctggcacgacaggtttcccgactggaaagcgggcagtgagcgcaacgcaattaatctatgaccatgattacgaattcgagctcggtacccattatgagattgccagttacgggacattagcgacgctggctgaacaattaggttaccgtaaagcagcgaagcttctgaaagaaaccctggaagaagaaaaggccaccgacatcaaactgactgatctggccattaataacgacattttcatgaatcgtattgaacattatcatgactggttacgtgacgcccacgcaatggaaaagcaagccgaatctatgcttgaatccatggccagccgtatagataattatcctgaactacgcgctcgtattgaacaacatcttagtgaaaccaaaaaccagattgttcaactggaaactattcttgatcgtaatgacatttcacgttcagtcattaaagattccatgagtaaaatggctgcgcttgggcagtcaatcggtggtatattcccttctgatgaaatagtcaaaggctctattagcggatatgtggggatcctctag

SEQ ID NO: 13559 - DNA, 171 bp, Glycine max
  Peptide Sequence Number=SeqID_105244
atggttaggtctcctcaggaacaggtgcaggagatggctcaggtatctgatctgtggaagtcccctcctcctaagccatgtgtgcttctgcatcaaaataaaagggctcaagaggggagagctcatcctccccctatgctgctcggaaagcgcaccagatcgtcaacctaa

SEQ ID NO: 13560 - DNA, 231 bp, Glycine max
  Peptide Sequence Number=SeqID_105245
atggcagtggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctctgaaatttgaacccactaatccaagatcaattctaagattctccactaagtgtacttag

SEQ ID NO: 13561 - DNA, 276 bp, Glycine max
  Peptide Sequence Number=SeqID_105246
cacttggttcgccagcaggcagccaacaaccgggggcaggtacagatacatgagtgtctctaccgcttcagccttagtcagcaggggcagggtttcgctccttttgcgtgccctactctagagcagtttagggttgaggtcgcatggcccggagattggcccgaggcccaggcaggggaggcgcctgcaggatcccccggcgatgtagaggaggcccgcatggatgaggagataacagatttgctcagtttcttgggagggagcagagccacatga

SEQ ID NO: 13562 - DNA, 545 bp, Glycine max
  Peptide Sequence Number=SeqID_105247
tggtcatgttggtgcgcatgatccgcactcgtctcttgcagcggcacgggtgaaatcttgccccggtatgcatagtagttgtgtgatagcctccctctctggttgtgctcgcacagttggccctcctccaatatcagggggtggcccaggaaccgtgtggatgtcgagcacactgaaaatgaggacacgtagccctctaaaggtgagggcgtgcagccctctcaaggcgaggaggtgcagtcctctggaggtgagggcgttcagccctctgctggtgaggacgtgtagtcctttcaaggtgaggacgtgtagccctctcaaggcgaggacatgtagtcctctggaggtgagggcgtgtagccctctcaaggcgaggacatgtagtcctctagaggtgagggcgtgcagccctctgatggtgaggacgtgtagtcctctcaaggtgagggcgtgtagccctctcaaggcgaggacatgtagtcctctggaggtgagggcgtgcagccctctgatggtgaggacgtgtagtcctctcaacagtgagg

SEQ ID NO: 13563 - DNA, 1182 bp, Glycine max
  Peptide Sequence Number=SeqID_105248
atgttgcgcttagtgcgggtgagggtcagaggtcatcttgtgaagtctgacgaagacgccctcaacacattcttgaagacccttgtgatcattgaggaaggggaaacactatctgcttattccaggttcgcactcctgaggcctgatcctcaggaatgggcagccaagctttgtgctgatgctgatggcttgccattgaagatcctcaaaaagaacctaactgccatttctcaaacttggagtgtgccttctttctcaaacttggtccctacctcatacacatcagatatcactctggatagggccaagttgatttatggaataattcagaggatggacatgaatgtgggctacttaatttctcatcagatctttatgatcacccagcacgactcctctaggcttgggtttccatccttaatcactgctttacgtaaagctagaggagtcacttctgattctaggacgctagagagtctcggccccgccattaatttggcatatgtgaagaagaattgttggaatcttgatgatctaatagtgactttcagagggcctaggaaggccaaggggaagaaatctgagactctcccatcttctgaggttccctctaccatattagttttttccacatcagcaccagcttcttctaccccagctacctctactccatcaccagttcatctaccagttttagctcattcttcttctggaccatcaaatttttcttttacaccaaagatgctacatgccacaatgcagagcctacaccaagggcaggtcattattatgcagagcttccagagcttgggcctgccatctatcatgagtgtggatgagtttctttctaaggtggcttggctaggagtccagccttctccttttggagggggtgggacctctgcaactcaagagcttgagcccatagaggaacatgcaccagcagtggaggatgagctcactcctcctgagcccttttcatttacgtctgattcagttgtggctcaagaggaagtaccttcaccagagcttattccagagccatcccctacacctatttctgaggataccctgccatctgcaccagcattggagcaagagcaacccatttcacaggctccaccagctgctctagtgttggatcttaatgagcatgcagacgatcacccacaggaggattga

SEQ ID NO: 13564 - DNA, 291 bp, Glycine max
  Peptide Sequence Number=SeqID_105249
atgcagagcattcagggcttgctccccgttatgagcatggaggagtttgatgctcaggtggactggctaggagaccagtcctcttcttctggagggggtggagcctctgcagctcaggagcctgtgactgaggagccaccagcaccagcagtagcagaggaggagactactcttgaggagacccaaccatctacaccagttgcagagccagagcagcctatccatgattcatcaacaactccaacactggatttgaatgaagaccaaccacaggaggagaaggacgtttaa

SEQ ID NO: 13565 - DNA, 219 bp, Glycine max
  Peptide Sequence Number=SeqID_105250
atggccatagaagaccagcaaatcagtttcgatatgtttcatgaagagaaagctttgcctgaccaaaatgtttatttgaaggtgaatgtgatggagaaaaagagactagagaagaaggatagcaggatgatgcgtcaagctaatgacgttaaaagagcgattactaggaggcaacccagctattctttccctttagggccctttaggggcaatgcctga

SEQ ID NO: 13566 - DNA, 267 bp, Glycine max
  Peptide Sequence Number=SeqID_105251
atgtcagaattcataagcaattatcctcctcaaattttagccagcccgcatcaattagactttgcaccttatgcttcaaggtcatacaatgctcaatggaatgccccgggactcctccatgataagcacatgttgcattcaagttgtatccttggaaaaatggaggttggggaaccttggttggggttatggctaccattgaattatcgagtagatatgggagcaagctttgtggctgattgggtgcttggtaatgggaagggctga

SEQ ID NO: 13567 - DNA, 490 bp, Glycine max
  Peptide Sequence Number=SeqID_105252
atgtcgaattcttatgactcctcaagtatcaaagtcctgaaagggcttgatgcggtacgcaaacgcccgggtatgtacatcggcgatacggatgacggcaccggtctgcatcacatggtattcgaggtcgtggataacgccatcgacgaagcgctcgccggccactgtagtgatatcgtggtcaccatccatgccgacaactctgtctccgtacaggatgacggccgtggtattccgaccggtatccacccggaagagggcgtctctgctgccgaagtgatcatgaccgtactgcatgccggcggtaagtttgatgacaactcttataaagtttccggtggtctgcacggcgtcggcgtatcggtggtgaacgccctgtcgcagaagctggaactgaccattcgtcgcgacggcaaagtgcatcagcaaacctacgtgcacggtgtgccgcaggcgccgctggcggtaaccggcgataccgacgctaccg

SEQ ID NO: 13568 - DNA, 335 bp, Glycine max
  Peptide Sequence Number=SeqID_105253
ctgtccctcctgttcagctactgacggggtggtgcgtaacggcaaaagcaccgccggacatcagcgctggcaagtgtagcggtcacgctgcgcggcgcgtcccctttgccattcagggtgcgcaactgttgggaagggcgatcggtgcgggccttttcgctattacgccagctggcgaaagggggatgtgctgcaaggcgattaagttgggtaacgccagggttttcccagtcacgacgttgaattcgatgtggtgtcacttgcctgtaatcccagctactcaggaggctgaggcaagaaaatcacttgcacctaagaggcaaaggttgcagtga

SEQ ID NO: 13569 - DNA, 627 bp, Glycine max
  Peptide Sequence Number=SeqID_105254
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcttctggcatcttgtattcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 13570 - DNA, 827 bp, Glycine max
  Peptide Sequence Number=SeqID_105255
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgaaattcatgacaaaatgagcatgatagagatccctgctaatgtacttcaaattctcttggaagaagattgtccgccactgcctatagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13571 - DNA, 313 bp, Glycine max
  Peptide Sequence Number=SeqID_105256
atgacaccggtaaaccgaaaggcaggaacaggagagcgcacgagggagccgccagggggaaacgcctggggggcggagcctatggaaaaacggctttgccgcggccctctcacttccctgttaagtatcttcggcagcgtttccaggaaaaaatcctggcccgatatcgtaacttccgctccgcagtacgccgagcttgcgcagcctgacatggtttcgaatggaaagcgggcagccctgagcgcaagcgcaattaacgcggcggcgtttaggcaccccaggctttacacttgcagcgctatgcttccggctg

SEQ ID NO: 13572 - DNA, 561 bp, Glycine max
  Peptide Sequence Number=SeqID_105257
atggtgaaagttggaacctcttacgtgccgatcaacgtctcattttcgccaaaagttggcccagggcttcccggtatcaacagggacaccaggatttatctgttgagtattgctggaagtttttgtcgggaattcctgtattgtgttcatcagttgattgtttcttggatcaagcttatcgataccgtgcgcctcggggatgctccgacagcttacttgattctagtgtatgatggtgttatttcgagtgctccagtggctaatcatggtttctatcagctgttcctcctcctggggtgcctaagacgctgcgctaactcaccattcattgccgttccgcgcttacatgcgccgctttcacagtcggcgaaacctgtcgtgccattcgctgcattcaatgaatcgtgcgcaactgttgcgcgaagggcgatcgagtgcgggcctcttcgcggtgtcccagtcacgacagtgcttcatgtggcagaaaaaaaggctgcaccggtgcgtcagcatgaatatgtgaatacggactcactattccgggcgaattcctcgctctga

SEQ ID NO: 13573 - DNA, 887 bp, Glycine max
  Peptide Sequence Number=SeqID_105258
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtcgatgcgttctttgcctccaaaagttcccggctcagcaaagtttctgctggaacttcgagtcgatgcagtctattggcagagtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13574 - DNA, 450 bp, Glycine max
  Peptide Sequence Number=SeqID_105259
atgaccatgattacgccaagctcgaaattaaccctcactaaagggaacaaaagctggcaaagaacgcatcgaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13575 - DNA, 338 bp, Glycine max
  Peptide Sequence Number=SeqID_105260
gctgtcgtcccttgtgacggacgtgtggggtgctaataccttccccgcgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccaaaggtcatctcgctaagcacactgcgccgtctcgttaagcgcaaccctgcgctaagcacaattccttctctgtctggaccttcatgtgaattgggcccagtgggtcagcccgctaagcccaaatccctctcgg

SEQ ID NO: 13576 - DNA, 740 bp, Glycine max
  Peptide Sequence Number=SeqID_105261
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagctgctttgaatccaaaagtggaggttgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13577 - DNA, 375 bp, Glycine max
  Peptide Sequence Number=SeqID_105262
atggtcaagaagggatctgaaaatgtggtagcagaccaactatccagattagtcaatgaagaggttactttaaaggaggctggaataaaagatgaatttcctgatgaatctttgtttttgattgcagagacaccatggtttgctgacctggccaatttcaaggcagctggtgcaaataatctccttagaagatgtgtgacaagtgaggaagccaagggtatattgtggcactatcataattcaccatgtggagggcattatggtggagacaaaacagcggctaaggtaatgagtagattttggtggctgttgattttgtgtctaaatgggtggaagctgtggccactccaaaaaatgatgctaaggttgtggtaa

SEQ ID NO: 13578 - DNA, 174 bp, Glycine max
  Peptide Sequence Number=SeqID_105263
atggccgaccagcaggcgaccaagtccaaagccaaagacgttaaagaagtgctactaggaggcaacctagaattggctacgaagaagctccccgcgaagtggtctaggaagggcaccattgaagcggattccagtgtggccccacaagccgacacaagctttgacaaacattga

SEQ ID NO: 13579 - DNA, 282 bp, Glycine max
  Peptide Sequence Number=SeqID_105264
atgaacgaaaacgcaattcatggggctccgaaaaagggtagagaatggagaattccactaagcaatcactacgcatggctccaaacttatgggtggaagatgcatggacgaaaacgcaattcatgggggtctgaaaaaggatgcatgaacgaaaacgcaattcatggggctccgaaaaagggtagagaatggagaattgcactaagcaatcactacgcatggctccaaactcgtggatggaggatgcatgaacgaaaatgcaattcatgggtctccgaataa

SEQ ID NO: 13580 - DNA, 402 bp, Glycine max
  Peptide Sequence Number=SeqID_105265
atgattcaatatcattcctatgttctttccgcagcacctgatgtgtggaattacaatacttcttcatcggattcagttttgataaagaaaatcattcaaataagggactttattatctccaaagagctaagtacggaagaggccaacaagaggattcaatcttggagcaccaatgaacaattgcttgttggcaaagcctatgaatacattagaggtgttaagcctactgttagttggaaatctctccaagtttgggctcacattcgtgatttggctcttttctgtaggcgtttcacttctttacagtgcattactgactctttaatttggggcagatccaaatcaggtgttcaaggaaaattacgttgtttggctatagcaattacagtctactacatctga

SEQ ID NO: 13581 - DNA, 602 bp, Glycine max
  Peptide Sequence Number=SeqID_105266
atgaggggagcgccaacggaagggagtctctcacctttccttgtgaaagatttagacgcgcaaggtctcaaggttatacaaagaatccacaaggcgtggaggagtccgttgaggaaagacaaggagcttaggggcatccgtaatggcgtcatcggaggttatcatggatggctaagaattcacacgcgagggaggaacttcgaagctccgaaggaagatgaagaagtccgagctctaaaattagagttagggaaggcaagactcgccaaggagaagttcaagtcagctgctacacatatccggaaggagtgcaccgagttacaagaggaaaacgcggccactgcaaaagcccttgaacaagaaaccaaaagggcccgcaaggaggaacatggccgagagaaattccgaggagcattgtggggtagcaacaatgagctcaagctccgaagagaggagagagatcggtcacgggtgcatggcatgatcttaaaagaagagttagttgcctgcgcgaggtccaaaagaagtttggctcaacacttggaagccacggagcaaagcatgctagctatcatagggcaatacaaggaagaattgaacca

SEQ ID NO: 13582 - DNA, 146 bp, Glycine max
  Peptide Sequence Number=SeqID_105267
atggccaccagcatgcatgccacgccacagcatgggttacgtcatcaatatgggcagcggaatacccatgtatgtggttacgccagtccctctggcggaacagccatgatccatgtggttccgccaattcctctggcgaaataccc

SEQ ID NO: 13583 - DNA, 740 bp, Glycine max
  Peptide Sequence Number=SeqID_105268
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcaacaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13584 - DNA, 168 bp, Glycine max
  Peptide Sequence Number=SeqID_105269
atgtccccagtggagtcgccaactgttgcaacctacccttcgacgggagggcgacatgagggctcacgggtgcgtcttccatgggaggaaaatgcacgtagtcgtcaccaacgtttattcgaggaaaacgtcagaaaaaccgaaaaaggtgtggtctacgaactttaa

SEQ ID NO: 13585 - DNA, 453 bp, Glycine max
  Peptide Sequence Number=SeqID_105270
atgactttgttgttcccggaggaacaaaaggtgcagaagactgtgtcagcccctgcatgctatcaagcgttctgtcttacagatagcaaaagaatgggtgcgaataaccaaatgaccaaacttggtctctgcttgtcatcgggcccgccgcctctggatgacaaaaaggtgcgaataaccataagaatgaccaaacttggtctctgcttgtcatcgggcccgccgcctctggatgacaaaggtgccgataaccgtaaggtatctccgcgtatcatgggtatctccgcgtatcatgggtgcagaatgaccaaacttggtctctgcttgtcatcgggcccgccgcctctggatgacaaaagggtgcgaataaccgtaaggtatctccgcgtatcatgggtgcagaatgaccaaacttggtctctgcttgtcatcgggctcgccgcctctggatga

SEQ ID NO: 13586 - DNA, 408 bp, Glycine max
  Peptide Sequence Number=SeqID_105271
atgggtgaagtagaggaggtgcaagagcagatgaaggccgacatggaggccatgaaagagaaaatggccacaatgatggaggccatgatgagcatgaagaagataatggaagccaatgcggttgtagttgccgctactagcgttgttgctaaggtgaacccgacacccccatctggccttaaccaaatgaatcatccaacctcaaatatggtaggcaaagaattgggaagtacgggcggcccccattatgtgcaaattcaaaacaagcacgccttcccaccatatggcttgcctcccaactatacaccacccaatgtggcgtacactcccagtgagaatgtcaataactccactcccacactcattgagagccaacaacctcaatctgatcatacacatgtctcttaa

SEQ ID NO: 13587 - DNA, 231 bp, Glycine max
  Peptide Sequence Number=SeqID_105272
atggcagcggaatggagaaggaagatagagaggagacgccacttcaaggagaagatgagtctagaagaagctcaccaccataggaggccatggataagagcttggaggaagaaggagatgaatgaggggagagggagagaagagcacgaaattttgtgctctaaaagagctctaaaatctgaacccactaatccaagatcaattccaagattctccactaagtgtgcttag

SEQ ID NO: 13588 - DNA, 405 bp, Glycine max
  Peptide Sequence Number=SeqID_105273
atggaagataatttccttggagaactatcacagcagcagattcagccaaatagggaggataggtgcagctggaagcatgatcaaactggatactactcaacaaaaagcagatatgacttgatatgggaagcacagatgggagctaatcagaatttggactttgtggacatttggaagctcaaaataccaagtaaatcactggtttttgcttggaggccaattagggacagacttccaactaggatgaatcttagaagacggcagggaatttgcggacaagacagctggagaaaggctttgcccagccctacaactattggtctagtaatttatcaacaacattttttgattagggtagcagtgcagggttattgtattctatttagattggcacctgattcgtag

SEQ ID NO: 13589 - DNA, 576 bp, Glycine max
  Peptide Sequence Number=SeqID_105274
atgacttccatctttgaagaactagatactttaatcatgaaaaagttttggctgaaatactctctggtaatcgattacaacaacagtgtaatcgattataggcagataagaagatttcaaaatctgaaaactgcaactcctcattctctcacgaaacccttgttcccaatttttctttctgccatatctcactcaattcttgtccaaatcactccccacaaagaccaaatttcatctttttttcattctctttcatttgaactgattgaaatttcaaataactccctcaaatgttggaaccatcaaagaagcgaaagggttcttcgagtcgaagccaatggcattctgagactcaagaaacgtagattccctcctccatttcctcttcctcattgttctcaacagaagaacaaaggatacgttaaagccttctattctaatcttgaaattcaagaaggcactctgatttctgaagtctatgggataaaaatggtcattgaccaatccctattctatgacttgacccaattatcaagtgagggtgtaccatttgaaggtgcactgaatgatgattag

SEQ ID NO: 13590 - DNA, 297 bp, Glycine max
  misc_feature (12)..(12): n is a, c, g, or t
  Peptide Sequence Number=SeqID_105275
atgaagcaaganccggcacctcaacaggagagatccgacgaggctgctcctcctcctaagcctacacctgcacaggttgaaacaacgctagctgatccatattctccagtggcagatccatcttctcccaaacttgaagtagctcccccatcttcacctattattatcatctctgaagactcgacagagtcagcatctggagaagttgttgctctctctgattcccctattttccatttgatagatgaggaggatgctcagactcgggataccaaggatctatctcaggacttttaa

SEQ ID NO: 13591 - DNA, 525 bp, Glycine max
  Peptide Sequence Number=SeqID_105276
atgcgtatcgtttccgaaggcgcggtcgccgctggcgttcgccgcatggaagcgctgacgggtgaggctgcacgcctctatctcgaagagcaggacgaacgcgtaaagaccatcgccggtgcattgaagacgacaccgtctgaagtgctggaacgggtcaacgcagtgcttgatgaacgcaagaagatggagcgtgaatttgctgatgcccgcaagaagcttgcacttggcggcggctcggcggacgggggcagtgcagttgaagccgtgaatggcgtcaatttcctcggcaagattgttaccggcgtttctccgcgtgatctgaagccgcttgctgatgaaggcaagaagcaggtcggttccggcgtcgtgactgtttattgcgcggtcgatctggttcgggccgcttccgcagctcttggtggcgcaggcggcggtggtcgcccggatatggcccaggccggtggcccggatggtgcaaaagcggctgatgcaatcgccgcggtcaaggcgctgatcggttaa

SEQ ID NO: 13592 - DNA, 500 bp, Glycine max
  Peptide Sequence Number=SeqID_105277
gtaaggatcgtgatggacaatggctgaagaaggacgcgctacctccacaagacgagcgtactccctctcctcctcctcaacgagatgattcctcagcccttatgaatgaagttcttttagagttacggggcctccgcacctatgttggtgaacgattcgattccttggatggtcgctttgaaggcatggatacccgcatcacccagcttgaagaggatgaattaaattgtcatcatcaaaaagggagagattgtagaagcaaagactttgactttgatgttttgatgatgccatatgatcatgatgttttgatgccttatgaaaatgcgcttctcaagtttaattcaagacaaaaatccaagaatacaagatacaacatcaagaacatctctagtgatttaggaagggaattccaaattgaaacagcaaaaggtttggccaagaaatttaaactaaaatgtctttttcaagagatttactctctggtaaccgattactag

SEQ ID NO: 13593 - DNA, 392 bp, Glycine max
  Peptide Sequence Number=SeqID_105278
ctccttcttccatggcttattccctagtggatggtgtctcccttctcctcttctcctttgcctttcactacatctccatggtggaaaatcaccattgaaggacctcattgaagctcaaagatccagtctccatagaagctccacaagcaagcttttatcagtaaaagaattctacgcaaacctctatgacccagaagtcaagtcacctaagcaggtggagaatttatgtgcttattcgagattttcactcctaaggcctgatccacaggagttagctgctaagctctgtaccccagggaggggatttgagttgaatgctgatggtctccccttgatgatcttaaggaagaacatgactactctcgctcagacatggagcattctttcttatt

SEQ ID NO: 13594 - DNA, 165 bp, Glycine max
  Peptide Sequence Number=SeqID_105279
atggaggttgatgaaccttggctagggttatggctaccattgaattatcgcgtagatatgggagcaaggatggcctttgtggataactgggtggtgggtaaggagatgggttgttattggctgagtaatgacattgttgggttggtgggaatcttggtcatatag

SEQ ID NO: 13595 - DNA, 357 bp, Glycine max
  Peptide Sequence Number=SeqID_105280
atggcttctatcatgagggccatgctaaagcttcaaaaaactatagaagataatgctacggcggccgcttccaatacagctagggaagcggaaccggtgatacagcccgcaataaacttgggccgagacagaaacacgacggttttcggtcggaggtatagtcctcaagcctacccttatggtttgcctccggacttcactccccgtaccgctccagacgatttgagccaagcccctaccttcgaggggcaactccctcctcatgccgactatcctctgcaagaagatgatgaaggagatgcccatttaggccctctacttcccctcaaggatccggccccctatgagttgccctaa

SEQ ID NO: 13596 - DNA, 222 bp, Glycine max
  Peptide Sequence Number=SeqID_105281
atgacaaaagttgacagcaacacgggtgtgcgcaccgatgatataagatttacattggtagacctaaagaaacttggttaccacgatgaccctttcatcatggcaaaacaagctagacaaggcaaaacaattggtgtcaatgtagaagatgatgattcatacatggacacctatgttagtcctttgaccatacaaatcactcctaacgttgtcagagaataa

SEQ ID NO: 13597 - DNA, 743 bp, Glycine max
  Peptide Sequence Number=SeqID_105282
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcagtctcgcttcaaaatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13598 - DNA, 636 bp, Glycine max
  Peptide Sequence Number=SeqID_105283
atgcgtgctagagctagagtaatgagtgaagtagaggaagttcaggaacagatgaaggttgacatagaggccatgaaagaccaaatggctgccatgatggaggccatattgagcatgaagaagataatggaggtcaatgtggctgcagttgtcgctaccaacgtcgttgctgaggtggacccgactcccccatctggcctcaaccaaataaatcatccaacctcagacatgaacaaacatgccttcccaccatatggcttgcctccgaactatacaccacccaacatagcacacactctaaatgagaatgtcaataactccactcccatactcattgagagccaacaacctcaatctgatcatgtacatgtctctcaacccatgggggagacacatgaaattccccaccataatctagccgacttcaagcctcgcttcggatacgccactaaggggcaagtagttggtggtgtacctctgccaaacactttggagggcccccagtttttcccacaaccacaaccctttcattttgcggtggggagagtccttcttgctatggtggaaagggagaaattggatcacatagaggaaaggctaagggccattaaaggaggcggattatgcctttgctga

SEQ ID NO: 13599 - DNA, 294 bp, Glycine max
  Peptide Sequence Number=SeqID_105284
atggcccgcacgaagaagacaggggagattatgactgaggctgcaaaggaaatcgctaagaagattattcgtttgaggagcaggccacacattgatcgttcgtcccccatcgacgtcaggatgttctcgccgctactattggacgtccagagcaccctggacgtgtccgtgctgctggagctggtgtcaccatcaagcaatactttggatcggctccacagacgtcccacaacgtttccttcctgcctcctgacgaattacagtagcttacccagcagatcagggaccagctag

SEQ ID NO: 13600 - DNA, 1259 bp, Glycine max
  Peptide Sequence Number=SeqID_105285
cgctggatggcgaagcggaaaatggcgtaatagccgacgaaccagacggcggccaccaccggcaccagataccacttggtggcggtgccgtgcagaatgccgaacaccacgaagtcgatgatattgccgtcggtattgccgatggtcacgcccagcagcgccatcacggtaaagcccagcccggtgagcagcgcgtggatcaggtagaggaacggcgcgacgaacaggaacaggaactcgatcggctcggtggtgccgccgaccacgcaggccaccacgccggaaatcaacagccctttgattttatgacggttctccggtttggcgcagtggtacatcgccagcgccgcgcccggcaggccgccgaggaacgccggcattttaccctgcgacaggaagcgggtggcgctttcggcgaagccggtggtggttgggcaggaaagctgcgcctggaagatggtcagggcgccgctgacgctgtggccgcacacttccatggtgccgcccgcctcggtaaagcggatcagcgccaccagaatgtgctgcaggccgaacggcagcagcaggcgttcgccggtgccgaacagcatcgggccaaaggcgccggcgctgttgatcacccaacccagcccggtgatgccggcggcgaaccacggccagatcagcgggatcaccaggccgcacaggcccagcaccgcggtggtgacgatcggcacgaagcgcgtgccgccgaagaacgccagcgcgtccggcaggcggatggtgtggaagcgttcatgcaggcgatagacgatgatgccgacgatcaccgcgccgaggatgccggtatcgatcgactgaatgccgaggatgttctggatattgttggctttcagcaccagcggatcgccggtgggcagcacgccggcggcggtcaggtagaaattggtgcccagattcagcacggcgaagccgacgaagccggagaaggcggcgacgcccttgttctcgcgcgccatacccagcggaatggcgatggcgaacatcaccggcaggaagctgaaggcgaaggagcctaccttgctcatccaggtaaagatcagctggaagatcgggtggccgataaacggcatcagggtgatcacgtcgcggctgctcagcgagctgccgatccccagcatgatgccgcagaaagagagcaaggcgacgggcaacatgaaggttttgcccaggctctggaagaactcccagagggtgattttgggtttgttggttgctga

SEQ ID NO: 13601 - DNA, 129 bp, Glycine max
  Peptide Sequence Number=SeqID_105286
atgtgtattcgccagaaagctcctttacaagttaatggttggagtgaaattagtaaagatgatgtagatgaaatgtggcgacatatgaaggaaagaagcttgacaaacaaagctaatcgaagcaagtaa

SEQ ID NO: 13602 - DNA, 764 bp, Glycine max
  Peptide Sequence Number=SeqID_105287
aacgcctcgccaacccgtcgtcgtcgctgatccagagccgcatcccggcagcctggtgtcatgctgctgccgccgctgtcgcaccgcgacattttcgccgcctacgtgctggcggccgtggtgcgcggcctggccgtgggcctgtgcgtgtgcgtggtggcgctgttcttcgtctcgctggtgccgtccaacccgctgtggctgctggtgttcgcggtgctggcctgcggcatcatgggcgtgctgggcctgatcgccggcctgtggtccgagaaattcgaccagttggcggcgttccagaacttcctcatcatgccggccaccttcctgtccggcgtggcgtgtcgcactggaaccccatcttctacaccatcgacggctttccgctacggattcttctcggtgtcggacgtctccccctggcgcagcctggcagtggtgacgggggtgttcctcgcgctttcgatctatgcgctgcggctcctggccagcggctacaaactcaggaactgacgtccatgcttcccactcccgcgcaagtccgccaatacatcgcggacggcctgccctgtgaacacctcgacgtacagggcgacggctcgcatttcgacgcggtcatcgtcagcgccgccttcgaaggcaagcgcctgatccagcgccatcaactggtctacgcggcgctgggcgaccgcatgaaggccgagatccacgccttgtcgatgcgcaccctgacccccgccgaatacgcccaggcgggcaagtaa

SEQ ID NO: 13603 - DNA, 551 bp, Glycine max
  Peptide Sequence Number=SeqID_105288
atggtgaaagttggaacctcttacgtgccgatcaacgtctcattttcgccaaaagttggcccagggcttcccggtatcaacagggacaccaggatttattattgcatgaaaggtagcaacggactggccataaatccacaaggatcaagcttattcgcaaagtgcgacctcggggctccatggcgtatctgtttctatcagctgttcctcctgttcagtactgacggggattgttatccgctcaacggcaaaagcataccgccggaagcatcagcgctggcaagtgtaaagccggggcgcccgctttccattcgaaccatgtcggtgcgcactgcattaagaggcaagggcgatcggtgcgggctttgcgtattgggcgtaaagggcggagtgtataggcgattaatgttgggtagcagggtgtccagtcagaacgttgtgcagaaaagcgacggccagtcagaatatgtagatacgactcactatattggagcccaccgcggtggcggccgctctagaactgactcctacctcggcgcactgcaggaaag

SEQ ID NO: 13604 - DNA, 501 bp, Glycine max
  Peptide Sequence Number=SeqID_105289
atgggcacccaattacctacacgaagtttggttcaaatacaatggagcaacctacccaatacggatttaaaaatctacgagtctattatcatcaacttctttgcctgcgatgataacaccatctttgatctacattttacacctcccctaaatcaacagacatgtggtagaccaatacttcattcccgtgtacatgcctggagaactgaaattacccaatgtatactgggtgctccccaaccactggaaatcccatcacatgcaaggaaatatctgaaacaatgtgagaatcacttgacaattttaaggaagaatgcacctcctttgcaatgggacgtcgttacacttgaccgcggcaataaagataaaagtatcgtccggccatggtacaagtttctcagggaaaatgatttccatcatggagacgaggtatcattctattaccggccacatgaaagaatttgggaaatagtcatcagaagagaaaggaagtggctataa

SEQ ID NO: 13605 - DNA, 848 bp, Glycine max
  Peptide Sequence Number=SeqID_105290
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatttcggtggcttgcaaaaggggatacggcacccgaaggtgccgcatcacgcatggcgcgccggtcaaatgcgcatgggcatcaccacgtacttgaaggtgtcgttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13606 - DNA, 589 bp, Glycine max
  Peptide Sequence Number=SeqID_105291
ttggaacctcttacgtgccgagtcaacgtcgtcatcgacgaaatcgatatggacaactggggcataggcggcaaaagcgtgcccgggctccagtggcgttctggtttctatcagctgtccttcctgttcagtactgaggaattgttatcgctaacggcaaaagcaccgccggacatcagcgctggcaagtgtaaagcggcgctgcccttcgccattcggtgccaactgttgggaagggcgtcggtgccgggcctcttcgctattaatgacgccacgctggcgaaagggggaggctgcaagttgcgattaattgggagctgccaccgcggtggcggccgctctagaatagtgaacgatatattcccccgggctgcactgactcgctacgctcgatgtcgtcgtcatgccgacgaaatgcgatatgacaacggggcggaattcctggaaagccggaagatacttaacagggaagcgtttccccctggcggctccctcgtgcgctctcctgttcctgcctttcggtttaccggtgtcattccgctgttatggccgcgtttgtctcattccacgcctgacactcagttcccgg

SEQ ID NO: 13607 - DNA, 507 bp, Glycine max
  Peptide Sequence Number=SeqID_105292
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgaatttacaagatagtggaactctcaagcgggttgcttggggactagacgtaggcacaagg

SEQ ID NO: 13608 - DNA, 480 bp, Glycine max
  Peptide Sequence Number=SeqID_105293
atggtccaagacgacacatccaatgaagttaactacatgggcaatcataatcatcaaggattccatcaaagaggaccactaggattctatcagagcgataattttttgcaggaccatgattggaggtattatccaagtaataatttcaaccaagggggttcaccctatcagcatcctagccaaggaccaagtcatcaagagaagaccactaatatagaagaattgctaatacagttcatgcaggaaacaaggtcacatatgaagaggactgatgcagcaataaaaaatttggaggtacaaataggccaactagctgagctagttgctaaaaagcccactgaaacctttgcggtaaatgctgagatgaagcccaaagaggattgcaaggtgcttccagaatacacgagtttcatggcgtctctagctaagaggaaaaaatgcaagaaagatgtgttctacgtgaccttcatgccaccttga

SEQ ID NO: 13609 - DNA, 639 bp, Glycine max
  Peptide Sequence Number=SeqID_105294
atggagagaagtatgatagatgctgccagtggtggagcccttggagacatgactcctgctaaagccagaaatttaattgagaagatggcttccaactcccagcagtttagcgccagaaatgatgctatagtcattagaggagtgcatgagatagctacaaactcaactgcatcatctgaaactaagaagcttgaaggcaaactggatgcattggttaacttggtaacccagctggccttgaaccaggaatttgtacctgttgcaagggtctgtggtttgtgctcctctgctgaccaccatacagacctttgcccttccatgcagcaacctggagcaattgagcaacccgaagcttatgctgcaaatatttacaatagacctcctcaacctcagcagcaaaatcaaccacagcagaacaattatgactctccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtga

SEQ ID NO: 13610 - DNA, 294 bp, Glycine max
  Peptide Sequence Number=SeqID_105295
atggacgaagatcaatggacgtatgacaatacgatgtctcaagaaattgatatggattatgaaaatgaacaagaatgtggagcggtcagtataagtgtaggaagaaagaatttgttagaagagacattgggagtaggaaatgtggttgtcccttcaagcttcatgggaaaccaatgcatggatgggaaggatgagaagaatattattgctgatatgacaaagtcgatggtgaaaccaagaaacatcctgctaacattgaaggagcacaatgccaacagttgcaccacaatctaa

SEQ ID NO: 13611 - DNA, 546 bp, Glycine max
  Peptide Sequence Number=SeqID_105296
atgaagaaacccgtcaagggcaaccaaattgggtgtggtcgtgcccttcggagttcgaattggggaactgacaaattgtcaaacaacccggaatttccatggaaaacacaatatccgacaatgagtcctgtgaaggtaatgataccaaggacccagacgtcgattttgagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13612 - DNA, 486 bp, Glycine max
  Peptide Sequence Number=SeqID_105297
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggaaacttacccgttgaagaacgaagaacggtga

SEQ ID NO: 13613 - DNA, 207 bp, Glycine max
  Peptide Sequence Number=SeqID_105298
atgaagcatggctccaaactcgtgggtggaggatgcatgaacgaaaacgcaattcatggggctccgaaaaaggggcgaggatggagaattgcactaagcaatcactacacatggctccaaactcatgggtggaggatgcatgaacgaaaacgcaattcatggggctccaaaaacaaggcgaggatggagaattgcactaagcaataa

SEQ ID NO: 13614 - DNA, 702 bp, Glycine max
  Peptide Sequence Number=SeqID_105299
gaattctatgccaacctttatgaccttgaggagaaattgccaaagcaacaaggggagagcttgcccgcttactccaggttttgtaggttgaggtcagatcctcaagagttggtagcccggttatgtatccctgggaggggatttgagcttaatgtcgatggcttgcctctaaagatcttaaggaagaatcttactactctggcccaggcctggagtgttttatctttctctaacctagccccgacatcccacacttttgatattactttggacagggctaagttgatctatgggcttatcatgaagatggatatgaacctaggatccctaatcttaggtcagatttctcttattgcccagcatgactcctcgaggctaggttttccagctcttatcactgccctgtgcaaggcccgaggagtcacatcagattctctgacccttgagtcacttaacccaaccattaatttggcttatattaagaaaaattgctggaacctggatgacccttcgatcacttttccagggacccgcaaatccagggctaaaggacctaaggccccatccattttagctccccctgatactactactccctctactttagcttcaactacttctactcttccctcaccactgacagctccagttcctccaacttcctccgctccgagctcagatcctatcatgactatgctttag

SEQ ID NO: 13615 - DNA, 180 bp, Glycine max
  Peptide Sequence Number=SeqID_105300
atggggatttcttttggaacattgcgaaactacacgaattgcgcaacgatgcttgtcttgactttcgggatgttgcgaaactttacggattgcgcaacaacgcttgcttcttcttccagaatgttgcaaaactttatggattacgcaacaacgcttgcttttccttccagaatgttgtga

SEQ ID NO: 13616 - DNA, 399 bp, Glycine max
  Peptide Sequence Number=SeqID_105301
atgtgtcctatttgtggaagtcatcaggaggaggctggtcatctttttttccactgcaaaatgactaggggtctatggtgggaatccatgagatggactcagaaatgctacaaggattacaaagttgatcactcaaaggcagaagctgaggacagaaatagtgagaataacaatgactggggtgtcactggtggagtatggccaaaaaaattgggtctcactggtgggggaagcaaggaggcaatcattcaaaaattccagcaaatggaggaaagggacaaagtacaagtagaagcaaagtcattgctaaaggagagaaatagtgagaataacaatgagtggggtacaaagtcattgctaaaggagagaaaggaaaaacttgatcactcaaagacataa

SEQ ID NO: 13617 - DNA, 487 bp, Glycine max
  Peptide Sequence Number=SeqID_105302
gccagggggtgcgaacacgcgaccgctgcgggttatgccgctcagcccgatgatgtttgttactttggccgatagtgagccgatgtcggtagcttcttccttcctactgctcggaggggcgtacctccacggaactgtgcgcaagcaggccaagcattgttcgaccaagtggcccaaggatcccccatggtatgcgcaagttgcgctagggttataccactttgggaacggagactggatgatctttcctggaatcatcacggccaattggttcgcgatgaaagatggcaagagatccctatacatcattgggatcggggccgggttggagccagagcctgaggagcccccctctgtgggggcatgggcacccttggctgggcgagtgttgtgttgtaagagaccttggcgcgagccgaaaaactcgggtgatgctgtgcatattggtgggtatcgtgaggggtttgcggcgacttgggcaacgcag

SEQ ID NO: 13618 - DNA, 375 bp, Glycine max
  Peptide Sequence Number=SeqID_105303
atggtgccgctaagcgcaacctctaaggagcttagcgcaaatccttgcgatgagctaagtggaccatgtctcgctaagtcgccagtgcctttttcagtttttgaatttgatcaacttatgtcctgtttagctgtttggttcctttatttgcaaatgtcatcaagaaagagggctagaaccgatgacatcctttcatcatccatcccagctcctcaatcagtcgccatagaactagatgtccaacacccgcaaactttagtccctatgctacagagcctattcaaaggacaactcattatcatgcacaacctgcgagagttggctcagaacaggccaattatacctctagagtattttcttgagaaagtagtgtag

SEQ ID NO: 13619 - DNA, 747 bp, Glycine max
  Peptide Sequence Number=SeqID_105304
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggccatctgtccctccattcatgggatattaagaacctgtccaatctgcttctagacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 13620 - DNA, 390 bp, Glycine max
  Peptide Sequence Number=SeqID_105305
atgtccgtgtggcaagagaacgatcaacctgtactaaggtatagagttgaagtgatggttaatcacaagggtgaacagaccaaattttttatctgggatcgtgaatgtgcacagttaattggtcaatcagcggatgaagtcaacaggctcaaaatagaagatggcgatgttgatttaaatgcctctcctcaagcactagataggctattgggttgtttccttgcattcaaagtgaaggtgcaaccaaggttcaggaattctattgttcttaaatattcagatgaatcagacttggtcaatgctgtcctggatatgcttcccgatagtgagccatgttgcaagatcgagaattcaatacttgagtcgaccgatcctacagagcttgaatct

SEQ ID NO: 13621 - DNA, 455 bp, Glycine max
  Peptide Sequence Number=SeqID_105306
aagggctacacaccctcaccttcagaggactacacatcctcaccttcagaggactacacgtcctcgccatcagaggaccacgcgtcctcgcctttagagggctgcacgccctcgccatcagaggactacacgtcctcgccatcagagggctgcacgccctcgccttcagagggctacatgccctcgccatcagaggactacacgtcctcaccttcagagggctacactccctcaccttcagaggactactcgtcctcgccttcagagggctacacgccctcgccttcagaggactacacgccctcgccttcaaagggctacacgcccttgccttcagagggctacacgccctcaccttcagaggactacacgtcctcgccttcagagggctacacgccctcgtcttcagaggactacacgtccacatggttgcgtgcatgaccagttttgtataa

SEQ ID NO: 13622 - DNA, 299 bp, Glycine max
  Peptide Sequence Number=SeqID_105307
tgatctccgtcacaggtattttttcggcgcaaagtgcggtcggggtgatgctgccaacttacgatttagtgtatgagggtgtttttgaggtgctccagcggcttctgtttctatcagctgtccctcctgttcagctacgacggggtgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 13623 - DNA, 174 bp, Glycine max
  Peptide Sequence Number=SeqID_105308
cccatggactcgaaatctaccctaaggctcatgagaaccctagggccttcccttggatctctggtctcactactgcaactatggttgacactcccttggaagttaatgtcaagttaagacaggatgaagtcagcatcaagcttatcgataccgtcgacctcgagggggggcccg

SEQ ID NO: 13624 - DNA, 381 bp, Glycine max
  Peptide Sequence Number=SeqID_105309
atgtatatgcatgcgtggagtcaaatcttgggtcaaggttccatgtatgcattccttgagccacagtccttggtggtttcaaaggatacacgtggcgaatgccaacaatatcttgaaagatggcttaaggaatctaaccgagaggtgtacgttggaccttacttccatcagaaacctgatatgcatatcaaagccgcaattaatagtgtaatgacaaaattaaagacgagttcgtctcctgaaagtaaggcagctgcacctaagtggattgaagttaagagtcaagttcaaaccggatgttatgaatgtggatattacatgatgcattggatgtggaacatcataaccagcgagatcaagagtgattggtccatgtactaa

SEQ ID NO: 13625 - DNA, 357 bp, Glycine max
  Peptide Sequence Number=SeqID_105310
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctagcatagaggactggtggtcacaaatctcctctgttacatacacacctgttgagctaagagaaaactttcagatcatcaagcttatcgataccgtcgacctcgagggggggcccg

SEQ ID NO: 13626 - DNA, 281 bp, Glycine max
  Peptide Sequence Number=SeqID_105311
aaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgccgtaatatcccagctgaacggtctggtcataggtacattgagcaactgactgaaatgcctcaaaatgttctttacgatgccattgggatatatcaacggtggtatatccagtga

SEQ ID NO: 13627 - DNA, 324 bp, Glycine max
  Peptide Sequence Number=SeqID_105312
atgaccacaatgatggaagccatgatgagtatgagaaaaatgatggaggtcaacatggctatagtcgttgccgcaagtatcaccatagaagtggactcgactcacccacctggcttcaatcaagtaaatcatccagcctcagatatgaacaagcattccttcccactatatggcttgcctcccaactatacaccacctaatgttgcacacactcccgatgagaatgtcgacaactccacacccatacccattgagagccaacaaccccaatatgatcatgcacttgtctctcaacccatgggggagacacatgaaacaccctaa

SEQ ID NO: 13628 - DNA, 413 bp, Glycine max
  Peptide Sequence Number=SeqID_105313
atggggacaaatcaaaacggcaaaaggttttatcaagtcaaggttaaaagtctagatgtcactagcctcaaggaattgggacgattgatgggacctctccaaaggcaagccttccgcaaagtctacgggaagattctagatttgaccccagcggaggtatttacagaagctgtcgtatccctcgcccaatactatgaccagccgttgaggtgtttcacgtttggggacttccaaatggtaccgactattgaagacaagattgcagctgtggttggagattcaacaaaagagttggatcgcatgaagcaaactcggaacggcgtagtgggcctgcctcaaaaatacttggaagttgtcctctttccgaacgtggacggtttggtggacttagccgccattgacgccttcctcgc

SEQ ID NO: 13629 - DNA, 438 bp, Glycine max
  Peptide Sequence Number=SeqID_105314
gaaacggctctgaggaatctttcctcgaagagatctaggaaggacgtcgtggccgaagggactagtgccgctcccaagtttgatagccatcgtttcaggagcgctgagcaccagcagcgtttcgaagccatcaagggatggtccttccaccgagagagacgcgtccagctcaaggacgacgagtacacagatttccaggaggagatagctcgccggcgttggacgtcgctggtaactcccatggccaagtttgatccagatatagttctcgagttttatgccaatgcttggtctacagaggagggcgtacgggacctgcggtcatgggtaaggggccagtggattcctttcgatgcagatgccctcagtcagttcctgggatacccgctagtattggaggagggccaggagtgtgaatacggtcagagaaggaactga

SEQ ID NO: 13630 - DNA, 720 bp, Glycine max
  Peptide Sequence Number=SeqID_105315
atggggacaaatcaaaacggaaaaagattttatcaagtcaagattaagggtctagatgtcaccagccttaaggagttaggacgattgatgggatctctccaaaggcaagccttccgcaaagtatacggaaagatcttagatttgaccgcaatggaggtatttacggaagttgttgtatccctcgcccaatactatgaccagtcgttgagatgcttcacgtttggggacttccaaatggtaccgactgtcgaagagtttgaggagatattaggatgccctcttgggggaagaaaaccgtatcttttctccgggtttcttcccgccttgagtaagattgcaactgtggttggggattcggcaaaagagttggatcgcatgaagcaaactcggaacggcgtagtaggcctgccacggaaatacttggaaggcaaggcaagggatatggcaagccaagagaagtgggtcccgtttgcggatatactagctttgctgatctttggggttgtcctctttctgaacatggacagtttggtggacctagctgcaattgatgctttccttgcatatcaccatagcaaggagagtccagtggtggctatcttggcggacttatttgatacctttgaccgaaggtgcgagaagaacagcgcatggattgtctgttgcttacccgttctctgtgtgtggttggtttcaaacctattccaacaagacatatga

SEQ ID NO: 13631 - DNA, 384 bp, Glycine max
  Peptide Sequence Number=SeqID_105316
gcttttattgagaagtactgcacccagagacaggctcagggtgatgctccacaggccacaggcgcgccaccaccacctcatcaggctggcccggctgggtcgtttgacatggagcagtatttacggcatgtggttcgccaggaggtggccaaccacagggcccatatgcggaccaatgagaccctttaccagctgagcctcagcatgcagagccagggcttcgcttctttttcatgccctactccagaccaattcagggcagaggtcgcatggcccggggattggcccgaggcccaagcaggagaggcacccccagaggctcccgacgatggagagaaggcccacgaggacgaggagatggccgatttgcttgacttcttgtaa

SEQ ID NO: 13632 - DNA, 317 bp, Glycine max
  Peptide Sequence Number=SeqID_105317
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatacccgcacgacatcagccaatagctactacttgattcgtcccaatataaaaaagaaactcgcaaacgccgatcttgatcaagcttatcgataccgtcgacctcgagggggggcccggtaccagcttttgttccctttagtgagggttaatttcgagcttggcgtaatcatg

SEQ ID NO: 13633 - DNA, 465 bp, Glycine max
  Peptide Sequence Number=SeqID_105318
atggctccgagaaagctttccgcaaagagatctaggaaggatgccgtggctgaagggaccaatgctactcccgagtttgacaaccatcgtttcaggagcgctgagcaccaggacgatgagtacacagattttcaggaacagatagctcgccggcgttggacgtcgctggtcactcccatggctaagtttgacccggatatagtcctagagttttacgctaatgcttggcccatggaggagggcgtgcgggacatgcggtcatgggtaaggggtcagtggattccttttgatgcagacgccctcagccagttcctgggccattgcccagctgttatgcgtaccgggtcaggattttgtccagactgctgccaggaggcgggtgtggatcatgcgcaccagcatgacctccttgacccagatgtggatgacgttgctgctcagcaacgtcctgcccagcgatcataa

SEQ ID NO: 13634 - DNA, 1422 bp, Glycine max
  Peptide Sequence Number=SeqID_105319
atggggacaaatcaaaatggcaaaaggttttatcaagtcaaggttaaaagtctagatgtcaccagcctcaaggaattgggacgattgatgggacccctccaaaggcaagccttccgcaaagtgtacgggaagatcctagatgtggccgcagcggaggtatttacgaaagccgtcgtatccctcgcccaatactatgaccagccattgaggtgtttcacgtttggggacttccaaatggtaccaactattgaggagtttgaagagatattaggatgccctctcggggggagaaaaccgtatcttttctccggctttcttccttccttgagcaaggttgcgcctgtgattggagattcagcaaaagagttggatcgcatgaagcaaattcagaacggcgtagtgggcctgcctcggaaatacttggaagacaaggcaagggatatggcgagccaagagaagtggggcccgtttgcggatgttttagctttgctgatttttggggttgtcctctttccgaacgttgacggcttggtagacttagccgccattgatgctttcctcgcatatcaccatagcaagaaaagtccagtggtggctatcttggcagatttgttcgacacctttgaccggaggtgtgagaaaaatagtgcacggattgtctgttgtttacccgctctctgtgtatggttgatttcacacctattccgacaagacacgagacacccgtgtccgcttcaaagctatcgctcatgcgccgaaaaaggaagagtcgattgggaccaacatttggctgggatagggggcagcgcgatcaattggtttcctcgttggaaggaaggcaaggaaagagttcttttctcatgtggggactaccctaatgttccactgatagggactaggggttgtattaattataatcccgcactcgctataagacagctagggtatcccatgaggggagcgccaaccgaagaaagtctctcgcctttccttgtgagggatctaggcgcgcaaggtctcaaggttatacaaagaatccacaaggcgtggaggaatccgttgaagaaagacaaggagcttaggggcatccgaaatggcgtcattggaggttatcatggatggctaagaattcatgcgcgagggttagattggctctccaaattgaaagttatcgatgaggagaatttcgaagctccggaggaagatgaagaagtccgagctctaaagttagagttagggaaggcaagactcgccaaggagaagttcaagtcagctgctacacacatccggaaggagtgcaccgagttacaagaggaaaacgcggccactgtaaaagcccttgaacaagaaaccaaaagggcccgcaaggaggaatatggccgagagaaattccgaggagcattgtggggtagtaacgaatga

SEQ ID NO: 13635 - DNA, 292 bp, Glycine max
  Peptide Sequence Number=SeqID_105320
atgtccaaatcttttgaatttgggatgaccggctctctcgatgagtcgatctcttgctttctcataaggatggaccctcgggtactagtaccctcgcctccagaggactacacgtcctcatcttcagaggactacacgccctcaccttccgaggactacatgtcctcatcttcagaggactacatgtcctcacctttagagggctacacgccctcggctccgaggactatacgtcctcatcttcagaggactacatgtcctcaccttcagagggctacgcgccctcgccttc

SEQ ID NO: 13636 - DNA, 87 bp, Glycine max
  Peptide Sequence Number=SeqID_105321
atgtcggtggcctgcaccctcgactaccaacggtcccgtttccaccacgggctggtgcgcgcggcgttgccgtggcgtatgccggag

SEQ ID NO: 13637 - DNA, 359 bp, Glycine max
  Peptide Sequence Number=SeqID_105322
atggtgatgccagccgataaagcgctactggaagagccgaacgtcgccaccgttactttatcggcgccggaaagctatggcgtttccgccggccagccgctgatgctgcacggcgttaaagtcggccaggtactggaacgcaagctaaccgcagagggtgtcactttccaggtcgccattgcgccggagtatcgcaatctggtacgcggcgatagcaaatttgtcgtcaacagccgccttgatgtgaaagttgggctggatggcgtgcaggtgcttggcgccagcgccagcgaatgggtcgatggcgggatccgcatcatccccggcgaaaaaggggaaatgcagagtcgctatccgct

SEQ ID NO: 13638 - DNA, 669 bp, Glycine max
  Peptide Sequence Number=SeqID_105323
atgtacatttatcatgagaaaggaagagctcctgattttgaaagtacattggcagacttcacgacatatcaagctcgctctaaaggtgatggctattcaatgcagcagcaggaaactcagtttgaaaaggactattcattggcagattatcaatgggagtcagaatggcaaccttattatcataatgaagcagaagggttgtctaatctagatgacctattaatgttattcaagggtacagtagattcaatgcaacaagcatttaaaagagctgagactcagattggcaaagataaaggtcggttggaactcagtgtagaggatcagaaaatctcctttgacctctttgaagcaatgaaacacccagatatgagtgatgcctattttgaagaagaagaggcagagcaggagatagcattattagcttcaaccatggtactgcagttcccttggaaaaaacctaattatgtgacaaattgcctagtgtgtgatgaagagcatgatgatccaaaagacaactttgttggtcatgtggttcttaaagaattagaaaaaattagaccaacagaaaagcctaaagcagaattgaagatccttccaacgcatttaaagtatgtattcttggaggataatgagactaaacccgttataattagcagctccttgtag

SEQ ID NO: 13639 - DNA, 195 bp, Glycine max
  Peptide Sequence Number=SeqID_105324
atgccttcctttcgcgatttggagcagaaatgggcaccaaaggttggagctttaatgaagtttcaatggaggatgaagaagaaagaaaaagcaacctatgccacatgtctccatttgagtgaagcaaaagggcccactttttctcttgatgtgactcatgctcagccacatgaagagaaaaatctgaccttttga

SEQ ID NO: 13640 - DNA, 264 bp, Glycine max
  Peptide Sequence Number=SeqID_105325
atgcctgatgaagctcatatcatatttgagtcgagtgatccttgtatccatggcatcgaagcgctcacccacaaaagctcaaaggtcacggagctttgtgagtacttcagtcataagagaagtggaatcatccctttatggtggacgagaaggggtacgttcgtcgggaataggcgatggcaagtcttgtttgcaaacccactgaccatcaacatcctttcggtaaccaaaggaggtaaccacatcgacaccaatggaaaatga

SEQ ID NO: 13641 - DNA, 348 bp, Glycine max
  Peptide Sequence Number=SeqID_105326
atggttattccctgttttctttcactttcattatcaatttctggaggcctctgcctggatatgtacattcgtgttaaacgtagtaagacaacctacttcattcggtgcaagccatctgataaaattcttgacataaagcagaagttgcaagaacttattgatcagccagctattaatcaacggttaattttacctgatacaggagaagtattagaagactctaagactctggcagatcaaagggttgaaaatgatgctgttgttgcactgaccttgagaaaagagtcctattgcttgttgtctatgttgtgcatcaaaggatgcataggagttatgtgcatttggtaa

SEQ ID NO: 13642 - DNA, 342 bp, Glycine max
  Peptide Sequence Number=SeqID_105327
atgacaagcagagacaaaatttggtcattctgcacccttgtgtcatccagaggcggcgggcccgatgacacgcggagataccttacggttatctgcacccttgtgtcatccagaggcagcgggctcgatgatacgcagagataccttatggttatctgcacccttgtgtcatccagaggcggcaggcccgatgacacgcggagataccttacggttatccgcacccttgtgtcatccagaggcggcgggcccgatgatacgcggaaatacccgagtggttatccgtataaactttcttttgctatctgtaagacagaacgcttgatagcatgcagagactga

SEQ ID NO: 13643 - DNA, 282 bp, Glycine max
  Peptide Sequence Number=SeqID_105328
atgtcgcgtgcgatgtgcaacccagcaatggtgagtaggagtgttctagggtcccaaacgagttcaaaatcggtgacagagacaatgagtggttcccacgagtttgtgatcaagggttactcactaacgaaaggaatgggcattgggaaatacatcgtgagtgagactttcatagtgggagggttccaatgggccatatactttttccctgatggtagggaccccaaagataatgccgcttatgtctctgtcttcgttgcactccattccaagagcaccaac

SEQ ID NO: 13644 - DNA, 342 bp, Glycine max
  Peptide Sequence Number=SeqID_105329
atgggtaaacgcgtagatacagattctgtgccctatatcattcaggaacaaacaagcttagtgggtaaacgcgtagatacagattctgggccctttatcattcaggaacaacaagctgagtgggtaaatgcgcagagacagattctgcgccctttatcattcagaaacagcaagttgggtggtaaacgcgcaaaggcaaattttgcgccctttgtcattcaaaaacaacaagttgagaggtgggcggagacaaattatggtcattccgcacaccttttcgccatccagaggcggtcgtttccggtggcacacaggaacaaattatggtcattctgtgtctga

SEQ ID NO: 13645 - DNA, 333 bp, Glycine max
  Peptide Sequence Number=SeqID_105330
atggggatcgcacccacaaagacacccagtggacctgaagaagtccaacagggccctggggtttccagctctgggattgtgcccgcaagacacctagtggacccgaagaaggccaacagtgatcttggagttgccaacggtcatcaggccccctaccaatcgagttatcatctagaagtgtcgcgcccccaggcaggcgcagggcgagacaccacagcagcattgggatggacgatagcgggcaatagacacaccgccatcaccattatagttcacctcagctcatccataggaaggttagagcgttgcatacgacacatggccgaccaatag

SEQ ID NO: 13646 - DNA, 522 bp, Glycine max
  Peptide Sequence Number=SeqID_105331
atggggggcagcgaccgcaatgccaatctcgccctgcaaaagtatcagttggtctgtgtcgtcccgacatggggatcacacccacaaagacacccagtggacctgaagaagtccaacagggccctggggtttccagctctggttacgggcctctatcggccctatagggcgctcgtccccccagcaagctcatgccatcatgacataggtaaggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacggtagcgggcaatagacacaccgccatcaccactaaagttcacctcagctcatccataaaaaggttagagcgttgcctacgacacatggccgaccaatag

SEQ ID NO: 13647 - DNA, 183 bp, Glycine max
  Peptide Sequence Number=SeqID_105332
gtggggtggtcgacaaaagcaaggcttttgctcctacgtatcctcaattcatgatgtggaactcagaccaacactcttgggtcatgatagcacaaggtggggtggtcgacaaaagcgaggcttttgctcctatgtatcctcaatttgtgatgaggaactttgacatacgtagttctttcaaaa

SEQ ID NO: 13648 - DNA, 475 bp, Glycine max
  Peptide Sequence Number=SeqID_105333
atgcctcctaaggtgtctagttcctccggcagaggaggaagatccagtacaaaaggtaaagaagttctattggctctaccagagccaataaccaaaaaggcaactacaacatcttctgggtcacctacccagactgggtcatcgacccataaaggaaaacttgaagggtcattgacccagacaactaccatcaaatctgagtcatcaactcaggaatctccaaaaccaacaacaagcaaacagactgtggctgactatgcctggtcaatacaaactctcttggccttagaagatataggcctcaccaaaataccaaaattagcaaaaaagacctgggcagaaatggcctcagaatcagacgatgattctgaaacagatctacaaaaacaaatccaaaaagccaaacagaccaaaatcgtctgtaaccaaaaaccaagccaatcattgactaaacaagaatcaacaccacaacccg

SEQ ID NO: 13649 - DNA, 534 bp, Glycine max
  Peptide Sequence Number=SeqID_105334
atgcacgtggctcaattgatttctgatgccatccactatttgcagggatcacgcccacaagacaccctgtggactcggagaagtccaacagggccctggggtttccagctctggttatgggcctctgtcaatcctactgggtgcccgtcccccccagcaaggtcacgccatcgtgacatagggattgcgcccgcaagacaccttgtggacccggagaagtctaacagggtcctggggtttccagctctgattacgggcctttgtcagttctacggagtgcccgtcgcccccaacaaggtcatcaggccccctattaaccgggctttcatcaagaagtaccgcgccccccaggcaagcgcagggcgagacaccacagcagccttgggatggtcggcaacgggcaatagacgcaccaccgccacctctagatcccctcagctcatctacaaaggttggagcgttgcctacgacttgtggctgaccagcaggcgaccaagtccaaagccaaaggtaagcaaagtactaggtccatga

SEQ ID NO: 13650 - DNA, 279 bp, Glycine max
  Peptide Sequence Number=SeqID_105335
atgactaatgcaaactgtccacaagagtcattgcattcagtctcaaactggaatctaagatatatctgcaaagaatgggaaattaggattgaaattgataccaatgtgaagagagaagaggtggagaagctggtcaatgacttcattgcaggagagaaaggaaacaaaatgagacaaaagatcgtggagttgaagaagaaggcaggggaagccactacccccagtggttgttcattcatgaacttggacaaattcattaaggaggtgttgcttaattag

SEQ ID NO: 13651 - DNA, 459 bp, Glycine max
  Peptide Sequence Number=SeqID_105336
atggctgaatttggcattatgggtgtgctcaccgaactggcgcacgacaccggcatttctattccctcggccgggaatatgatttcgttttatgctttcggcgtggtgattggtgccccgattgtggcgctcttttcgggcaagttctcgttaaaaaccacgctgttgttcctggtggcaatgtgcgctgtcggcaatgcgctgtttactttctccacgtcctatttctggctggcgctggggcgtttaatttctggttttccgcacggggccatttttggcgtcggggcgattatcctctctaaaatagcaccaccggggaaggtaacggtagccgtggccgggatgatcgccggtatgaccgtggctaacctgctggcgctatacctttttcctgattgcggtgttcgatgcgctggtgatcctgtcggttatcctttgggtgccacacctccatga

SEQ ID NO: 13652 - DNA, 426 bp, Glycine max
  Peptide Sequence Number=SeqID_105337
atgccatcctcgtcggtctctttatctcgtacggtgcgatcctgccgtggtgggtatccggcaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13653 - DNA, 546 bp, Glycine max
  Peptide Sequence Number=SeqID_105338
atggctccatcaccgtcactccaaaaaatggtcaaagggctacacgccctcaccctcagaggactacgtgtcctcgcctttagaggactacacgtcctcaccttcagagggttgcacgccctcgccttcgggctacacgccctcaccttcagagggtcatgtaccttcacctttagaggactacacgtcctcgcctccagaggactacacgccctcaccttcagaggactacacgtcctcacctttagagggctacacatcctcacctttagagggacacacgccctcgccttcagaggactacatgtcctcaccttcagaggactacacgtcctcgccttcaaagggtcatgtacctttgcctttgtagggctacacgccctcaccttcagaggactacacgtcctcgcctttagaggactacacgtcctcgccatcagaggactacacgtccccaccttcagagggctacaccccttcgcctttagaggactacatgtcccccttttcagagggcgacacgccctcacctttagaggactacac

SEQ ID NO: 13654 - DNA, 857 bp, Glycine max
  Peptide Sequence Number=SeqID_105339
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttgttggtctcagcttaagttcacagggatggtgcagtggggcacacgccgacaagttcggttcttgggccgtcacgaggagcaaaaggttgaatctttaccaaaaatgtgtgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13655 - DNA, 351 bp, Glycine max
  Peptide Sequence Number=SeqID_105340
atgactaccatcatccttaattattttcctcattttcattttgcaagcaattccatgaacattgcaacatcctttactcctagtcctcccttctctttctcaagacaaattttttttccatttgatccaagagatatgctttccctcctccacacctttacacctttacatagaaacaaagctcaaaagttgatagagatcagcggaataagatcacacggacagataggaagtaagaatgcaatatcgggggcacaccgaaacggcttacaaacccaggtttttgaaaacaaagaaaccgaagcggcggcagagccgcacaggatcagtgaggggagaagggagatatga

SEQ ID NO: 13656 - DNA, 306 bp, Glycine max
  Peptide Sequence Number=SeqID_105341
atgggaagcattaaacggcaatttctacaacgtgctcttaggcatcacgttcaacctggagccgttgtcgatgagtactttggcatgacatggtccatgcatttgactgacacatgcaaagccctgttatgtcctctccccttggcagggataaaaatcttcagcgaaggcgaggtagttgttggctgtgatgttattgacgagtcccccaaagccctctacagatatgtcttgggctacatgagcttcattcaagacttttaccagcaaagctcgatgaggcttagagctcatgagcagttctaa

SEQ ID NO: 13657 - DNA, 447 bp, Glycine max
  Peptide Sequence Number=SeqID_105342
atgattgcggagacagagccctttggcagcaatgaaaatggcgaagaggaggaggaaggggtgattgagatttgtgtccctgaccgtggcagcacacacaacaaaaagggagaagtggatgtcagacggaaggatgccacgactagaggactttgtgtgggaccgatgactggcggccgggagggattcggaggagagggaggcaacgtggtttttgctgttggtggaggcggcgtggtttctgctgttggtggtggcttagcagaggaagaagttgggttggttgtcttgggaagtagaggcggcatgggtggtgacttcgtagaggcagaagatggagagggttgtttgggtaccatggtattcaatatccgaataatggcatcaagtttggaagtaatggaagtttgggctacaacgattttggccatggttgcctcgaggtga

SEQ ID NO: 13658 - DNA, 279 bp, Glycine max
  Peptide Sequence Number=SeqID_105343
atggccgagacaggccaatgtggtggaccatatgcgttccgtgacctcactcttgttgggtggtatgcatggggagctgctggcctcgtccatatgtatgatcagcttaatgatgccagtctcagcaccaaccgacagcttgctggttacatcaccttgttacagtactggatatacgagcacttttcgtcagttgcggagtgcaatgttgattcagactacgacgaggtgtcatcacgtgcgtgtcggtggattgcgatgaagaagactgtgaagaag

SEQ ID NO: 13659 - DNA, 303 bp, Glycine max
  Peptide Sequence Number=SeqID_105344
atgagggtggaggatagaagaacagcgctaggcatcaattcgtggggctcgagactcgatggcggaggatgcatgaatgacaagcaattcatggggctccggataagatttgagggtgcaatcgactcgtggggctccagactcgatggtggaggatacatgaatgacgagcaattcatggggctctggataagatttgagggtgcaggacagacgaacagcgctaggaaatcatttcatggggctccagactcgatggaggaggatgcattaatgagaagctattcatgggggtccggataa

SEQ ID NO: 13660 - DNA, 567 bp, Glycine max
  Peptide Sequence Number=SeqID_105345
atgaccatgattacgccaagctcgaaattaaccctcactaaagggaacaaaagctggtaccgggccccccctcgaggtcgacgagatgggtttcaccatgttgcccaggctggtctcaaactcctgagctcaagtgatccacctgcctctgcctcccaaagtgctgggattacagggcatgagccaccgtgcctggtctttgccatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13661 - DNA, 190 bp, Glycine max
  Peptide Sequence Number=SeqID_105346
atgttggtgcgcatgatccgcacttgtctttttgcagcggcatgggtgaaatcttgccccggtatgcatagtagatgcgtgatagcctccctctctggatgtgctcgcacagttggtcgccctccaatatcagggggcgaggatgtgagtcctctgatggcgaggacatatagtcctttaaaggtgatag

SEQ ID NO: 13662 - DNA, 378 bp, Glycine max
  Peptide Sequence Number=SeqID_105347
atgactaggggcaatccaggtgatttacaatcctttgatcctgaaataaatagaacctttcatagattagttaggcatagtgtgcatcttggccattctgtgcattttgagcattctgagtattatgttgagggtgattatgaatattctgattttgagcatttcactactaatttttatactgagaacatggctcaacctccatttcgtgagaggactcttagggagatggctgcacctgatttcacttatgaaagcttgtgcattcaatatcctgatgagggtgttccatatgttctcaagactagactaatacatttgctagtgaagatcctcataagcatcttaaggagttccatattgtttgttccaccatga

SEQ ID NO: 13663 - DNA, 306 bp, Glycine max
  Peptide Sequence Number=SeqID_105348
atggttagaagatttcgaccgttctctcctcatcttcctgtcttccaacaatttctctattcattcctaatcattattcctttactggagttcttcggaaacgttctatactctggtctggagacttgcttgctcactgagcaaggaagccttatccagactcttacttcgtggctcctccgttactctcatcatggcaggtggattcgctctacgggccttcttcctggcgaccgaaggagggctatccatggagaattccatgatgcctcaccctcacggagctgccgaatccacccattctga

SEQ ID NO: 13664 - DNA, 854 bp, Glycine max
  Peptide Sequence Number=SeqID_105349
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgattacctgaatcgcttctgggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13665 - DNA, 365 bp, Glycine max
  Peptide Sequence Number=SeqID_105350
atgactacaccacccagctctcctcctcctcctcctcctattggtgcagcattgcattcactatctaccttgaagtggacaagaaaggccacacgcctaagatcattcgcgattaaaatagttggggcagagagacccctggtccatgtggatcctgctatcgggaaagcggacgatccctacaaaaagaagttaagaacatatttgggtatcatcgctcgtaataagtttaagtatgatttgacatccaaatgggcacttgcagctgacaaggatagtgtcaatgacactgtatgcgaaaagtacaacaataacaaggagaaatgggcccaattttgtcagagccacgagacccttcgtggaag

SEQ ID NO: 13666 - DNA, 501 bp, Glycine max
  Peptide Sequence Number=SeqID_105351
atgaagcacttcactgacaccctcatcagtgccaacatagttgaaattgataaagcttatgagaaaggtggagtagcatgtctaagtgttttgacggatgaaaagtattttaagggaagctttgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13667 - DNA, 4584 bp, Glycine max
  Peptide Sequence Number=SeqID_105352
atggcgaaagcagagtataactatacggtagattcagcgagagcgtctttggttagacaagaagacaccatcatatttggtttgatcgagagagcaaggttccccttaaattctccaacctacaatcaaagttacacttccattccccaatttcgtggcacattgctcgattttctcgttcgccacaccgaggccattcaagctaagacaaatgaggcggtgtggtcacgatgtgagaacggagatctcaaaaaccttggtgagactgatatggcaggaaggtacattaaccctgaagaaaatcctttcttcccagaaaatttaccaccttcggttgtgccacgttaccccttctcacagtttttgcatcctgcagccgctatgatcaacataaacaatgccatatggaaactgtactttgatgagctgcttccaatgtttgttgcttctggtgatgatggcaactatgcgcaaactgctgctaccgatctttcattgttgcaggccatctctagaaggattcattacggaaagtttgttggtgaggccaaattcagagaatctcctcaaggctatgagcctttaattcgtgctaaggacaaaggagcattgatgaaattgttaacatatgagagcgttgaagagatggtggtgaagagggttaaaaagaaggccatggtgtttgggcaggaagtgagccttgatcgtgatgtcaagggaataacatacaaggttgatccatcagtagtttctctcttgtaccagaaatgcgaacgagaaacggagaaagtattgacttcacttgggacaagtgagaagtcaagagttggtgctttaccacatatacccctccctatcaccccagattgccacaagcgtttcataactttcatttccaggaaatcgaaactgctcgcgttgttcacagtcactcacactcactcacattgcaaggacggcaccaaggtggggctgtccgctgctgcgatggacatcgacgacgacgacgacgacgacgacgacgacctcggcgacgtcgacctagaccctacgaactccgaaatccttgaagaactcggcgaagacatggtgaaatactggtgcaagaaagcgtcgatgctgttcttcgacgagtacggtctgatcagccaccagatcaactcctttaaccacttcgtcgccatcggcctccaaaacaccttcgactccttcggagacctagtcgtaactcccggttttgacccctccaagaagggagaaaacgaacacttccgttacgcctccgttaagttcggcaaggtgaagctcgacaagcccatgttctggggcggtgaagggaatgcgcaggagttcaagatgcttccgagacacgcgagaatccagaggatgacctacgcttccaaagtcaaaatccaagttaaagttcaggtgtatgttccgaagaaggttcggagtgataagttcaagactgggaaagaggagttccttgatagagagattatgaaggaagacgagagggaaatcatcattgggagattgccagtcatggtcaagtctgatttgtgctggatgaaagacgcggaaaaagatgatgatgaatttgaccatggaggttattttatcgttaagggtgcagagaagacttttattgcacaggagcaactgtatttaaagaggctatgggttatgaacagtccagggtggatgattgcctacaagtcacagatgaagagaaacaggatggttattaaactggtaggcaattccaggagtgaagaagtggagaatggggacatgtgtcttactgtatattttttgtctgttgaggttcctgtgtgggtactgttttttgctctcggtgtctcatctgacaaagagattgtagatctcattggttgtggcaatgatgatgtcagaattcagaatatcctctttgcatctgttcgtgatgctgatgagaaatgtggagcatttcgaagagttaggaatgctgttcaatatttagaaaaatgtgtaaaaagtgttcaatttccaccttcggaatctatgcaggagtgccttgaaatgtatgtctttcctggaattagtggtttaaatagaaaggcgcgcttccttgcatatatggtgaaaggtctcttgctggcttatactggccgcagaaaatgcgacaacagggatgattttcgaaataagaggcttgaattggccagtgagcttcttgaccgtgagttgaaagtgcatgttgcacatgctcggaagcgaatggcaaaggctttgcagagagacctttatggagatagggacgtacgcccaattgaacattatcttgacgcgtccataattacaaatggcttgcaaagggcattttcaacaggagcgtggtcacatccgtataagaggatggaaaggatctcaggtgtggttgcaaatgttgggcgcactaatcccttgcaaaccatggctgagttaagaagagcaaggcagcaggtccagtacacaggaaaagttggggatgctagatatcctgcaaagcatccttctcactggggcaaggtttgtttcctcactaccccagatggtgaaaattgtggactagtaaaaaatttgtctgtcacaggattagtaagtactgatgtaactgacgtaactgaatctatactgctaaaattggtggattgtggaatgcaagaacttgttgatgatacttccactcatcttggcagcatggacaaagtcctcctaaatggtgattgggttggagtgtgtcccgattccagttcgtttgtggcagagctacgaagtagaagacgcagaaatgagctgcctcatcaggtggaaatcaagagagaccaatctcagcatgaagtgcgcatatactctgatgcaggaaggattctacgtcctcttttggttgttggtaatctactgaagattaaaggatttaaatcagaccgttactctttccagtctctattggacaaaggtgttattgagctgattggacctgaagaagaggaagactgttgtactgcctggggtgttgagtatttatttggaaaagaaggaaaacgatctgtaaagtacactcactgtgaacttgatatgtcattcttattgggtttaagctgttcacttgtaccatttgctaatcatgaccatgcaaggagggtgctctaccagtctcagaagcactcctcacaggcaattggcttttctacaacaaacccgaacattagagttgatactttgtctcaccagttacactatccccaaaagcccctttttcgaacaatgacttcagattgtcttggaaaaccagaccattcactgggtcaaagtaaaatacctccaaaggcagaattctataatgggcagaatgcaattgtggctgtcaatgtacatctgggatacaatcaagaggattccctggtgatgaaccgtgcttcactgcagcgtggtatgttcaggtctgagcacataaggagttacaaatctgaaattgacaataaggaatcttcagataagaagcgaaaacctgaagacattgtaaattttgcaaagctacaaagtaaaattggccgagttgatagccttgatgatgatggctttccatatgttggcgctaatctccaaagcggtgatattattattgggaagtgtgctgaatccggtgcagacaatagtgtaaagttaaagcacactgaaaggggttatgtgcaaaaggttgtgctgtcttcaaatgacgagggtaaaaattttgctgtggtttcattaagacaggttcgtagtccagttcttggagacaagttctccagtatgcatggtcaaaagggagttttgggatttctggagtctcaggaaaattttcctttcacaagacaaggcattgttcctgatattgtcataaatccgcatgcatttccctcacgacaaactcctgggcaactcctagaggctgctttaggaaaggggattgcttgtggtggtatactgaaacaagctacgcctttctccactccttctgttgatgccattactgaacagcttcacagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcacatctgcagcaaatgcaaaaaagttgcaaatgtgatcttgcggccagtgtctggtggacggaaaatacgaggaccttattgccgtcactgtgaatctgcggatgacattgtggtggcccatgtcccgtatggggcaaagactaatgtggatagaagaagtgaatggatggataaagaaatagaagagaataatgaacatagaaagaggatttttcctgatagagaactctga

SEQ ID NO: 13668 - DNA, 1167 bp, Glycine max
  Peptide Sequence Number=SeqID_105353
atgaaacagaaacacgccttctttaaatccccaaatcttaatttctgtcccttcgctcactctcactccgtccatcgccgtttacgcgtcgcggatattcttctcgccgacgaagatcacgacggcgacgccgttgatttcatggacggcgtccgagaaacaccgtccaccaaatgcttttcgcctcggaggctcgttgcttcgttgctcgcgccgctgcggccgaccaaggggctccgactccagcaacggcgccagaacgagaccggtgatttggaggcgccgtcgtcgtcgtcgctgacgaacgaacttaaaggaagcgacgattcgacaggacagttacatcagagtgatacatcttttaagctaggggttggttgtggtttgctatatctgattgcagcaagtaaaaatgagcttggcaagatggttgagctgcggaaagaaatggaaatgctccttcaaaatgcgaaaggagaactgcaaagtaaagatgcacttcttaagccattgaaacaaagtgatgctcttgccctttccataactgatattcaagaagtttccagctctagtagtcatctttctattcattcaaatacacaatatgttcaaccagagtcaaaaggcgatatggttcctaattgttttctggaatataacataagcgaacaagatgaatgtgcagaagagataaatgagctccaggcagaatttgaaattgagttacaacggttgcagatgtatttggatggagaagctggatttgatgatgcacaacatgagggagtaaagttatattccagaattgctgaaaacaggaatttgcaggtagctcttgatgattctagttcaaaaagccatagttcaagttttggtgaaataataatggaacctcaaagagcaaattatgatgtatcatttggagttcctccaattgaattggagagaaagttgcatgaactgcttgaagcaagactggaagaacggataacagagctggagtctgcattagaatgtaccacgcaaaagcttattaagaaagagatagaggttacttggtggaaagacactgcacaacttatctcacaacatcttccagaaacttctcggttcactttcccacttgatcctgagatctctttgaagttgagtcaacttgtaggatag

SEQ ID NO: 13669 - DNA, 525 bp, Glycine max
  Peptide Sequence Number=SeqID_105354
atggaaatgtctggcggtgttgtgggcgatgttggcgctgacactatcgccggcaaggaagacaatgtttacatcggcgtgggagttgagccatggctccgggccgacggcggcggagtgggcaacggtccactggagggcatcccaagtgccgtcgtaggcagcgaggagggggtcttctggggcgaggcggcagtggatggaggcgacgacaacgtcggtggcagcggagacaaagttgaggtagtggtggtaggcgggattgtagggggtgcatgcgcagaacaggccgccatggatgtatatcaaaaagaggagtttttttgcgatggaggaagcgacgacttaagggaggtaaaggcagacggcgacgtcggtttgggcgttgatggttacgtctttggattggacggcgatgcaggggtcgatgccgggagggatggttccggtgccaaggaggcgctcgacatgaaagatgaagaaaaagatgatgtaaagatgaagacagtcatgaagttgttttag

SEQ ID NO: 13670 - DNA, 834 bp, Glycine max
  Peptide Sequence Number=SeqID_105355
atgagtgtccaaagccagagtggttcaagcaatggcaccgaacgatcaaggacgcattggactccattgctggaacgctatttcattgatctcatgttggagcatttgcagagagggaacagggttggccacactttcaacaagcaagcatggacagacatgctcacctcgttcaatgataactttggttctcagtacgacaaagatgtcttgaaaactcgctacaccaatttgtggaagcagttcaatgatgtcaagagccttctttctcactttggtttttcctgggatgctgcccggcaaatggttgtggctgctgatgatgattctgtttgggatgcttatttgaaagctcaccctgatgctagatgctacagaacaaaaccagtgctcaattttgatgatttgtgtgttatatatggccacactgttgctgatggaagatatagtttatctagccatgatgtaaaccttgatgatcaagtacaaggacaacatttgggtgatggaatgggaagcattgctgtaccgagtagtgaacgtgccaagacagattggactgcttctatggaccagttttttatagagcttttgctggatcagttaggaaggggaaatcaagtggataatggattcaataaaaatgcttggacagatatgctagccctctttaatgctaagtttggatgtcaacatggtagaagggttttaaagaatcggttcaagaaactgttgaaatattaccgtgatataacaaatcttataaaacaaggcttttcgtgggatgaacaacaacaaatgcttttggctgatgatgatgtctggaatgcttat

SEQ ID NO: 13671 - DNA, 651 bp, Glycine max
  Peptide Sequence Number=SeqID_105356
atggaaaattcaaatgtgattgaagtgaagatgaccaaagaggttgcatgcatttacgattgttgcttacaggatgtttctttgatgctacaagggaacaatacagaacaaagtgatccaggaaataggtctgtcggaggattttcagttatagattcagcaaaaaggatcctagagaaattctgccctagaactgtttcttgtgcagacataatagctctagctgctggagatgctgttgaaatagtaggagagatgggatggtttcagttgcttcaaatgtcagacctaacaagagatgaacttgatggaggagttcaaggaaaagagagatatgggatacatatactttcatatgagatgaggatgaaattattatggaaagagaataagacgttatgcttttcaggagctcataccattggaacagcacattgcagctcattcagggatcattttcaagaagattcaaagggaaatcttaggctcattgacaaaaccctatacagtgactatgctaatgagctaatgaaacagtgtccagctggtgtccaaccatctgtaacagtgaacaatgatcctgaaacttcaaaggtctttgacaacatgatgcaatcctccctaggaagggaccaatcacaagaaccatga

SEQ ID NO: 13672 - DNA, 234 bp, Glycine max
  Peptide Sequence Number=SeqID_105357
atggccatggccgagcattttatggcgaccagtgttgaatgggatcctaccggaaggccaccgtcaccactgagtcctgagaaagaggaggagatgagtaagaacttgaagaagtatagcaagaagtatgaggcagaggaccaagatgtttcaatgctgttaagggagcaggatagaaacaagaggaggatgttaaagaagaatggaagagattgcatgaacaagagaagctaa

SEQ ID NO: 13673 - DNA, 897 bp, Glycine max
  Peptide Sequence Number=SeqID_105358
atgggttatctcaattcagttttgtcatcttcaagccaggttcatgttgcagatgatgcaattgtgagcggcgggggtctaagtcacaatggaaaattcagctacgggtatgctagctctcctggcaagagatcttcaatggaagatttttatgagacaagaattgatggtgttgaaggtgaaattgttggccttttcggagtttttgatggtcatggtggtgctcgtgctgctgagtatgtcaagaaaaacctgtttagtaatttgatcagtcacccaaaattcatttctgacaccaaatcagcaataactgatgcatacaatcatactgacactgagttgctgaaatcagaaaatagccataacagagatgcaggatcaactgcttccactgctattttagttggtgaccgcttgcttgttgcaaatgttggggattccagagctgttatatgcaggggtggtaatggtaagggtgaagaaaaagttgacagctcccttgagtttcttattctggccagtgacgggctatgggatgttgtctctaatgaggaagctgttgctatgataaagccaattgaggatgcagaggaggcagcaaagaggctgatgcaagaagcatatcagagaggtagtgctgacaatatcacatgtgttgttgttcgtttcttgatgaaccaaggtggatccaaagagttagtagcttatcctcataatagtagctctgcgggtataggtgagttgtggatccaaaagatgctgagacttggtaaaaatcggtttatagttgggttcctgataagcaatctagtagttgtgttgtactacgtcatgcaagaatttatggtcctcttgcataaaactattcattatttgttagctaggaaatgtatgtaa

SEQ ID NO: 13674 - DNA, 531 bp, Glycine max
  Peptide Sequence Number=SeqID_105359
atgggaaaacgtgactttcttgcgaagctgaatgcagaggaaagtgccacgtctggtgttaagtacgcaaggcacttgacagttggcaccgaaccacctcttgggattggattaaccctttacgacctgggcaccattagatcaatctcgtgcctacattattacaatacaccatcaacaccttacaatttctcaatcatcctctttcactttcctgtccacactttcgctaacgccgacagacacgtcgctgctgaacctgcaacaggcgagggttctgatcaagatctgcgtggaattgatgagctcgagcatgagaagtcgcatccagcaacggagccgacgccggagaggagcttgccgacacaaagggtggtgcggttgacatgcgcaaagacttgttcgacagcggcaggtagtggaggaagaggtgatgcgagagaggccaatggctgcttgagagcaagggcgacgaggttcttggcgagtgaggagtttggcgacgcaactatgggttgccggtggcagtga

SEQ ID NO: 13675 - DNA, 1053 bp, Glycine max
  Peptide Sequence Number=SeqID_105360
atgctttatgccaacttggcgaatgagcttcctatttttggtattgctggagaagagtcaaaactcaaaaggattgttcactttgttaatcgtgattctctgagcttggcaaatgactatctttctttgggatttattcctgaagggattgacatacattcagtttctgatgcgctgcaagcatcatttgctgatcggaccactgaatctcaagattttcagggaattatgaaccaactatatgatgtcatgtatgaatttaacttctcccttccgccagactatgctcttgtgataagagcattgggatcactagaaggcacagctaaagctctggatcctgattttaaagtcattcagagtgcatatccttttgtcattgggagacttattgcagacccaagccctgatatgagaagaattctgagggaacttctcattcgtaacaatggatccataaggtggaatcgtctagaacgcttggtagcagcaatctctgaacaagcttctgagataactggagaccctagttctgaaaagttttcaagttcttctgtttggaaattatttgacatgcatgctgttgttgattccactgaagatcttttattattcatattatcagacaagggtcttagagtgcgtcttttccttcttcgggatatagtagaagcagctgatgtgtttctgcaagatgaagtgattgattgcgcattaaatgagaatcctcaaggccagaggacattactatttgaggagcgtgctatccttagtaggattggaaaaggctttgaatacttatgtgaggtggtgaagttggcgccaggggagtggacagcaatgcttattcggatggcagggaagcccgaggttcataaatttgctttagacattatttcagctttagctttgcattctagtcacaaattacagaaatggggaaatggtttcctctacattggcatgaagattccattttttacatctacactcgttatacatgcttcccaacttttacatctttcagatttttcaaagaataatgtaaaataa

SEQ ID NO: 13676 - DNA, 1032 bp, Glycine max
  Peptide Sequence Number=SeqID_105361
atgttggaacaggcttgggcttacctggttgggcctggtttccattccaagttggattctgtgttctgggcgaaggctaagtcacgtggctctcttagaataaagtatgctattattaccgggccggtgagggaggttgaggttggaatagagccacacatagggcgaagaggtgtcagcgggaagagtgccacggtagtgtcaatcagcgggagaaatctctgcacagattctaacaaagttgatgggccattcaaagttgaagaagcagagactgtaaatgtgcctccactcccaacagaaaagttgcttgtgttgggagggaatgggtttgttggatcacacatttgtagagaagccttagaccgtgatttgtctgttgcgagtcttagcaggtctggtaggtcatccctgcatgattcctgggctaccaatgttgcttggtataaagggaatctcctttcaactgattcattgaaagaagctctgaatggggtcactgctgttgtaaaggtggttggagccttgcctctatcactggtgaatttagataatgttgatgagaatgattttacagtttggttgaaagtcgtgatgctaacagattggaagggaaaaaagggagtgtttgtgattgactgcaagataacttggcttgaaagaatcataatctcatgtgttggtggttttggctccaactcttacatgtacaaaattaatgggactgctaacatcaatgcaattagagcagcttcagatcaagttaatgacaacttaatttccactaaaatattttgtgagggctatgccgtagggcaaaatcaatctcatcgatatggacggtgggtagctttgactaactctatatggaagcatagaaaccagctggttttcgagggcaatcactttcaaccatctaaagtgatggatgatgctttattcctcaattggtcatggttaaagaccagagagaaacacttcagtatttctttcaaccaatggtcttctaaccttgtggattattttagttga

SEQ ID NO: 13677 - DNA, 693 bp, Glycine max
  Peptide Sequence Number=SeqID_105362
atgtttccgatcacgaggatgaggataagccgttgttcatccctgcttctgagtctaaccagacctttcctattgttatcactaatcagggtacctagcttggaaagggaagttgctgaattcatggagaaacgtacaagtgttccttctaatgaggctgagaacctggtgctcgcaaaccctagcctctgggttttcaaaagagctccgagagggctcctgaaagaccctgctgatgatggatcagcagggagcttattagctggtcttggaattaacgagacactaccgagggatacattttataaaccggagatgaaactcactagggttgtcctaagagtggcactacaagcttatcgtcaggatcgggcagactatgggttgtgtcgtgacgaggttgctgctttgttgggagatgaatcagctagcaaggaaaacaaggtggggggtgttctgagggccctcagaatgctctttaagcgttcgccaaggttcaacatgtatggaaatgaatttggaatggggaaaggggtggcggttagaagtggttatgccaacaaatttgatgggaaagtgaaatcatactcgggccataaaggaggtggaagcattgatttggaattgtgcctttctcctgatacaatgagcgcattggaatcagatgaggagttcatgagtgcagtttgctaa

SEQ ID NO: 13678 - DNA, 123 bp, Glycine max
  Peptide Sequence Number=SeqID_105363
atggctcacaaaaaaactccgtttaagagtttttcagccacaaaggatgaattggagagctcggacaaaccaacaatcactccgatccaagcaacaaccagtgaggatgagtcagcagtctag

SEQ ID NO: 13679 - DNA, 861 bp, Glycine max
  Peptide Sequence Number=SeqID_105364
atgcaacaacacgaaaagcgtcggataaggggatgtgacctcgttccgagggagaagtttgagaagctggaaggagtggttcggaaaatttatagtcagattggtgttatcaaggaggatggcctctggatgcctatttatcctgaaaccgagaaaaccctaggttactgcttcattgagtacaatacccctcaggaagctgagcttgctaaggagaagactcatgggtacaaattggaccgggcacacatatttgccgtgagcatgtttgatgactttgacagattcatgaaggtgcctaatgagtgggctcctcctgaaactaagccatatactccaggggaaaatcttcaagactggctcactgatgcaaaggccagggaccagtttgtgattcgtgctggttcagatactgaggttctatggaacgatgccaggcatttaaagcctgatcccgtttataagcgagcatttggacagagttttgtgcaatggtctcctttggggacatacttggccactgttcatagacagggggcagcagtctggggaggtgctgccagtttcaataaacttatgcgttattcgcatcctcaggctttctttgagatttattctgtaaaacttattgatttttcgcctggtgagaagtatttggtaacatatattagccatgaaccaagcaatccccgagatgccaatagagttgtgataaatatatttgatgtgaggactggtaaagtgatgagggacttaggaagtgctgatgattttgcagtcggaggtgctgggggtgtcactggagtttcatgttattcattcttgtcattttctttgcagatggattggtggaagagatga

SEQ ID NO: 13680 - DNA, 432 bp, Glycine max
  Peptide Sequence Number=SeqID_105365
atgaattccaacattgattcaacagaccatagccaggatcaaagcagaaaacgaaacctacccgatgctgatgattctccggcgccgaatttccacattgattcatcagaccataaccaggaccaaagtaaaaaacgaaagcaacccaatgatgaagattctccatcgcttgaatcgccttgttccaacatgaaccccagaaggtatcagatagaggtgtatgaagttgcaaggagaaggaacactatagctgtgttggatacagggtcaggtaagaccctgattgctgtaatgcttatgaaagaggttggtcaagccatcaagactagtggtgtaaagaagctgattattttcttggctcccacagttcatcttgtcaatcaggcatgtcacacagttttttcttccctttctgcttttgcttcctgttag

SEQ ID NO: 13681 - DNA, 4056 bp, Glycine max
  Peptide Sequence Number=SeqID_105366
atgtctagctttacgcaggctgttaaaatctgtcatgagaatttttccaaatctgaaggagagtgtgaaatttacagaaaagctgataaaaagattttggaggttgattttaattattctcaggcagaagatttgggatacatatctcccaaattaattgaacttattaaactctttcagtcatttggagaatctagtcaggtgttgtgccttatttttgttgatagaatcattaccgcaaaggtgatccaaagattcgcaaagacagttcccaatatttctcatttcacagtttcctatttaactggtaacaatacatcggttgatgctctggctcctaagaggcagaaggagatattggattctttccgctctggaaaggtcaatctattatttactactgatgtacttgaggaaggaattcatgtgccaaactgctcatgtgtgatacgttttgacctcccaaagacagttcgtagttatgtccaatctcgtggaagatctaggcaggcaaactcccaatttgttgtgatgttggagaggcaaatcaatctgctgggtggaaggataaccgaaaagcatattaagaaaatagtctttgtttctctcttttcacacttaattatcaacattaacccttgtatctacaggggaaacttgaagcaaagagatcaactctttgatatcattaggagtgagcggtccatgactgatgcatctatttataaagaacatgaatctagtttaagggcatgtatggtggggaaaacaaatgcatactatgtggaatccactggagcatctttcactttagattctagtgttagtctcatccaccgatactgtggaacactccctcgagataagtactcctgtgtaaagcccaattttgagtttctgtctgtggaagggggttatcagtgtaaattaatattaccatctaattcagctttccaaacaataattggtccttctggaaaagatatgcgtttggcaaagcatcttgcatgtttcgaagcttgtaagaagctgcatcaaatgggtgccttaaatgaacatttggttccattaattgaagattcttcagaagatgaccatattgtgaaaaataaagaatcaagttctggtgcagggaccacaaaaagaaaggagttacatggaaaagctaacattcatgcattaagtggtgcatggggagacaaactcactagagtcaaatttaatgcgtataaatttgaattcacatgtaatattgtaagtgaaatatactctgggtttgctcttttgattgagtcagagcttgatgaggatgtgggaaatgtaaatttagatctttatttagtctcaaagattgtgaaagcttccgtctcttcatgtgggcaagttgatttggatgctgaacagatgatgagagcaaaatgcttccatgagctttttttcaatggtttgtttgggagactggtcttgaagtccaaatcagcaggagaaagggaatttttacttcagaaagacacaaactcattgtggagcccaaaacacttgtatttgcttctaccactagagaaattgaatgatatctgtgagggatctttgcaaattaattggtgtggaattaattcttgtgcttctgctatcaaatttttaaggaggaaattttctttggtcactggagattgtgatgataacggcacaatcacatcacctcatgataccagttcatcagagatggaatgtgtaggagcaaacaagattcactttgctaattgtgtggttgatgctgataatataaaagacagggtagttttggccattcacactgggaaaatatattgtattattgagatcgacagtaacctatctgctgaaagtcctttctatggaaacaatgaaaaatcaaaggaaagcattaccttctcggattatttcagcaaaagttatggaatttcactgagacatcctggacagcctatgttacggttgaagcaaagtcataatccacacaatcttcttttcaacttctatgaggaagatgcacgagacaagtcatcaaaaattggccctgcagcctcaaaattgccagtgcatgttcatattcctcccgagcttctatacattcttgatgttaaaagagatgtgttgaaatcactgtacttgctgccatctctgatgtaccgcattgaatctttgatgttatctagtcagcttagagaagagatagatggtcaaactagcaagttcaacatacgtagctcactgattctagaatcacttacaactttgagatgtagtgaaagtttttcaatggaacgtcttgagttgctaggagattctgttttgaagtatgtggtgagttgtcacctctttcttaaatatcctaaaaaacacgaaggacaattatctgccagacgatcatcggctgtttgtaactcaaccctacataaactggggacagatcgcaaattacagggatatattcgagactctgcttttgaaccacgccgttgggttgctccaggacagcgttctatacaccttgtttgttgtgattgtgggttggaaacccttgaagtgcctttagatgcaaaattccatactgaagatccaaaagttgtggttgggaagttttgcgacagaggtcactgctggatgtgttctaagactattgctgactgtgttgaagctctgataggagcatactatgtagatggtggactttttgcttcacttaatgtgatgaaatggcttgggattggtgctgaacttgaactatcattggttgatgaagcaatcactgctgcatctctgcgtacatgtttgccaaaagaaagtgagattgcaagccttgaaaagaaaattgggtatgaattttcggtcaagggactcttactggaggcaatcacacatttgtctgagaaagaacttgggattggctgctgttatgagaggcttgaatttctaggtgactcggtattggacctgcttatcacatggcatctttatcagagtcacacagatattgatccaggggtgttgactgacttacgttctgcttctgtcaataatgacaattttgctcaagttgctgttagacataaccttcaccagcaccttctacatagctcaggattattactgagccagatatcagaatatgtgaaggtcatttctgaatcagatcccagatcacttccaagtattagtgctcccaaggcacttggagatgtagtggaaagtatagttggggctatactaattgataccaagctcagtcttgaccaagtgtggaacgttttctattctctattatctcccattgttactcctgataaacttgaattgcctccatttcgtgaattaaatgaattatgtgattcgctcggttattttgtaaaagtaaaagaaaattgtgaaaaagtgggatcagcaatgcatgttgaggttagtgtacaacttccaaatgccctattggttcgtgaaggaaagggggcaaataaaaaaactgcaaaaggagaagctgctttttatttgttgaaggatcttgagaagcagggaatttcacatggtagtttcatgtccaagggaaaaagagataatcctgaccatgtctatggttcatctcatctcaaaatggattctagtattctaattgaagaacattcctcagagccagcatcacataaaaggcacatattggatgaaactaacttaactgcaattaatttatcaattaatatgaagaagggaggaccgcggaccacattatatgaaataagaatattttgttctagaattggtagtgctgtgacatgtgaatccgacaagtttttattttgtcacagatctctatttgaatcctgtgaggggctgcaaggaagcaagggacagaactgctttgtgtcgaaaattaccttgtgcatacccaattatggtaatatagaaagcaaaggagaagctagaagtgataagaagacctcctttgactctgctgcagttcaaatgcttcttgagctgcaaagactgggaaaagttgaaattgatcctctcccttctagttag

SEQ ID NO: 13682 - DNA, 543 bp, Glycine max
  Peptide Sequence Number=SeqID_105367
atggcagcgacgacggcgatggaggcggaggcggtgtggtccgtgaagtgctactgctgcgggttaacggaggagtgcacgccgcgttacattgacggcgttagagagagatatcagggtcgttggatttgtggtttgtgtgcagaggcagtgaaggaagagggtttgaaattgaaggatgatgttgatgttgatgttgatgttagcaccgatgaagcgctgaagcgccacatgaagttcagatcttccacttctagccctcccaacaaacccacccttgacttgattctcgcaatgaagcaccttcttttccgttctttggattctccgaggaaggagcctttgactttttcgccacttgcaacatcacgcacgtgcttttcacctggatcctcaaagggggagccacaagaggctagagagggaggtagcgcccctgacgcaggcgcctttagtagtgcccaggggtcagacactactggtggcgcccctgctgcaggcgctacggctagcgcagggcagccccccagcctcttcttctag

SEQ ID NO: 13683 - DNA, 606 bp, Glycine max
  Peptide Sequence Number=SeqID_105368
atgggtcgagtgcaaggtggaaaatcatctagatctcctggtgggcttcctcaacaatcacctgttgctcaatgggacaacatcatcaattttttggattctctcatgagccgcttatgtgcaaatcatgcaaattatgttttgggagaggttgttccaatagatacctcaacagttgtgccaccagaaccactcattggtgatgtaccatccttcttcatccgcaagctagttactcaggttttttccttcatcaatattacactcttcaacagccttctgttgcggcgtgaatgttgtactttctcaaatggtgaatatgttaagtctggtctcgcagaacttgagaaatggatagcaaatgcaaaagaggagtatgcaggaacgtcctggcatgggctgaattatataagacaagctgttgggtttctggtaatacatcagaagaggaaaaaatctttggaagaaattcggcaggatctttgtccgcttttcggcctcaaattttttaagttccatcatttcattaagatgcatgagaaattgaagcttatttttggggaatacaattacagcaacttatggccatggcccatgggttcttga

SEQ ID NO: 13684 - DNA, 144 bp, Glycine max
  Peptide Sequence Number=SeqID_105369
atggagatgaccgctgacactatcacagttgctattgtggacgaggatgggttgcaccgtaatggacaaggaagggtcacgcgcaaaagggtgggggtgacaattttggatatgaggaaaagggaagggggtgtagggttttga

SEQ ID NO: 13685 - DNA, 765 bp, Glycine max
  Peptide Sequence Number=SeqID_105370
atggcgtcacttatcacccctgcgcatgttagcaacaagaagcccttgcatctatccagttggaaggcgaagcgtgtgaggtgcgcagtgtcacccccgacatggcgcgaagggctgcgcactgtgtcattgtctctggttatctcacacttgcttctcattcctaaccgtgatgctgcccaagcaaatcctttcgataagtatgttaagagatggcaaaacgaaaccacaaacttccttgatttgaggccaaggatcctcctcactaaagctaagtttctcagaagtgtattctctgctttattcgaatatgggccaagcttttatacagtgagtttacgcttgctacagagatctaacaactctaacggtttcgtaactgcttacactgtttcactgcttgagtcgttatatgtaatcctccaagtgcctaggttgcgtgatactccttcgtgggcgttcctctacgcatttgacagtggcaatggtaaaactgcattcaatgatgttgatgaatgcctgaggtcactggaagaacttgattccttgcttcttcatgcatcaagaaatgatcctgaagcctcagtcaaatcaatgaagacaaaaatcaattctgcccttggcgctctggacagcctcttacaaaccgtaccttcagatgtgctgagtaaaggagaggttatagctgattcatacagggaaccggaagacgaggaaacagggagtttggaccctgatttaaagcaactagaatcaatactatga

SEQ ID NO: 13686 - DNA, 1263 bp, Glycine max
  Peptide Sequence Number=SeqID_105371
atgctagcttacctggaacacttcgttcacgaaaacgacgccgaatcgaggcaagacgacgacgtagcgaccctctccaaagcgcttgagcttcaagccagcgtcgaggaattcggtcccaccggagtcgccggcaaggatttcggcggaatcaagtccgtcaaacccttggccctgatcaggccctctgccgccgccgacgtcgccagagtggtgaagcacgcggcggcgtcttctagcctcacggtggcggcgcgcgggaacggccactccatcaacggccaggccatggcggagcagggcctggtcctcgacatgcgcgccatccaggacccgtttgagattctctggatagaaggttctccctacgtcgacgtttcgggaggggcattatgggaagacgtccttaaacgctgcgtttcggagtttggcctcgccccgaggtcgtggacggattatctcagcttaacggtgggcggaacgctctcctacgccggcgtcagcggtcaaacattccgttacggtcctcagacatcgaacgtaacggaattggaagttgtaactgggaaaggagacacactgtgctgctcccaaacagaaaactctgaacttttttttggcgcgcttggtggcttaggacagttcggtatcattaccagagccagggtcgttcttcaagaagctccagatatggtgaggtggataagagtggtatactctgagtttgaggagtatgctagggatgcagagtcgctggtggaggaatattgttttgattacgtggaagggttcgttctggtgaacagtgataaccgggccaatggatggcccacagttccattgggcccggaacaagtgttcgacccgactcatatccctttcactgctggtcctgtcttgtattgcttggagctcgctcttcactatcgtaacgcggatcatccttctcgtgtcgatacggatgtggatggattgcttggacggctacgattcattcagggtctgaagttccaggtggacgtgacatacatggagttcttgctgcgtgtaaagcgtgtggaggagcacgcgaaaggcaacggaacctgggatgcacctcacccttggctcaatctgttcgtgtccaagtcccacatcgttgattttgatcgtgaggtgttcaagaagattctcaaggacggagtcgatggacccattttagtctaccctctcttgcgaaacaagtacgtacttggttcccttcctacccttcatcaactataa

SEQ ID NO: 13687 - DNA, 1038 bp, Glycine max
  Peptide Sequence Number=SeqID_105372
atgagtttgggaaccgcggaggaggaatcgggttccgaaatccacatcccggcggaaatcgactggcacatgctggacaagtcaaaattcttcttcctgggtgcggccttattctccggcgtctcatgcgcactctatcccatggtggtgttgaagacgcggcaacaagtttcctcctcacgtttctcctgcctcaacatctcctgcgccattctccgccacgagggattccgcggcttctacaagggcttccccacctccctcatgggcaccatccccgcgcgtgccctctacatggcctccctcgagttcaccaagaccaacgttggcaccgctttcgtccaattcggcttctccgaaacctccgccgttgcggctgccaacgccgccgcgggcgtcacctccgccatggcggcgcagctcgtgtggacccccatcgacgtcgtgagtcagcggctcatggttcaggggagtggtgggagcaaaaccgtgctcgccaatctcaattctgaaaattacagaaacgggtttgatgcttttaggaaaattctgtgtgccgatggagcgagagggttttatagagggtttgggatttctatattgacttatgcgccttcaaatgctgtttggtggacttcttattctatggttcatagactcatttggggtgcttttggttcttacttggggaataataatttggggggagggtttaggcctgattcgaaggcaatggtggcggttcaagggttgagtgcggttatggcaagtggggtatctgcaattgtgacaatgccgcttgataccattaaaacgaggttgcaggtgttggatcttgaagagaatgggagaagaaggcctttgacttttgttcagacggtgaggaatttggtgaaggaaggtggtttggttgcttgttacagaggattgggtcccagatgggcttccatgtccatgtctgccacaactatgattactacatatgaatttttgaaacgaatgtctaccaagagtcaagaggatttcacttcatcatag

SEQ ID NO: 13688 - DNA, 267 bp, Glycine max
  Peptide Sequence Number=SeqID_105373
atgacgtgtttatatggtagaattttggccttctgccatgttctggcatccgccattgataacactgctcttgaaaacccaattgattgtgtgatcaatcagtggttaaagcagggtatgttatacgtggctacctgttcacctgcccgggatactggatctggttatgtggctaggggccactccactcttgttggaccatttggagaagttctggctactgcagaacatgaggaggcaatcatcatagcagaaattgattattga

SEQ ID NO: 13689 - DNA, 1752 bp, Glycine max
  Peptide Sequence Number=SeqID_105374
atggaggagatgtcaaccacggttacagtgccatggagagtaggtaattcagtgtgtgataagccaaccatagctacccacatggatgtatccagaattaagctgatggcagatgcagggttgttatccaattctataactaaggtttccgatgaaacttttataggttcagatgagaatcatgacagtggttgtcatgaggatgaaattggtattacagcagtcacagctccagaacagcaaagagaaggggaaattccgatgttggatatgatatcccaaaatataagctctctggttgttggtgatgaagttttaaccccagaaattgaggaggatgatttgatatcactggaaggtgatccaattattgatagctcttcactttcagtagccagtgaacatagtagtatttgtggagatgagttcatcagttctgaggtttcttcagatttagggacaacaagttccaaagacataggaaagagcatctccactgtcaaaattgcagccagggctactgatttgagtatgtcaaatgtagaggcagatgtggcagtgagccttgaagagacaggagttagatctggctcaaagcctactacaggtgtttttcaccaactaactctggaaagatctgtgagtggaacagtaggtagaagtgtttttgaattagattgtaccccactatggggatttacatctgtgtgtggaaaaaggcctgagatggaagatgcagttgcaactgttcctcgatttttgaaaattcctattgaaatgctaactggtgataggttacctgatggaataaacaaatgtttcggtcagcagacaatacatttctttggagtctatgatgggcatggtggctctcaggtggcaaagtattgccgtgagcgcatgcatttggccttggctgaggaaatcgaatctgtcaaggaaggtctattagttgaaaataccaagaatgattgtagagatctgtggaaaaacactttcaccaattgttttttgaaggttgatgctgaagttgggggggaagttaatcgtgagcctgttgccccagaaactgttggatccacttctgttgttgctattatctgttcatctcatatcatagtttcaaactgtggtgattcaagagcggttctgtgtcgtggcaaagaacccatggcgctatctgttgatcataaaccaaatcgagatgatgaatatgcaagaattgaggccgctggaggcaaggtgatacaatggaatggtcaccgagtatttggtgttctagcaatgtcaaggtctattgggtacagtcggatgtataacagtacaataaaactttcctttgatcttgaaaggcgtgtacttgtgcacgatgttaggttgcatgtccttgaaaagttgctcctaagacctgtgctacttgcacggtatttgaagccatggattattccagaccccgaggtgacgtttcttcctcgtgcgaaagatgatgaatgcctcattctggccagtgatggcctgtgggatgtcatgaccaacgaagaggtgtgtgacattgctcggcggcgcatacttctctggcacaagaaaaatggcttggcattgccctcagaaaggggagagggaattgatcctgctgcacaagcagctgcagagtacctatcgaaccgtgctcttcagaaaggaagcaaagacaacatcactgtaattgtggtggatttgaaagctcaaagaaaatttaagagcaagacttga

SEQ ID NO: 13690 - DNA, 1176 bp, Glycine max
  Peptide Sequence Number=SeqID_105375
atggataataataacaacaacaacatcaactcctccgtgtttgtttcatacgcatgtcgagatccatttgtcagtccacttctcgataactttaacgaaccggatcctgcacttgtctatttattacccgaaccgaacctacgaaatgatgaacagcagcccctgcagggtcatgtttcctccacggattcaacgatccatgatcaatcccaccattattgcaatgacaattttaccatcggaggaggagtatttcctaactatgaattcgtagaggggtcttccaagaacaagcgtaaatatcccttcacggatacggatattgaagatcaatccttcatgcatgactttgaagcgggtccatccaatctgaatcagccagcaagtgggaatatgggtcctcgtaattggcctcctatgccaaggccattcttttgcacttgctgccaagttctaagacagacaattcacaccaatggtactgattttgagagactagaaatacatggaaggatcggattgatcagccacataataattcagaatcagagtattacaccgggtggtagatcatgtgacaattatcaaatgattgatttcaccaacggaagccctgcagaagttaagggtttccttgaagattacattgcacggaaggataaattagggtacattattgcggaagaatctttttctgagttttatgaagccgtctgcacaaaacttgattgggttggaaaacgcactaataacgaagacgatgatttgactccacaaaatgtggaggaagaacctgagcctgagcctgagccgcctaaggaaagaaggcgtaaacgtagtcgcaaagaccagtcagataggataaatagtatgacattggatgatttgagtggcgtgttccacataactatgaaggctgcaaagaatgtattagacatgtctgttactgcaattaagtcaatttgccgcaagtgtcgtttatataaatggccccacagacagttgcaacccctagcgaggaggttgaaagtgctgaaaagagcattggaatcttcacaagatccagtggtaatacaaacaactagcatggaagttcgaagaattaaacaacacatgactcagttgtgtggtggagttaccccaacgggtatagaaattcctgaagttgaagaatag

SEQ ID NO: 13691 - DNA, 744 bp, Glycine max
  Peptide Sequence Number=SeqID_105376
atgtgggaatcaattgttttgacggtggttgccaccgccggcaacaacatcggcaaaatccttcagaagaagggcaccgtcataagggcatatgctttgaacaaaacctgggtgataggttttctaatggatatatttggggcactgttgatgttaagggcattagctcttgcgcctgtctctgtcatccaaccagtttctggctgtggactggcaattctctcagtcttttctcatttttatctcaaagaagtcatgaatgttgttgattgggtgggcattaccttggcaggttttggcacaataggagttggtgctggaggtgaggagcaagaggctgctgctctatctattttccacataccatggctggcatttgttgttttcatcttgtttgtagaaacacttgtacagataatgcttaatggatggcttcgtatattcaaacgtaatcgaagagaacaagagatggatggcatctgtaatatcaaagatggggtttctgttcttggagcaaggcttccccaagctgttggttcctatttgcatcatcataagtgtctgttcaagtggtacaggcttttactaccaggtattgtgaagacatctttcatgttgtttacttttttgcgaactgttacatctcttaagcctatgggacatttcaatctatggatgctgggaaggtgggatttcagtcaaactggcttgatatttgtccaagttctgctttgcgaattttag

SEQ ID NO: 13692 - DNA, 126 bp, Glycine max
  Peptide Sequence Number=SeqID_105377
atgcggggtatcacacaagcgggaaaggaatggctagggcttcccaataaggaagggccacatataaaaactggaggtgtaacaagcaaaaaggctagaaaaattgaagaaaagaagaaaatctga

SEQ ID NO: 13693 - DNA, 1620 bp, Glycine max
  Peptide Sequence Number=SeqID_105378
atggaaggagaaggggctcggctcttacccattgtgattgagaataagctactacacaccaaaggcttcgtgcctttttatgcctttattatccctccctcaaaggcactgggccccacccaccatcaaaaagtgacgaggtggcactgttcctatgcagcaacaaagaatcctctatcacgcgggaccaactacgtcaacccctctttacacttcattcaaagaagaagaagaagaagcaagccaagcagcaacacctgcttcattatgggtgcctcaggaaaatgggtaaaggcattaatcggactcaagaaaccagacaaagacgaccatgtgaaggagggtggtggtaagagcaagaggtggaggctatggaggagttcttcaggggacacggggggttcttggaagggtttcaaaggaggaaactacagagcagcttctgaagtggggtctgattcttctccacctgttgtagcagcagatgcagatgctgctttcacagccgctgtagccactgtagttcgagctccacctaaggatttcagactcgtcaagcaagaatgggcagctataagaatccaaactgctttccgcgccttcttggcaagaagggctttgagggcattgaagggagtggtgaggattcaagcgcttgttcgggggagacaggtgaggaagcaggctgcggtgacattgaggtgcatgcaggccttggttcgagttcaggccagagtaagagctcgtcgtgtgaggatgtccatagaggggcaagctgtgcagaacttgctcaacgagcgacggagtaagcttgatcttttgaagcaagctgaggaaggatggtgtgacagcagaggaacgttggaagatgttaagacaaagatacaaatgaggcaagaaggagctttcaaaagggaaagagcaatggcttactctcttgctcacaagcaatgcagatcaactccaagctctaattcacgaacaaatgcctctttttcctctctcaagagtcatgagatgaacaaagctaacggtgggtggagttggttggagcgttggatggcagccaagccttgggagagtagattgatggaacaatcacaatctcaggctgaagccttagataaaaccccaactccaaagaagtttgtggaatcctttgtgagctctaattccaaaccatgcacggtcaaagtcaagaaaaacaacgtgacaacaagggtttttgctaggccacccctggttgggcaagctacacgctcatcctcaagtccaagttccgagtttcgatacgatgagagttctgcatcatcctccatttgtacatctacaacaccaatgtctgggaacacttgtgacaggactgaggatagtaatggtaatgctgttgctaggcctaattacatgaacctgactcagtccacaaaggcaaagcaaaagacaagtagtaatcatgtgtataatagagctcagaggcagcaatccatggatgagtttcaatttctcaagagggcagcggttttctccaatggagattccaaaagcacggctggttctgacccttcaatcaacttttctaggccacttcacttggacaagagttcagttatgacacgttga

SEQ ID NO: 13694 - DNA, 3096 bp, Glycine max
  Peptide Sequence Number=SeqID_105379
atggaacgtgcccggaggctagcaaacaaggcgattctcaagaggctaatttcctcggccaaggttaattcccattcgcgttctctttcatctatttcccattccttttcattacccaaaccagagaacccgatcggaaacaaccgaaaactctcacataatgtcccatctcgattcatttcactggatgcgctcaagccgagcgacacattcccacggcgccacaactcggccacctcggaggaacaaagcaagatggcccagacatgcggcttcgacagcctggactccctcatcgacgccaccgtcccgaaatcaatccgtctgaacgacatgtcgttcagcgtcttcaacgaggggctaacggagtcggaaatgtcgtcgcacatgaacagcttggcgtcgaagaacaagtgcttcaagtcgtacatcgggatggggtactacaacacgcacgtgccgcccgtgatcctgcggaacatcatggagaaccccgcctggtacactcagtacactccttaccaggccgagatatctcagggccgtctcgagtccctcatgaatttccaaaccatgatctcagatctcaccgcgcttccaatgtccaacgcttccttgctcgacgaaggaactgcggccgctgaagcaatgtcaatgtgtaacaacatccacaagggaaaaagaaagacttttatcattgccagtaactgtcaccctcaaactgttgatgtttgcataaccagagcgtctggttttggtattaaggttgttactgcggatgttaaggatgtggactataaatccggtgatgtttgtggggttcttgttcagtacccggggactgagggtgagattttggactatggagagtttgtagaggaggctcatgcgcatggagtgaaggttgttatggggactgatttgttggctctgactgtgctgaagcctcctggggaaatgggggtggatattgttgttggctctgctcagaggtttggggttccgatggggtatgggggtccacacgccgcattcctcgccacatcgcaagagtataagaggatgatgcctgggaggatcattggggtcagtgttgattcttctggaaagccggctttgagaatggccatgcaaactagggagcagcatatccggagggacaaggccactagcaacatttgcactgctcaggcactgcttgcaaacatggctgctatgtatgctgtatatcatggacctgaaggacttaaaaccattgcccaacgggttcatggtcttgctggggtgtttgctcagggattaaagaaacttggaaccgtggaagttcaggaccatccattctttgacactgtgaaaattaggactgccaatgcccatgcaattgctgatgctgcttgcaagaatgaaatcaatttgcgggttgttgatgggaacactatcactgttgcctttgatgaaacaaccaccttggaggatgttgataatcttttcaaagttttttctaatggcaagcctgtctccttcacagctgcatctcttgcaccagaagttcagactgcacttccttctggacttactagaaagagtccttatctgacacaccctatctttaacacgtaccacactgagcatgagcttctcaggtacattcataggctacaatcaaaagatctttcattgtgccacagtatgatcccgctaggatcttgtacaatgaagctgaacgctacaactgaaatgatgcctgtgacatggcctagctttgctaacattcacccttttgcaccgattgaacaggctcaaggttatcaggaaatgttcgaaaatttgggtaaattgctgtgtacaatcactgggtttgattccttctctttgcaacctaatgctggtgctgccggagaatatgctggactgatggttattcgtgcatatcatttggcaagaggagaccaccatcgcaatgtctgcattatacctgtctcagcacatggtacaaatcctgccagtgctgctatgtgtgcaatgaaaattgtatctgttggaactgatgccaagggaaacatcaatattgatgagttgaggaaggctgctgaaacacataaggacaacctagctgctctcatggtaacatatccttcaacccatggtgtttatgaagaaggtattgatgagatatgcaagattattcatgataatggaggtcaagtatatatggatggtgctaacatgaatgcacaggtaggacttacaagcccaggttggattggagcagatgtttgccatctgaatctccataagacattttgcatccctcatggaggaggtggccctggcatgggtcctattggagtaaagaaacacttggcaccatttttaccatcacatccagtggttcccactggtggcattcctgcccctggcaagtcacaaccacttggtaccatttctgctgcaccatggggctcagcactgatattgcctatctcatactcttacatagccatgatgggttctaaaggactcaccgaagcatcaaaaacagccattttgaatgcaaactatatggcaaaacgattggagaatcattaccctgttcttttccgtggggtcaatggaacagttgctcatgaattcattattgacttaagaggctttaagaatactgctgggatagagcctgaagatgttgcaaagcgccttatggactatggtttccatagtccgacaatgtcatttcctgtgcctggcacactcatgattgagccaactgaaagtgaaagcaaggccgagctagacaggttttgtgatgctcttatttccattcgacaagaaattgctgagattgagaaaggaaaggccgacattaacaacaatgttctaaagtgtgcccctcatccaccatcagtgctcatgggagatgcatggacaaaaccatactctcgagaatatgctgccttcccagcttcctggcttcgtgtttctaagttctggccttccacaggacgtattgataatgtgtacggtgatcgcaacctcgtttgcacccttctcccaacatcacaggttgttgaagaacaagctgctgcaacggcctaa

SEQ ID NO: 13695 - DNA, 372 bp, Glycine max
  Peptide Sequence Number=SeqID_105380
atggcgaagaaccccgtgaagggaaacttggaccacgggaacgaaggcaggcacgggtgctggagcgcctcggtggcgtcggagagcatgtggacgaatccggtggcgagaatgacgcctgcggcgaaggccttggccgcgacgaagaggttgccgtcggtgcggaggtgttttcggacgagcgggatggcgatcccggccatgccggcgaggagaatggaggcgatggcgaagaacttgagaagcaatgcggccgattcatctcggcatagctccaactcggcgcctccgcagcttgagttggtcatcgattcccgaaggttctggaagaaggacgaggaattttctaaaagcagcgtctcaagagtttag

SEQ ID NO: 13696 - DNA, 1152 bp, Glycine max
  Peptide Sequence Number=SeqID_105381
atggcgtatgctaatgctgcttcaactagcccaacaacatcttcaaacctctccccgcaacccatggaagggttgcacgaggtgggtccccctccgtttctcaccaaaaccttcgacgtggtggaagacccatccaccaacgacatcgtttcgtggagcagatcccgcaacagtttcgtcgtttgggactctcacaagttctctaccaccatcctgcctcgctacttcaagcacaacaatttctccagcttcgtacgacaactcaacacctacggttttagaaaaattgatcctgacaagtgggagtttgcgaacgaagggtttttggcggggcagaggcaattgttgaagacgataaagaggaggaggcacgtgacagtgacacagacacagtcacacgagggaggaagtggggcttgtgttgaattgggggagtttgggttggaaggtgagatggagaggttgaggagagacaggacagtgttgatggctgaaattgtgaggttgagacaacaacagcacaactcgagggagcaattgttgtccatggagactaggttgcaagccactgagaagaaacatcaacagatgatgaattttctggctaaagcactcaacaaccaggcttttattcagcagtttcttcaaaggaatgctcagaacaaagagttgcaaggtgcgagaagaaagaggagactaactgctaccccaagtgtggagaatttgcagcaagatcatttcgctttgtcaattgaagaaggatcggctactattgagtcacagatggagtcttttttctcagctgcgtgtaatgatccgttagaatcaaacagtgaactcaaagacccaatattgagttcagttccagttgcaagtgggagtaatttgggggaggtgagtgattctgtttgggaggacttgctgaaccaagacttggttgctggggaccctgaagaggaagttgtgattggtgatttttcacaagttgatgttcctgtggaggatttgattgcggatgctgatgagtggagtgaggatttgcagaaccttgtggatcacatggcagcgaagatggtaatactagttgaagaagtggtcgacagatattgcctcattatccgtatcctttgtaaagaatatgatgttttgtga

SEQ ID NO: 13697 - DNA, 780 bp, Glycine max
  Peptide Sequence Number=SeqID_105382
atgggtggcgtctacggtgaagtttttcagaaatggaccactggtgaggaattgcaactgctgtcgctcaacaacagaagtgaacacaagtcagccattatatctgaggagaacagaaggattactggtttccatgagggtggccatgccttagtggcaatgcatactgctggagcacttcctgttcacaaggcaaccgtagttcctcgtggctcggctcttggcatggttactcaattacctgacaaggatcagaccagtatcagctgtaaacagatgcttgcttatcttgatgtttccatgggaagcagggttgatgaagagctaatctttggagaaagtgaagttacttctggtctatcatctgatatttcacacgcaactaatcttgctaggaaaatggttactagatatggtatgagtaataaagttggactagtcactcacgattacaatgataatgggaaaagcatgagctcagaaactaggcttcttattgagaatgaggagaagaggttgctggagagggcttacatcaatgcaaaaactattctgagcacacacgataaggagcttcgtgcaattgcaaacgcttttccggagcatgagacacttgcaggaaatcagataaaggcattacttgaaaaagtaaggtccaaacagcagcaacatcagaaaacaattgaatctcagagcagttcactgtctaatccaattgctagttctactgctgctgcagctgcatccaaggctcaaggtgctacccctgtgggatcatag

SEQ ID NO: 13698 - DNA, 1134 bp, Glycine max
  Peptide Sequence Number=SeqID_105383
atggtccatgcttccttttgtacccattcaattcaactaggtaaagggtgttcttcagctggagtaactcagttttatcacgaaccagtacgtataacatgcctcagtaaccatatgcaggctatcctgcccagcaacctggtggatattccaccaattgggaccagtctactgcaccacctccaccagcagtctactcatggtggtggttatgattactatagtcaacagccacagcaaccacaaaatcctgggggtactgcacctccagctgatggctctgcatacaattacagtcagccaccttcctctggttgtaaccaatcaggacagcagggttctgcacaggacagctataatgcatataatgcgcaatcacactcagggtatgggcagccaccgacatttgatcagcagcaaggctatggcccagctactggctatggcagtgggagtaacccggcacaggagggccacactgcaaactatgcagcacggggagattcagcccaagctccttctgcccaaccgactactgttgtgcagcaaggttatcctaccaatcaacagcccagttcaaacactgtcaattactcacttcaaggaactcctcagccaggttatggggttccccctacatcccaagcagcttatggcaatcaaccacagcctggttatggaacccctcaatctcaaaagccgactggcaatccacctgtttatggagagtcacaatttcctagtgctggaggaggctatgatcagtcagcatatcctgtgcagccccctccttctgggtatgctcaaccagagtcaggttctcagagagcaccagcatctggttatggtggtgcagtgcaaccagggtacggtcatcaaatatatggtgctcctcagggtggccagcctggttatggtcaggcatcgccttcttacagcaacagttcttttggtgctggttatacacacactctggaatatactggtgatggtgatggtaatgctcaggcaccccatagtgctgttgctaaagcatcacccaagagtttatatttttgccacccttcccctccccttctcatagactatttttattgtctttcaccgtttattgtaccagtgacacctatgtag

SEQ ID NO: 13699 - DNA, 162 bp, Glycine max
  Peptide Sequence Number=SeqID_105384
atgaagtttagacggtgtgggactcgtttgcgaacgagacctgagtcttgtgggaaagggaaagaaacaacaaaacaagctaaagtaatgtcgagtatatacacagcctcggagcctccaccgggagcaaacgggaaccatctttctcaagtctcaatataa

SEQ ID NO: 13700 - DNA, 378 bp, Glycine max
  Peptide Sequence Number=SeqID_105385
atggttagcagagcaagtcttgaacagcttacctcagttaatattccgccaatattaactgagcaacaaagcgacgcaaaaggattgcacatgaccatatttatcgtggtaaagccgaaactaaaattgacattcaagttaaatttttccgttcttatcatggcttaccctatcaatggtttatgtctcacttctcaaacaagctggagctttgtggctgagtccatagacttggacataacaatatcagaatcatgcataacctatgtggtcactccaatggtccaattccacaagccatgtcctatgaagaagtattctgatagcagcggcattgacgtggcaattggcatatatagaaatcatgcgcaaaagtga

SEQ ID NO: 13701 - DNA, 768 bp, Glycine max
  Peptide Sequence Number=SeqID_105386
atggaagcttcatatggtgagtggcagccatggaagcttcatatggtgagtggcagccatggaaggtggtcatgggagttccgtacggcgagtggtagccatggacgacaggcatggaagcttcgtatggtggttgttgaaatgaaggaggggttatctcgggatcaaacaagctcagcaaccattggcgggtactctcaaaatcaatcccaagggattgagctggatgtgcaaagggaggaggggtgtgcaacaacgaagtacatgaaaaatgcagacactcaatctccacttaactgcgtaccgttggtcgatgagaatcattctggaacacttaagaaagtcaatcaccaattaagtattgaaatgttgttccacttggccaagggttatggaacggaaaacgcggcattttgtggcgtatttgatgggcatggaaagaatggtcacgtaagtgatgaacaaggagatcaagctacaagagaatctagactgctcttgcagtggaactactgctgtatttgcgctgaaggaagaaccacgcatccagcgagtgtggtgtgggatgtactaagcaacaaggaggtttgctcaattgtgtgggggcagaaactgagaaagaagcagcatggaaacacaagtatccttcttctaaggttgatgactgcactgtggtttgcctcttcctccacaagaaaccacagtttcttggtaactaacaaagttgccatgttgcttgggatgctagatgacagatacaagttatag

SEQ ID NO: 13702 - DNA, 1086 bp, Glycine max
  Peptide Sequence Number=SeqID_105387
atggaggaatacaccaataatcacctgagccaaaacacaagtccaagggcaaatttgttgtattctttggctggtggttcaagcgtaggaaaccgccaccaccaactaattccatttaacacctttcatcttcaaacgggtagatcggatcactgttttcaaccggatcaagcaccacaccctagtgtgaaaaccgagtccaacaattcccatcttcactatcctctaatgagatcaaatcttcaccacatgctgcatcctcagcaaggagggagccagagctctaacgaacttgaagccataaaagccaaaatcattgaccatcctcactactcaaatcttttacaagtttacatggattgccaaaaggtaggagctccgccagaagtggcggcgcgttttgctacggttaaagagaattttgaggcacggcagcgatctttggttaggtcaatggaaacttgcaaggacccagaacttgatcaattcatggaagcttactatgacatgctagtgaagtatcgagaggaattaacgaggcctatagaagaggctaaggatttcatgcagaggatagaatctcagctgaacacgctttgcaatggaaccgtgcggatcttctctgatgataagtgggaaaacattggttcatcatcggaagaggataaagacaacagtggtcgagaaacagaattgatcgagattgatccccaagcggaagaccgtgaactcaaaagccacttgctcaagaagtacagtggctacttaggtacccttaagaaagaactttctaagaaaaagaaaaaaggaaaactgcctaaagatgctaggcaaaagctacttagctggtgggaattacattacaaatggccatatccttcggaatcagagaaggtggcgctggctgaagcaactggtttggatcagaagcaaataaataactggttcataaatcaaaggaaacggcactggaaaccatcggaagacatgcaatttatggttatggatggcttgcatgcgcagaatgcaactctctatatggatggccactacatggctaatgaccattaccgtttatggccataa

SEQ ID NO: 13703 - DNA, 774 bp, Glycine max
  Peptide Sequence Number=SeqID_105388
atgggctttgatatctctaaaccagggcttcgacttggtcttggtcttggtctccatgatgatcactcatcagaaaattgcatgaagaccaatgaacaaagccaaaggcaaagacaaagccagaagaaaaaggaaacagatccatgtaacaaggcttacccatcacttaaatctccaagtgcagtgtcttcattttccaactcatctagcatcatcaagagagagagagaacaacttgagttagaggtagagaagatttcgctgtcaagggattttgtcgatgttgacgaaaatggtaaccccaagaagaaacttaggctcaccaaagaacaatctgcagtcttagaagatagcttcaaagagcattatactatcagtccgaaacagaagcaagaattggcaaagaaactgaatcttcggactagacaagtggaggtgtggtttcagaacagaagagcgaggacaaaactgaaacaaaccgaagtggagcgtgagttactgaaaaagtgctgtgaaactctaactgaggagaacaagatgctggaaaaagagttgcaagagctcaaatcgacgaaaacatcgatgggacccttttatatgcagcttccagtggaaagccttagaatatgcccttcgtgtgagagaataagcggtggcaacaatggctcctctcccacaacggctttgcttgaagccccaaaggcccataaagatcagcccttctataaaaataactacacattcacccaatcatccgcagcttttgctagctag

SEQ ID NO: 13704 - DNA, 1053 bp, Glycine max
  Peptide Sequence Number=SeqID_105389
atggcaaaaataagaggaaatggtgtgaaatttgcttcagagaagctggttctcacagccggcgcaactcccgccaatgagattctgatgttttgccttgctgatcctggggaggctttcattcttcccacaccctattatcctgggtttgatagagatctaaaatggagaactggggttgagattgttccaatgcattgctccagctcaaatggctttagaatcacttcctctgctttagaacaagcctatcaacaagcacaaaaactgaatctcaaaatcaaaggggtcttagtaactaacccctcaaacccactgggcataaccatgaccaaaactgagctcaaccacctagtagatttcgctattgacaagaacattcacataataagcgacgaaatctactcgggtacggtcttcgactcacccaaattcgtaagcatcacagaagttgtgaacgagagaattactagtgtcagcaacaataacatttggaaccgcattcacatagtttatagtctctccaaagaccttggcataccaggatttcgtgtgggaatgatttactccaacaacgaaacggttgtaactgctgccaccaaaatgtcaagcttcggattggtgtcctcacaaactcagtatttggtggcaaacttgcttaaggacaagaaattcacttgcaagtacatggaagagactcaaaagagactgaagaggcgcaaggagaagcttgtgtctggcctgagaaacgctgggattaggtgtttggaaagcaatgctgggttgttctgttgggttgacctgagacacttgttaggctctgccacttttgaggcagagaaggagctttggatgaagattctttgcaaagttggtttaaacatatctcctggctcttcttgccactgctgtgaacccgggtggttcagggtatgctttgccaacatgtctcaagacacgttagaagttgcaatgcgacgcatgaaggcttttgcagactcaaccatctctactagtgtcttaagaggatccattgctaagtgggaaaactaa

SEQ ID NO: 13705 - DNA, 2525 bp, Glycine max
  Peptide Sequence Number=SeqID_105390
atggaactgcgtaagctctgttgtcatccttacatgttagaaggagttgaacctgatattgatgatgcaaaagaagcattcaaacagctgctggaatcatcggggaagttgcaattgctggacaagatgatggtgaagcttaaagagcaaggacatagagtcctcatatattcccaatttcagcacatgctggacttgcttgaagattactgtacgtacaagtatgaaaggattgatggcaaggttggtggagctgaaagacaagttcggatagatcgattcaatgccaaaaattcttcaagattttgctttcttctttctactagagcagggggcctggggataaaccttgcaaccgctgacacagttattatatatgatagtgattggaatcctcatgctgatttacaagctatggctagagctcatcgacttggacaaactaacaaggtgttaatttataggcttataacacggggaactattgaagaaaggatgatgcagatgactaagaagaaaatggtgttagaacacctagttgtagggaggctaaaggctcaaaatatcaaccaggctttaggcttggcggttctagaaccatccatgattggggaacccgcagatccatttgcaactcctttgcaaatattaccggatgggaaagaactaaaagtgagggataaggcatataatcctgaaaaggatgataaaagaagtgataaagagttggatgacatcataagatatggctcaaaggagttatttgcagatgagaatgatgaagcaggcaaatcccgccaaattcattatgatgctgctgctattgatagattgctggatcgtgatcaagttggagatgaagaggctactttggatgatgaagatgaagatggatttctgaaggcttttaagtgcagtgcgcggggtgactacactttgtcactgccgaccaaggagtgcaccgcgccactgctaaccagggtgggctttgccgctgccgtccagagtcctaaaatccccaatagacttgctctgcgaactccccttgttttcccaatcatcccatcctccgccgatggcctcagcgatggcctagatccagtcatggtagacagcggtggcgttggtgttatacttcgtaacgatgttggtctccttggggatggagtactgtgtgagaaacgtgtcgggtttgtcgtttttgttggcttacattttctgaatctggatgtcggaccaggactccatggtgacggatctgatgaagttgatatggacgccgagatgcttgccagagcactcaaggcacatgaaggcactgtaggagaccgaggtccacacagatcttgttccccgcctagtactgcaggtcatggagcagctgtgccgctgccacaggatttggaagaaggcgttgcaaattttgaatatgttgatgaggctgaggctgcagcagaggaggcagcacaaaaaagagcaatggagacacttaacagttcagaaaggacacattactgggaggagttgttaagagacaagtatcaagagcataaagttgaggagtttaatgccctgggcaaggggaagcgaaaccggaagttggattttgtgccccaatggcgttgtgtaatccatgtagccaacttcactaagtggggtaaggcttttgtggttgttgttatggtttccgtggaggaggatgaccttgctggtctggaagatgtaagctctgatggtgaagatgacaattatgaagcagagcttactgatggtgattcaaattccactggaactacaactgctagaagaccttataaaaaaaaagcaccagatagcacagagccacatcctctaatggaaggtgaaggaaaagcattcagagtccttggttttaatcaaaatcagagggctgcatttgtgcaaattttgatgaggtttggggttggtgattttgattggaaggagtttacttcccgcatgaaacagaagacttacgaagaaatcaaagactatggaacccttttcttgtctcatattgctgaagatataactgattccgccacattcgcagatggtgttccaaaagaaggactccgaatccaagatgtacttgttaggattgcagtcctgctcttgataagggacaaggtgaagtatgcgtcacaacatcctcaaactccattgttttcagatgacatattattacgctatccaggattgaagggtgcaaagatatggaaggaggagcatgatttggttttgctacgtgctgttttgaaacatgggtatggaaggtggcaagctattgttgatgataaggatctgaagattcaggaggtcatatgtcaggagttgaatcttccctttataaacttaccagttccaggacacgttagttctcaggcacaaaatggtgcaaatttgacaaatgcagaagtacccaacagtcaatccaaggaaaatggtgggagtgatatagcaactgatggtgcacaaggttctggtgatgctaggaaccaagcaca

SEQ ID NO: 13706 - DNA, 1050 bp, Glycine max
  Peptide Sequence Number=SeqID_105391
atgtcaccatatctatcagagagagttttgaagaagttcaggtgcttacaaaatattccttcagagccacccgacatcctgcatatgagaggtgcaatcaggcttctgaggagtgggagcaaaaggtccattgcattgcagtgtaagtatttacaaagcaaagcgaagcaagcattcactgaatgcgctctatctctctctttcgatctgggtactaaccctaacccgcttcgaaccgtggcttcctcaggctcgcagaacctctctcgaagaaaaccttcttcttcttcgtcttcgtcttctcaacaaacacccgggtcgacccggatcgtttaccgagaatctcggatcccatcggaatccgatttcccgatctggcagcagaactggttcatcgcattgctcttcgtcatggctctcggattcttcgccctcgccattttcctcttcctcactctcgactctgacatcgctccttcttccaccgcctccgcctccgcctccgccgcttcctccgaaggcgtcgaggtgcaggttacttacggcacggttctgaagcttatgcacgagaagaccaaatttcggttgcattctcatgacgtgccctacggttctggcagtggacaacaatcggttactggtttcccaaatgtcgacgattccaatagttactggattgtaagacctgagccaggaacttctgctaaacaaggtgaccccattaaaagtggcacaatcattagattgcagcacatgagaacaaggaagtggctgcacagccatttgcatgcatccccgatatcaggcaatcttgaggagaatccgaatctgacaccggggactattggaagaagtggaaagacttggaagcaggatcagaggattcgccttcagcatattgacactggaggctatctacatagtcatgataagaaatacagtcgtattgctgggggtcagcaggaggtttgtggtgttcgtgaaaagcgtgctgacaatgtgtggttggcagccgaaggtgtctaccttcccgttacggaaagcaaatga

SEQ ID NO: 13707 - DNA, 747 bp, Glycine max
  Peptide Sequence Number=SeqID_105392
gtagatgttccctatcatttcgttggcttaatattggagaattgtgaacttccttgtgcaaatcatggccatgtcatattgggagatccttcgccagttctgttctatcggataagtagttcagaaatccgttgtctggttgatgtccctggtcagaaggtcccatctatttccaatggtgaaatgacaaattatttgaagacagtgattcctcccgagcttcatgacgcattcatagccgcagtggacaaaggcaacatcaggacaatgccaaacagaagcatgccagcagctccttatcctactcctggagccctgttgatgggagatgcattcaacatgcgccatcctctaacagggcctgtggcatccacaataaatacgttggcaagagccctttacaaggttttttgcgcatcacttgacccagcaaggaaggaaatgcgccaagcttgcttcgattatcttagtcttggaggtctattctccgaagggcaagtctctttgctttcaggattaaaccctcggcccttgagcctggttctccatttctttgctgttgcaatatacagtgttggccgtttactgctcccatttccttcacctaaacggatgtggattggagttcgattaatttctagtgcatctggaatcatcttgccaataattaaggcagaaggagtccgtcagatgttcttcactgcaactgtaccaacttactacagaatccccccggcggatgcataa

SEQ ID NO: 13708 - DNA, 657 bp, Glycine max
  Peptide Sequence Number=SeqID_105393
atgttcaaggtctgtaagaaattgaaagctcttaaagctccattgaaaaatctttttaagcaggagttcagcaacatctccaaccgagtggagctagctgaggctgaatatgggagcgatgtgtggaattacaatacttcttcatcagattcagttttgataaagaaaatcattcaaataagggattttattatctcaaaagagctaagtacggaagaggccaaaaagaggattcaatcttggagcaccaatgaacaattgcttgttggcaaagtctatgaatacattagaggtgtcaagaagcctactgttagttggtgttctgttatatggaatccaacaatcccccctaagatgtctttcattctgtggcttgctaaaaggaaccggttgcttactcttgacaaagttgcttttttgaacaaggattccctctaccctttatgttcaaatgaggctgagtcaaatgctcatttattctttgcttgcaggaaatctctccaagtttgggctcacattcgtcatttggctcatttccgcaggcgtttcacttctttacagcgcattactaactctttaattaggggcagatccacatcaggtgttcaaagaaaattacgttgtctggctatagcaattacagtctactgcatctga

SEQ ID NO: 13709 - DNA, 1131 bp, Glycine max
  Peptide Sequence Number=SeqID_105394
atgggtggccgtgaaaatgcattggggcttcaaagtgtttcagaaacgacagtaattagttctgtgtctatggctatgccttcaggagtcgtggctaacccttttcttgcttcttctgcttgggatccacttgttccattgagtcaaactttgggaggctctcttatggtttctcatagtgagtttgccaattcagcttacccttctgttttggaaaaccagggaatgaactgtgactctcactttgttcaatatgtatctgactcaaattttgagcacatggcccttaaggttccctcctttggccaaaccggttcttatgatatagctaacacagggtatctgccaaatcataatccgagtaatgagtctggaatggaaaggagtccaataaacaatgagcaatctaagctcgaaggttcaacttctgaagaaggagctgcacctgatgaacacaaaagaaagcgtggacttgactataattttactttcagttcaaataagaatgctgagggggaagcacttaaagattcttctgggaagagctgtgatgatgatgtgaaagaacaatgtgaaaagaagcctagagttgcacaaaatagtactgctaacttatgtggaaagcaattgctgaagcaaaagaaagatgactccgagagtgaagaaggttccaaagaaaatttcattcatgtgagagcccgaagaggtcaagctacaaacagtcacagccttgcagaaagggtgaggagagaaaagattagtgagcgaatgaggttacttcaagaacttgttccaggatgcgataagaaaacgggtaaagcggtaatgctggatgagattataaactatgtgcaatcactgcaacaacaggttgagtttttgtccatgaaacttgccactgtaaatccacaattgaattttaatgtagagcagatctgttccaaagattcacacattggacatggacctattggtggatatggtgccagcatcagcatgcctaacccatcaacacaattccctccaatgccacagtctgttttgaaccaaagcttttatgaaacaagttacaataccattacagctcttgacaatttgggaaccagtggatggttgaaaacagagttatag

SEQ ID NO: 13710 - DNA, 1983 bp, Glycine max
  Peptide Sequence Number=SeqID_105395
atgaagcgcataaatgagagtaacaacaccgatgatggaaacaatcataactggttggggttctctctctcaccccacatgaaaatggaggctacttcagcagccactgttccgacaaccttctacatgtccccttctcaatctcacttgtccaacttcggaatgtgttacggtgtcggagaaaatggtaacttccattctccacttacggttatgcctctcaagtctgatgggtcactttgtatcttggaagctctcaaaagatcacaaacgcaagtgatggtgccaacttcgtctccgaaattggaggactttctaggtggtgcaactatgggaactcacgaatatggaagccacgagagaggtttgagcctagacagcatctattataactcccaaaacgcagaggctcaacccaacagagaccttctttcacaacccttcaggcaacaaggtcatatgagtgtccaaacacacccttattactcaggccttgcttgccatggtttatatcaagcaccgttggaggaagaaacaacaaaggaaacgcacgtgtcggattgcagctccctaatgcctcaaatgacagaaggcttgaaaaactgggtggctccaacaagggagttttcaactcaccagcaggttttggagcagcaaatgaattgtggcatggggaatgagagaaatggtgtgtctttaggatctgtggggtgtggagagttacagtctctaagcttatctatgagtcctggttctcagtctagttgtgtcactgctccttctggaacagattctgttgctgtggatgcaaagaagagagggcatgctaaacttggtcagaagcagcctgtgcatagaaaatctatcgacacatttgggcaaagaacctcgcagtatagaggtgtcacaaggcatagatggactggtaggtatgaagcgcatttgtgggataatagttgcaagaaggaagggcaaactaggaaaggacgacaagggggttatgatatggaggagaaagctgcaagagcctatgatctcgcggcccttaagtactggggaccttcaacgcatataaacttttcgatagagaattaccaagttcaacttgaggaaatgaagaacatgagcagacaggaatacgttgcacacttgagaagaaaaagcagcgggttttctagaggtgcttcaatatacagaggggtcacaaggcatcaccaacatggaagatggcaagcgaggataggcagagttgctgggaacaaagacctttaccttgggacgttcagcacccaagaggaagcagcagaagcatacgatgtagcggcgatcaaatttcgcggcgcaaatgcagtcacaaactttgacatttcaagatacgatgtggagagaatcatggccagtagcaatctcctcgctggggagcttgcaaggcgtaagaaagataacgatcctagaaacaaggacatagactacaacaagagtgtagtaacaagtgtgaacaatgaggaaacggttcaagttcaagcaggaaacaacaataatgaaaacgactcagagtggaagatggttttatttaaccacccttcacagcagcaacaggcaaatggcaatggcagtgaccaaaaaataatgaactgtggaaattacagaaacagtgcattttctatggccctacaagatcttattgggattgattcggtgggttctgggcagcataatatgctggacgagtctagcaaaattgggactcatttttcaaacacgtcatcgctggtgacaagtttaagcagctcaagagaggctagtcctgagaaaaggggtccctcgcttctgttcccaatgcctccaatggaaacaaagattgtgaaccccattggtaccagtgttacctcttggctaccctcaccaacggttcaaatgaggccttctcctgctatctctttgtctcacttgccagtttttgcttcttggactgatacttaa

SEQ ID NO: 13711 - DNA, 741 bp, Glycine max
  Peptide Sequence Number=SeqID_105396
atggagcatagccttaaaaacgatgtttattttcaagaaaaagtaagcgtacccttctcatgggaacacgagcctggtctctccaaagtcaatcatcagaaaaatgactcaaggcacagtaatttagtgttacaacctcctcctccacgatcatcatctaggaatggacgcaagaaacaacttcgagttgaggacgcagagaatcctaattttattctatgtgcagttcaaccttcttccaggagaattagatcgttccgattggagagtgatcagaaaggagatccttttgtcaaagcttacaagaaatgcaccgaaacccccaaagatccctttatgcataaagggtctagtaataagagtaataaaaacaatggatcttggcttaacatagtgagcaacaatggctataccactgagaaaccacaaccaatattgatggcggaggaggaaccaccgatgctgccctctttcacctcgaggatcaactatgtgcccaaacctctgaactccacccaaaaattatcgattattttgacatcattatcaacaccgaaattcgcgtcctcctctcgccccactgtcaccggcggcagcagctttggctggcctctctacatcatcatagacgccaaccatttcactccattggttaggttagcaaaaacaacacatgacagaagagtggaacatgatccaacatcaccaattattaaagcaaattcaatctcagtcgtttaa

SEQ ID NO: 13712 - DNA, 294 bp, Glycine max
  Peptide Sequence Number=SeqID_105397
atggctactccacccggctctcctcctcctcctcctacagaagcagcatcacagtcgtcgtctaattcgaagcggacaagaaatgccacacggctacgatcattggcgactagaccagctagggttgacagaccggtggtccacgttgatcctgcgatcaggaaggccgatgccgacaagaacagtgtcgatgacactgtatgcgaaaaatacggcattagtatggagaaatgggcccagttttgtcagagccgcagagacccctcgtgggaggatgtgcagaaaaaggctcag

SEQ ID NO: 13713 - DNA, 2499 bp, Glycine max
  Peptide Sequence Number=SeqID_105398
atgacttgggcacttttgttgttaagttttacattagttaacttggcaatcaatgcttttgaagtttcatatgattcgagagctataacaatcgatggcaaaagaaaagttctattctctggttcaattcattatcctcgtagcacagctgaaatgtggccttctttgattaataaagcaaaagaaggtggacttgacgtaattgaaacatatgttttttggaatgctcatgagcctcaacctcgacagtatgatttttctggaaatctggatctcgtcaaatttattaaaaccattcaaaaggaaggactttatgccatgctgcgcattggtccatatgtatgtgctgaatggaactacggagggtttccagtatggttgcacaatatgccaaatatggaatttaggaccaataatactgcttacatgaatgagatgcaaaccttcacaactttgatagtggacaagatgaggcatgagaatctttttgcatcacaaggaggacccattattcttgctcagattgaaaatgagtatggaaacattatgagcgaatatggagaaaatggaaaacaatatgtgcaatggtgcgctcaactagctgaatcttacaaaattggtgtgccttgggttatgtgtcaacaaagtgatgctccagatcccattattaacacatgtaatggttggtattgtgaccaattttctcctaacagtaaaagcaaaccaaagatgtggactgagaattggactggctggtttaagaattggggaggaccaattccacatagaactgctcgggatgttgcatatgctgttgcacgatttttccaatatggtggcacattccaaaactattatatgtaccacggaggtaccaatttcggacgaacttcaggaggaccatatattaccacttcatatgactatgatgctcctttagatgaatatggtaacaaaaatcaacctaagtggggacatcttaaacaactccatgagcttctaaaatcaatggaagatgtcttgactcagggaacaacaaaccatactgactatgggaacctgttgacagccacggtttacaattattctggaaaatcagcttgcttccttggaaatgcaaattcatcaaatgatgctacaattatgttccaaagcactcaatatattgttcctgcttggtctgtgtctatcctaccaaattgtgttaatgaagtttacaacactgcaaagatcaatgctcaaacatccataatggtcatgaaagacaacaaatcagataatgaagaagagccacactcaacattgaattggcaatggatgcatgagccccatgttcagatgaaagatggccaagtccttggttcagtttctcgtaaggctgctcaacttttggatcaaaaggttgtcacaaatgatacgagtgattacttatggtacatcacaagtgttgacattagtgaaaatgaccctatttggtcaaagataagagtgagcaccaatggacatgtgcttcatgtgtttgttaatggagcacaagcaggttaccaatatggtcaaaatggaaaatattcattcacctatgaggcaaagatcaagctgaagaaaggcacgaatgagataagtctacttagtggtactgttggtttacctaactatggtgcccacttctccaatgtgtcagttggtgtttgtggtccagttcaattagtggcactacagaataacactgaggtagtcaaggatatcaccaataatacatggaattataaggtgggattacacggtgagattgtgaagctatactgtccagaaaacaataaaggatggaacacaaatggtcttcctactaatagagtatttgtttggtataagaccttattcaagagtcctaagggaactgatcctgtcgtggtggatttgaaagggttaaaaaagggtcaagcctgggtaaatggtaacaacattggtaggtattggacaagatatcttgcggatgataatggttgcactgctacttgtaattaccgaggaccatatagttcagacaaatgcatcacaaagtgtggaagacctacccaaagatggtatcatgtaccacgctcattccttcgtcaagataatcaaaacacattggtattgtttgaagagtttggaggtcaccccaatgaggttaaatttgccaccgtaatggttgaaaaaatttgtgcaaattcatatgaaggaaacgtgctagaattatcatgtcgtgaggaacaagtcatctctaaaattaaatttgccagctttggtgtgcccgaaggtgaatgtggatcctttaagaagagccaatgtgaatctcccaatgctttatccatcctgagcaagagttgtcttggaaaacaaagttgctctgttcaggtttcacagagaatgcttggtcctactggatgcaggatgccacaaaatcaaaacaagcttgctatagaagcagtttgtgaatctatagccaagaaatattag

SEQ ID NO: 13714 - DNA, 594 bp, Glycine max
  Peptide Sequence Number=SeqID_105399
atgttggagggggtatggctggtagaaagtcagagggtagtggtggctaatatctatgcttcttgtgagctagaaagcaaaagacagttatggcagaggctatatttaatgaagaatcagtcccaggttcagtgctggtgccttgtaggggacttcaactgcatcagacacccagctgaaagagtgggaagcactctttgtaatacagacactaatcttatagctgaatttaacgtgcacttagattacaagagtataagcaagaggcagaagaaaggaagggagagatatggaggagttttttctagcaatgaaactggtgttttcagttgctgttgtggggattctaagctagattctttctgtgtatggaagaggctacaaatgcaaggtataaaagggcctccaccctcttttctacatgggaatctgcctgatatgcaaagaattcaatctcaggccaaagctgcttccacttgcaactccaaccattctgatcagtttctagcacatgactacactacaaccctcttcccctattttgaacactggaggaaacaatatggtacccttctcttacttttgatctattaa

SEQ ID NO: 13715 - DNA, 295 bp, Glycine max
  misc_feature (267)..(267): n is a, c, g, or t
  Peptide Sequence Number=SeqID_105400
atggtcatggacatggctgacacatttggagaaggattttggggggttaatgctcttcaaggtttgtgtattgatggaggatggatccatgaccctaacagtgtcaagattgcagttcttcagcactttaaagaaagattctcagagcagaattcttgcagactaaccttggaagggatccagttctcttcccttgatcaaaggcagaaggaaagccttgttgatagattcactgagctggaaatcaagtctgcagtttgggcttgngggggagataaaagtcttggcttggatg

SEQ ID NO: 13716 - DNA, 330 bp, Glycine max
  Peptide Sequence Number=SeqID_105401
gagacgttcccacgtacttcccggtggttgacgtcgaaggcgcacatgaagggcatcacatgagcatcgagatttcatcgttccatggtcagctcagatggggtcctatgatcgttacagttcgaccggagagggtggtacgccagttcggttacatccagagcttccctccgccgcctgtatctgcggattacatggagtggtttttccgcatatctcaccctttcatgacaccgacccaggcaggtgaccagcagagggatgcaccagctgcagaccctgaggactacatacagccgctcagccctttttcaatgttcaagtacccat

SEQ ID NO: 13717 - DNA, 690 bp, Glycine max
  Peptide Sequence Number=SeqID_105402
atgatcatgaggggtcaagacatttatattagtcaagaggagactacttcttacctttcctctagtggaagtgaagatgaagtaaagggtgaagagtctagtgaggaagataagagggatgaggaagaaaaactagaaaaacaaaagaaaaagaaggacagtaaggccttgtcttcaaatgccaaggggaaggaaaaggaggaaaaggattcctccaagaagattgttaacaaggaaaatcattttgcaacaaaaggtgatattaaaagagcactccttcttaaacaatctttctaccttctcctatcaagggaaacatcccttagcaccgccatacctcttgagcttgaggttattcctctagtaaaggagttgttggatgagggtattattaggcaccaaatccctatgataggtggtatgatgaatgtgttgagtagtgcaacactcttttgtaaaatcactcatgcacccaacatcttcgtgatttgtgtacatagggtctcattaggtagtgatcaagggcttcccatggaccctaagagaataataaaggtcattcttgagtggcctactccaccaagtgttgaggaaagaattaatgagtttcaagaacctctggatttgaggtcaaatccttttcaagggggagggaatgatgcaatcctaccccccaaggacattggatag

SEQ ID NO: 13718 - DNA, 402 bp, Glycine max
  Peptide Sequence Number=SeqID_105403
atggcagataatgttaagaatcattttaagctttggagaacatggtatggaattgtgagtgacattcttagtcaaagtggatttgactggaatagcacaaagtacatgattaccgttgaaaatgaaattgcatggaatgaatatgttaaggatagagctactggactcggagcagaaaatgcattagatgtagatgatatcatgagcaaagaaacaaatgaagaggaagcaattcatagtgcgagttttgacttagagggatcaagttccgccacaagaaaaaacattcgtccaagtaagagtggagagaaagaagggatgatttcctcaatgaaagaagtagttgagtcattgaaagaatttgttgaagtgactaagaagaagatggagaacaaaaaatag

SEQ ID NO: 13719 - DNA, 300 bp, Glycine max
  Peptide Sequence Number=SeqID_105404
atgtcgcagaacttcacagattgcttaacgatgggtgtcaagttcctcgaagcggtcaagcgaaggttgtatgtcatcacacaatggtccccggacgaaattagggtattacaattgcccctctttacttaccatttatcggagataggaggaaaactcaatggtggaggatgcatgaacagcgctaggcaatcaattcatgggactccgaactcgatgatggaggatgcacgaacaatgctaggcaatcaattcgtggggctccagactcaatggtggaggatgcatgaacagtgctag

SEQ ID NO: 13720 - DNA, 534 bp, Glycine max
  Peptide Sequence Number=SeqID_105405
atgactcttgaagattcagaagaaaaacacaaggaaatgctaaaacaaaaacctttacttcaaaaagaatgcacccttgccaatattgaacttgataagctaaaaaagaagaactcagatctttggacaaaaagatattacaaaaagatgtcttttgatttaaactataagcttaagggacatgaggtgttgaaggaactacctcctgagattgtaaaaatctatgaggagataaaaaccctaagagataaactaggaaaatttgttggtggtcgtgaagcccttaacaaaattattaaggtgcaaagaaaccccaaagacaaatctggtcatggtttcgaaggaaaaaatattacacatggcgaagaagtcattgtttgctacttctgtggaaaagtgggtcatgaaactaataagtgcaatgacctccttataagggcaacctatcaaagggttcatccagtgcttatcaataaccataagctaacaaagaaaaatgacctaaaaagatttgggcacctaataataaaataa

SEQ ID NO: 13721 - DNA, 438 bp, Glycine max
  Peptide Sequence Number=SeqID_105406
atgatacgcggagataccttatggttattcgcaccctttggtcatccagaggcggcgggcccgatgacaagcagagaccgagtttggtcattctgcacccttgtatcatccagaggcggcgggcccgatgatacgcggagataccttatggttattcgcacccttttgtcatccagaggcggcgggcccgatgacaagcagagaccaaaggcggcgggcccgatgatacgcggagataccttatggttattcgcacccttttgtcatccagaggcggcgggcccgatgacaagcagagaccaagtttggtcattctgcacccttgtatcatccagaggcggcgggcccgatgatatgcggaaatacccgagtggttatccgtataaacatccttttgctatctgtaagacagaacgcttgatagcatgcagaggctga

SEQ ID NO: 13722 - DNA, 272 bp, Glycine max
  Peptide Sequence Number=SeqID_105407
atgatacaacatgaagaacttataagaatccttaatgattttgcaagcgtttgcccaaaggtttttttgagagaggataggacaatgaatgtgtcgcaacctactcttcagcgggagggcgacacgagactcacaggtgcgtcttccatgaaaggaaaatacgcggagtcgcaaacaacgtttattcgaggaaaacgtcagaaaaaccagaaaaaggtgtggtctacgaaaagcgtgaaaaggttcgggagttgtttttacgcatggggaag

SEQ ID NO: 13723 - DNA, 543 bp, Glycine max
  Peptide Sequence Number=SeqID_105408
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 13724 - DNA, 369 bp, Glycine max
  Peptide Sequence Number=SeqID_105409
atggttgcagcaggtgatgtgtgtgttgtgctaggtcagtgtgccagcgattacatagactggttcttccgcatttcgcatcctttcatgacaccaggccagacatcagatcctctgccaaatggtcatgctccgcagcctcgagtcgtccctcaggtcccagagacagatatccctcacgtgccagagtcaagagcaccattgacatctgcgaggcctgctgtggacgagcctagacatgcagtggcaatttgctatgggattgttgagaggttggagtgtcatctgagcctaggggtggtcatgtcaggctcatcgacacatgaggtgatcgaagaatgcctcaggatggataggagtgtcacataa

SEQ ID NO: 13725 - DNA, 459 bp, Glycine max
  Peptide Sequence Number=SeqID_105410
atggaactctcgcaatgcttggccacacttgttttggggtcattatcaagagtggtggatctcatgtggtttggagaactagcgttgaagttcctccaacaagaattccaacgatgtggagcttgtgagaaagaggatgtgaagatgctagatggtgaagttggacgctttaaggagttgatttgctcttcaatcaaaagtcttgcggagatttctagtacgaactttgttgctaaagaggttgagaagaataacaactcttgtgatctcgaagcaggaaagtcaaatgggggtgagaaggaaatgaagagccaagttgttcttagtttgagtgcggtgggattctccttgtgtgcatgtatacgggggacgatggaaattgaagaagcactcaaggaacttgttcaatgggagaatccctctagtgagattaattcacctgggggaaatggtgggtga

SEQ ID NO: 13726 - DNA, 213 bp, Glycine max
  Peptide Sequence Number=SeqID_105411
atgactgtgtctgaatggcaaaaggggtgcggaatgaccataatttgtctccgcatgtcatcaggcccaccgcctctggatgacaaaaggaaggtgtgcggaatgaccataatttgtctccgcatgtcatcgggcccgccgcctctggatgacaaaagggtgcagaatgaccataatttgtctctgcgtgccatcggacacgactgtgtctga

SEQ ID NO: 13727 - DNA, 396 bp, Glycine max
  Peptide Sequence Number=SeqID_105412
atggcccaggcttcccggatcaacgcaccttatttttgcgaagtgaccgtcactcagcgtaatcggcaaaagcaccagccggacatcagcgctggcaagtgtaaagcggggtgccatgacggtgtccagtcgaatgcgttcgtggcagaaaaaaaggctgacggccagtcagaatatgtgaatacaggactcactatcagggcgattcctcgctcactgactcctaccgctcggtcgtcatgcggcacgctgaacatggcccttacaacgggcgcggaattcgatctgtattatgatgctcgaagtttaggttactttaaccagggaagtgagagggccgcggcaaagccgtttttccataggctccgcccccctgacaagcatcacgaaatctga

SEQ ID NO: 13728 - DNA, 758 bp, Glycine max
  Peptide Sequence Number=SeqID_105413
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggaggtgctctcccaactgagctaatcgcccgcttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13729 - DNA, 812 bp, Glycine max
  Peptide Sequence Number=SeqID_105414
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggagcaaccataactcgagaaggtttagaaggatgcaagcgaaacagagtaatgaacagtatcaatgattatgcagaatccctctttcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13730 - DNA, 531 bp, Glycine max
  Peptide Sequence Number=SeqID_105415
atgccaggtgccaacttgttggcaatgggttcttcatcagattctacttcttccaggtcaatgaggtcacctggagcaggttctggtgcccttggtgcagaggacttcagtatttggggtggaagatgtcggaacatctttctcagcatcaggaacagcaacatctggggtggaagatgttggaacatcttcatcagcatcaggaacagaggcatttttcagaatgttactcacaatgctgcggatcttcttgtccatctccgtgtctacttccctaggacttgttgcaaggctagggttttcagcaatcttcacaccctgttgtcgtttggggatccagtttttcagggacaggagctgaccaggaatcatttgtatgggttggatatgaattcaggttgttcctggtttgatggtgctttggtggatgatggagatgatggtacagagggtgaaccaggagctgaggtttcttttggtgcggtagccatggagaagcagagctcttggaatggtttcgtgaatttctga

SEQ ID NO: 13731 - DNA, 387 bp, Glycine max
  Peptide Sequence Number=SeqID_105416
gacctccaagtccttcaagtggatcctagctccaagtcctttagaggactacacatcctcgccgtcataggactacacgtcctcgctttcagaggactacacgtcctcgccttcagagggctacacgtcctcgccatcagaggacaacacgtcctcgccttcagagggctaccggccctcaccttcagaggactacacgtccttacctttaaaggactagacgtcctcgcctttagcgggctacatgccctcgcctcgacttcagaggacagcacatcctcgcctccagagggctacatgccttcaccatcaaaaggcaacacgccctcgctttcagagggctgcacattctcaccttcagaggactacacgtccttgccttcatag

SEQ ID NO: 13732 - DNA, 474 bp, Glycine max
  Peptide Sequence Number=SeqID_105417
atgcaaatctttattgaagccatagatttaaacatttgggaagcaatagaaataggaccttatgtacccaccatagtagatgcaagcactagcacaacaacaaaaaaacctagagataaatggactgaagaagatagaagaagaatccaatataatcttaaagccaaaaacattattacgtctgccctaggaataaatgaatattttagagtgtcaaactattcaaatgcaaaggagatgtgggatactctccaacttacacatgaaggcaccactgatgaacatgaaatggaacttcaacgtctcaaccaaaatgaagagaccgaaaaaaggaaaagaagcatagcactcaaagcctcatcttcaatgcaagaagaagaagaagaagaatttgatgatgaagaggacttctcactctttatgaagaagtttcataaattcgtcaaaaatagaagaatgggagagaagccataa

SEQ ID NO: 13733 - DNA, 272 bp, Glycine max
  Peptide Sequence Number=SeqID_105418
ccgtgtccggcgacagcggcggcaacggacaccgcgtcgcaccggagtcgcacccgtttgtgtgtccagtgtgtctccgacgcgggacgcggcacttcggcggcgtgtccgtgcttcatagtatgtggcccttgattttgaacaagaaatggagactactaagagttgttctgcaatggaaaagagctatgaattgcttagcacatactgctgcaacctttcagactagaaacatgaaagagcaagctaacaacaacagcttagcatcataa

SEQ ID NO: 13734 - DNA, 201 bp, Glycine max
  Peptide Sequence Number=SeqID_105419
atgcccctcagtggcatatctgagagttatcgacattctcattcggagtgtgtacaacaaatgaggcttcattgttgtcaagcaagtcggagacccagcatgaccacagatcgaccttcactccttatggctcacatagacccgagtatagggcctaatatctcaacatgtgtgcgaggtgtaggtgccatatgtgcatag

SEQ ID NO: 13735 - DNA, 201 bp, Glycine max
  Peptide Sequence Number=SeqID_105420
atgtactatactgttgtcattttgctcacactaacaaaggtttgtgatcatcacagcctcattaccttgatgctaaccacatcaaatgtttattgtttggctatcattaatgatgtgatccttagtaggagtggatcacttggtacaggtcacagaatttggatgacgccacttccagaggtggaagataagtcagggtag

SEQ ID NO: 13736 - DNA, 253 bp, Glycine max
  Peptide Sequence Number=SeqID_105421
atgggtgatcaagaggagacgcaggaacagatgaaagccgacatgtcggctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaagagaaaaaggctgcaccg

SEQ ID NO: 13737 - DNA, 618 bp, Glycine max
  Peptide Sequence Number=SeqID_105422
atggtgaaagttggaacctcttacgtgccgatcaacgtctcattttcgccaaaagttggcccagggcttcccgtgttcaacatgacaaaatccatggaacatttattttttctgctccagtggcgtatcatggtttctatcagctgtccttcctgttcagctactgacggggaattggtatccgcgtcacaattcggcacacaagcataccgagccggaagcataaagtgtaacagcgctggggtgcctaagagtgtagcggtaactcacattaagcgttgcgctccactcacacccgccgcgcttaatgcgccgctacagggaaacgctgtcgtgccattcgctgcattcaatgaatcgctgcgcaactgttgcgcgaagggcgacggtgcgggcctttcgcgtattacgccagctggcgctaaagggcggatgtgctgcatacggcgattactatgttggcctgtaacgccagggtgttcagtcagaatgcgaaattccgcttacctatacgctactgactcgctaacgctcggtcgttcaactgcggcgagcggaaatggctacgaacggggcggagatttcctggaagatgccaggaagatacttaacagggaa

SEQ ID NO: 13738 - DNA, 938 bp, Glycine max
  Peptide Sequence Number=SeqID_105423
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaacaaaatgagaccctggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 13739 - DNA, 276 bp, Glycine max
  Peptide Sequence Number=SeqID_105424
atgaccatagattcacctccactccttaaattcccatggacccggagtcgccaactgtcgcaacatgcctttttgcgggcgagcgaggcgaggctctcgggtgagtcttccaaaggaggaaaatgcgcggagtcgccaccaacgtttatttgtggaaaacgtcggaaaagccgaaggaaaccgatcataaagaatattccagatttgggagttgtatttacgttcgaggaaggtattagcacctctcacgtttgtcccaaaggacaacaaccttaa

SEQ ID NO: 13740 - DNA, 627 bp, Glycine max
  Peptide Sequence Number=SeqID_105425
atgacaggccctctcaatgactcaatctcttgctttctcataagggtggacttccttgaggacaacacgtcctcaccttcagagggctgcaatcttcccttcaccttcagagggctacacgcctcgccgttcagaggactacacgtcctcgctgttcagaggactacacgtcctcaccttcagagggctacacgccctcgccttcagaggactacacgccctcgccttcagaggcatacacgccctcgccttcagaggactacacgccctcgccttcagaggactacacgtcctcgccttcagaggactacacagtcctcaccttcagagggctacatgtccttgcccttcagaggactacacgtcctcaccttgaaaggactgcacgtccttgtctttagagggctacacgtcctcgccttcagtggactacatgtcctcgccttcagagggctgcacatcctcgccttcagagggcatcacgccctcgccttgagagggctgcaagtccttgctttcagagggatgcatgtcctcgcctttagagaactgcacatcctcgccttcagagggctgcacgcccttaccttcagaggactacacgtcctcgccttcagaggactacat

SEQ ID NO: 13741 - DNA, 752 bp, Glycine max
  Peptide Sequence Number=SeqID_105426
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgacaagagcatccttcagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13742 - DNA, 411 bp, Glycine max
  Peptide Sequence Number=SeqID_105427
atgttgagtcagcatcccaatatgttaaactacactgactctgtgctgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 13743 - DNA, 489 bp, Glycine max
  Peptide Sequence Number=SeqID_105428
atgaagcacttcactgacaccctcatcagtgccaacataaggggcactccgagtagccgcggcggccgaggccttgggcctagacgggcggatggagaggcccgacaagttcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13744 - DNA, 129 bp, Glycine max
  Peptide Sequence Number=SeqID_105429
atgtgggcatgggaacgctgcacgactttggccccaaagaggactcctcatgtactagaaaataaaccactggggcacagtggtgccactcatttgtttccatgttgtagagtggcaccaacccgatag

SEQ ID NO: 13745 - DNA, 210 bp, Glycine max
  Peptide Sequence Number=SeqID_105430
atgacaccggtaaaccgaaaggcaggaacaggagagcgcacgagggagccgccagggggaaacgctggtatctttatagtcctgtcgggtttcgccaccactgatttgagcggtatcgaattcctgcagcccgggggaattccgcccctagttctagagcctcgtgccgctacaccagcggtagcgagctcaacaattcgcggcctatag

SEQ ID NO: 13746 - DNA, 866 bp, Glycine max
  Peptide Sequence Number=SeqID_105431
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatttgaggaaaacgtcggaaaaaccagaaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13747 - DNA, 147 bp, Glycine max
  Peptide Sequence Number=SeqID_105432
gttgcgacaccagtgaaaggtcttccagagaaaagggatggctgcggcaagaaggaagtgtcgctagaggaagcaagcgagtttctctgcattattcagcagagcgagttcaaggtcattgagcagctcaacaaaaccccggccagg

SEQ ID NO: 13748 - DNA, 366 bp, Glycine max
  Peptide Sequence Number=SeqID_105433
atggcacgcagcgtgtccgcttcgtgcccctattcaagggacttatatgggagagagctaaaaaggtttttagtgataattcccaaggcgatcatatctctcttgatggtctctagaggtatcatcccctttgaagaacatattgtagcagtagggactactagcaacaatatgttatcaaagaaaaaaactctagatgagggttcacttggagttgccaactgtcgcaacctaccattcggcaggagggtgacgcgtgactcgcaggtgcgtgttccaagaaaggaatacgcgcggcatcgccaccaacgtttatttgaggaaaacgtcggaaaaaccggaaaagatgtgacctacgaattttaa

SEQ ID NO: 13749 - DNA, 438 bp, Glycine max
  Peptide Sequence Number=SeqID_105434
atggtgaaagttggaacctcttacgtgccgatcaacgtctcattttcgccaaaagttggcccagggcttcccggtatcaacagggacaccaggatttatttattctgcgaatggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatactgccgtcaaggatggaaaggctgtgagtgtagctctcgactacaagggcaacatcaccgtctattaa

SEQ ID NO: 13750 - DNA, 193 bp, Glycine max
  Peptide Sequence Number=SeqID_105435
atggatggtaattgtgattatcgggcaatagttgcgttattgggtatgagtgaagaatcatggtcattggtgcgcaaccatctgcataaagaactgacaggctggttcgaagagtatatcaacctggttggtggcatagagagattcgaggaattaaagtgtttcctccttgttgacggattatctatggtgt

SEQ ID NO: 13751 - DNA, 183 bp, Glycine max
  Peptide Sequence Number=SeqID_105436
atgtcgcaacgtgccctttgcgggcgagcgaaggcgaggctcacgagtgcgctttccaaaggaggaaagatgcacgaagtcgacaaaagcgggactcttgctcctacgtaccctccatcaaagaggaaatcagacctacgtagttctttcacatgcgtgaatcaagtgattcttcttacttga

SEQ ID NO: 13752 - DNA, 135 bp, Glycine max
  Peptide Sequence Number=SeqID_105437
atggttagaggtcgagacaaggtacttatggatggacgcaaggagaggctagggtcacgaccaatgggtcgtcatcctttgcctagcctgggacaaacggaaagcgccgctgcaaagcagcctagtatcctttaa

SEQ ID NO: 13753 - DNA, 540 bp, Glycine max
  Peptide Sequence Number=SeqID_105438
atgaccactcttacatggatatggatgatgtcgctatttagcaacattctgcccagcgaccacaatgccaatctcccccctgcagatgtatcggttgctctgtgccgtcatgacatagggatcgcgcccacaagacgcccagtgggcccgaagaagtccaacagggccctggggtttccaactctggttacgggcctctgtcaaccctatagggtgcccgttcccccagcgaggtcatgccatcgtgacataggaatggcacccacaaagacacccagtggacccggagaagtccaacagggccctgggggatcgcgcctgcaagacacccagtggacccgaagaagtccaacaagagtgcttgtcacctccggcaagggcatcaggccccctactaatcgagctttcatcaagaagtactgcgtccccaggcaggcgcagggcgaaacaccacaacagcctggggatggctggcagcgggcaacaaacgcaccgccatcacctctagagttcacctcagctcatccacaaaaaggttag

SEQ ID NO: 13754 - DNA, 369 bp, Glycine max
  Peptide Sequence Number=SeqID_105439
atgcaggagatgcggtgcaagtcatatctggacgagaaagggggtaaagttggggagattactaaaatcttcaagcatgacaatagtgttatagtgaaagatttaaatttgaagacaaagcatgtcaagagtagagaagagggtgaactggggcaaattattaagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13755 - DNA, 49 bp, Glycine max
  Peptide Sequence Number=SeqID_105440
caccaaaacattgaccctaacccttggtggagcaactaggacttacaag

SEQ ID NO: 13756 - DNA, 1458 bp, Glycine max
  Peptide Sequence Number=SeqID_105441
atgtctgctatggatgttgttacttggaccacgatgattgatgggtatgcggcgtctaactgttcagatgcggctatggagatgtttaatttgatgttggacggtgatgttgagcccaatgaggtcacgttgattgcggtgctttcggcttgctctcagaagggtgaccttggtatggggaaatacattcatgagattatggagaagaagaatatgaggtggggtttgagtttacacaatgccttgttggatatgtatgtgaaatgtggtagtttgattgctgctagggagctttttgacagaatggaaactagggatgtaatttcgtggactagcatggttaatgggtatgctaaaagcggttacttggagtctgcaaggaggtttttcgatcaaactcctcggaaaaatgtggtctgctggagtgcgatgattgcggggtattctcagaatgacaaacctgaggaatcattaaaattgtttcacgaaatgcttggggcaggttttgttccggttgagcacaccttagtgagtgtgctctctgcttgtggccagctgagttgcttgagtttgggttgctggattcatcaatattttgttgatggaaaaataatgccacttagtgctactttggcaaatgccattatagatatgtatgccaaatgtggaaacatagataaagctgcagaagtcttcagtacaatgtcggagagaaacttggtttcttggaattctatgattgcagggtatgctgccaatggtcaagcaaagcaagctgttgaagtttttgatcagatgaggtgtatggaattcaacccggatgatattacgtttgttagtttgttgacagcttgcagtcatggtggtttggtttcagaaggtcaagaatactttgatgccatggaaagaaactatggaataaaacccaaaaaggaacattatgcttgcatgattgatctactaggtagaactgggctcctggaagaagcttacaagttgataacaaacatgccaatgcaaccttgtgaggcagcttggggtgcccttctaagtgcttgtagaatgcacggtaatgttgagctggccagattgtctgctcttaatcttctaagcttggatccagaagacagtggcatttatgtgcagctggcaaatatttgtgctaatgagagaaaatggggtgatgtaaggagggtgcggagtttgatgagagacaagggtgtgaagaagactcctggtcatagcttaatagagatagatggtgaatttaaagagtttttggtggcagatgaatcacacacccaatctgaggagatctataaagctatttggcttaaacttcatattacaggcatagagctattagcttctttcacaggttctactggatatggattgttaacatgggccaatggagttatatcggttcagacaattaagtacagactgtgcagttag

SEQ ID NO: 13757 - DNA, 200 bp, Glycine max
  Peptide Sequence Number=SeqID_105442
gtgaaggagacattctcaccacttgtgtttttgcagtctttcatcttgttcttctctttgttgtaaaggaggttttcggactatggaaagctaaatcctctgttggatcttcccttggaaactggtctgattctaaagtccttgatagaacgggactaagttgttgtgctatcacgaggaatcggggtacaagaacttag

SEQ ID NO: 13758 - DNA, 255 bp, Glycine max
  Peptide Sequence Number=SeqID_105443
atggcgagtcaaaagtttttagcccgtcggaattcacccgagtcttccatgataattttgagcgtcgcgataggttacttggtccttattcggagatccggtggaaaagttatggccgtttgtatttgcgatgggcttcatttttatcctaagagcatctcgatctattatgagcttcaatcaggaatccgagtcaaacattatggttgtccgaatttgcatggtcagtccaatttcatctttcgagggcgatga

SEQ ID NO: 13759 - DNA, 246 bp, Glycine max
  Peptide Sequence Number=SeqID_105444
atgcatgtgcatctttgttgtcctgtgagtcagaggacaggagaagagttggtcggtaccacaccaagttcaagaccaaaggtaagcaaagacttaggggcaggtacgagcaggtactgggcccgtgatcggcaggtcgtcgtcttacgtccgactcaagacgttaaagaagcgctattaggaggcagcctagtaccttttaaatttctgcttgttagttattcacctatgtttcttaagtcatag

SEQ ID NO: 13760 - DNA, 156 bp, Glycine max
  Peptide Sequence Number=SeqID_105445
atgtcaagttccttgaagcggtcaagcgaaggtcgcatcccaacaaacagacggtccccgaacgaaattaggggtcatcccgctaagcgcaccgcttttgtccatccgctgagcgagaaaagccgcgctaagccgaaattcactaatgcgcgctaa

SEQ ID NO: 13761 - DNA, 687 bp, Glycine max
  Peptide Sequence Number=SeqID_105446
gtacggttgtacatagaagcagatcctgcccacctggttgtcgtggggagagtttatgagggatccactcttgttcataatcctgcccgcctggttgccgtggggagagtttatgagggatccactcttgttcataacactcctttgttgtctggccaagtaaaggtgagtgtggacgaggttaaagatgcagatgctcccgttcttgtatccactgctgaggttttcttagtggggcagacacttcacactttccttgcttggccgacacatctgatcaagtctttatcacacgaggttagatgggatgtcaccatgttcgggatcgttaatccagatttccccctgtacataaagcacgaagacctctccgaaatcgcacacggtggtcaatgtctcggcatatcagtgttacggcatctcactgaaacatgtatgcgagcagggaattctgatatctatggattcctcgagcctcagtccattcagaggtctggacaatcgcagtttgaatctgaaagttacataaagagttggatggagagttcacaacgcgatgtgtatcttggagcctacctaaatgagccagacaactaccttaaggggattattaatagtgctatcaagggtcttgatgatgctctacagcctaaatcaaaagctcctgctaggtggattgtcgtcaag

SEQ ID NO: 13762 - DNA, 426 bp, Glycine max
  Peptide Sequence Number=SeqID_105447
atgcatttgctaagcattcagccaaacccatctttagatatagtaaatcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13763 - DNA, 315 bp, Glycine max
  Peptide Sequence Number=SeqID_105448
atggtgatcaatggggttcccacgaaccctaagagaataaaggtcactcctgagtggtccactccacctagtataaggaaaatttgggacttccatgacttaacaaacttttacaaaaggtttgtcccatatttttctatacttgtagcaccactcattaagttggtgaggaactatgttccttcatgggaagatgcccaggaaatgggtgttgagggaagaagcccagagtttcaagaacctctgaaattgaggtcaaatccttttcaaaggggagggaatgatgcaatcctaccccccaagggcattagatag

SEQ ID NO: 13764 - DNA, 246 bp, Glycine max
  Peptide Sequence Number=SeqID_105449
atgtcacgaaaccttacggattacgtaatcatcccttcattggcttccggcatgtcacagaacttcacggattgtgcaacaatgctcccttttgacttccggcatgtcacggaacttcacggattgcctaacgatgtgtgccaagtacctcgaagtggtcaaacgagggtcgcatgccaacaaacatatggaattaatgaagcattgggcttgtatctagaattggacttgaagagggcagactaa

SEQ ID NO: 13765 - DNA, 331 bp, Glycine max
  Peptide Sequence Number=SeqID_105450
caagacacccagtggacccggagaagtccaacagggccctggggtttccagctttggttacgggcctctgtcagtcctacagggtgcccatcccccccagcaagggatcgcgcccacaagacacccagtggacccgaagaagtccaacggggtcctggggtttccagctctgattatgggcctctgtcagttctacggagtgcccgtcgcccccagcaagatcatcaggccccctattaaccggactttcatcgagaagtactgcgccccaggcaggcacatggcaaggcatcacagtagtgggcaacaggcacaccgccactacctctag

SEQ ID NO: 13766 - DNA, 271 bp, Glycine max
  Peptide Sequence Number=SeqID_105451
atgttggccatcatcagcaagtacaaagaagaattaaatttggccaccacccacgagcacaaagtggcagacgaatacgcccgagtgtgcgcggagaaggaggctagaggaagggtaattgactcattacatgaagaagcaacgatgtggatggaccgatttgctctcactttaaacgggagccaagaacttccccgattactggctaaggccaaagcaatggcggacgcgtattccgcccgcgaggaaatccacgggctcctcagctatt

SEQ ID NO: 13767 - DNA, 245 bp, Glycine max
  Peptide Sequence Number=SeqID_105452
cggaattccctcccgaaaatgcacgtaaaggagccgcactgaagctgacatggttgctaagcatgttgcgtgcaccattgcctgaagaaccgacaatgcacttactacaatgcaagtgtggagcttacataatgtacatgattggcagtgctttaattcctgcaaacctgtatagagaactatgtcgagcatcatcggaggttggtaaatctatgagtggttgtgtcatactattgcagtcatga

SEQ ID NO: 13768 - DNA, 135 bp, Glycine max
  Peptide Sequence Number=SeqID_105453
atggctcatggccgtcaaacgcttaccttcaataagggctcgattcccctaatatcttctgggaaaggacctctacctcaaatgggagtaccgcttccatcccataaacccaggaatacggtggtgccccagtag

SEQ ID NO: 13769 - DNA, 797 bp, Glycine max
  Peptide Sequence Number=SeqID_105454
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtgtttgatggtttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13770 - DNA, 279 bp, Glycine max
  Peptide Sequence Number=SeqID_105455
atgttggatgttctggagatggccccgaggaaacttgcctcaaagagatccaggaaggataaagcggccgaaggaaccagttccgctcccgagtatgacagtcaccgctttaggagcgctgaacaccagcagcgctttgaggccaccaagggatggtcatttctacgggagcgacgcgtccagctcagggacgatgagtataccgatttccaggaagagatagttcgccggcggtgggcatcactggtcacccccatggccagttcgatccagacatag

SEQ ID NO: 13771 - DNA, 159 bp, Glycine max
  Peptide Sequence Number=SeqID_105456
atgcttctatttttcagtcctttgaataaggctaagcgcagctgctacgctaagcccttgttgctaagcacgccctgtgcgctaagcctaagggtcattttggtgaggctgagcttagcgcgccctgctacgctaagctcagacccttttctattttga

SEQ ID NO: 13772 - DNA, 190 bp, Glycine max
  Peptide Sequence Number=SeqID_105457
gccaaagaatagaaggtttaagcagccgatgactcgctcaacgaggcaaatccgctcagcgagatgcatccacttagcgaggaatccagctcacttagtggattgggaaactgatgcaatcctacccccaaagggcattggattgaagacttcaagaagattgggccaaagatgtaagagaaggccctag

SEQ ID NO: 13773 - DNA, 417 bp, Glycine max
  Peptide Sequence Number=SeqID_105458
atggagcagcgtggtcatggaatgtattacacgccaccaacatttgctcagtatccttcgcagatgtatcagtatcctttcgagggccatgacactgatatgtctgcaagcgaacattcgtttggtggtgttgccgaaacacagcctcatttttcatggccgaccatgaccccttcgcagcaacatgatgccccaatggcaacacctaatgccccattaggtcagcaatgggatgtacctggagcaatccctcctatgggtgatttattaggtgttgatttgcgtcacgagttttctgcagaggctgaggaacaagggcggagacagcgcgcaagaagaaatccggatcgtcaagcccgaaggtgggatcgaccatgtggcacatcctcgcgccatcacgaacaccatgatgactga

SEQ ID NO: 13774 - DNA, 237 bp, Glycine max
  Peptide Sequence Number=SeqID_105459
atgcaaaggtgctggaagcaacccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 13775 - DNA, 264 bp, Glycine max
  Peptide Sequence Number=SeqID_105460
atggtgaaagttggaacctcttacgtgccgatcaacgtctcattttcgccaaaagttggcccagggcttcccggtatcaacagggacaccaggatttatttattcgtgcgaagtgaagaagatctgccttcacaggttatttcgaggctccgtggcgttctggtttctatcagctgttcctcctgttcagctactgacggggtgaatgtacgcgtcaatcggcaacaagcataccgagccggaacatcagcgcggcaagtgtaa

SEQ ID NO: 13776 - DNA, 521 bp, Glycine max
  Peptide Sequence Number=SeqID_105461
atggcagaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 13777 - DNA, 786 bp, Glycine max
  Peptide Sequence Number=SeqID_105462
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaaccatcacacaatcacacggtcacacgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13778 - DNA, 399 bp, Glycine max
  Peptide Sequence Number=SeqID_105463
atgaggaagcccaaaagcccaccatttccttcaagtaactctaccacacccgccactgctgggagaatgtcctcggcttttggtgccgaagcagaaccagactcggttcgggaggagaaggccgaggaggacaaatccaaggtcgatgatctccgaggttctcctatgagcattggaaacctcgaggaactcattgacgagagtcatgccatagtttcatcctcggtggggcccgagtactatgttggtatcttgtctttcgtcaataaagatcagctcgagcctggatgggctattttgttgcataacaagatgaatggtagcggaatggagaaggaagagagagaggagacgtcacttcaaggagaagatgagtctagaagaagctcaccaccatag

SEQ ID NO: 13779 - DNA, 186 bp, Glycine max
  Peptide Sequence Number=SeqID_105464
atgggacaccttagtgatcaaggggttcccacaaaccctaagagaataaaggtcattcctgattggcccactccaccaagtgtcgagggaaggagcccagagtatgaagaaccttgggatttgaggtcaaatcctttccaaggtggaggggatgatgcaatcctaccccccaaaggtattggatag

SEQ ID NO: 13780 - DNA, 654 bp, Glycine max
  Peptide Sequence Number=SeqID_105465
gaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttcgctcgccggcagtcgaacgaccgagcgaggagtcaggagcgaggaagcggaatatatcctggtatcgaattcctgcacgcccgggggccaccttttagttctgaggccgccacgatggagctccaattcagccctatcagtgagtcgtattacaattcatggccgtcgttttacaacgtcgtgactgaaggcgccgcacgatcagcccttcccgacgttggcaaatggcgaatgggcagccctgtagcggcgcaattaacggggtgtgggttagctcactcattaggcaccccaggctttacacttgtatgctccggctcgaaccatgaacgccagagctcgaaattaaccctcactaaaggaatcaaagctggtaccgggccccccctcgaggtcgacggtatcgataagcttgattgccacccgaggtcgtga

SEQ ID NO: 13781 - DNA, 828 bp, Glycine max
  Peptide Sequence Number=SeqID_105466
attgtggttagaactagagggttaggtcgtgccttaggcaggattaaagcatccgcacataggcaacaggaagctgcccctattgctgaggatactcctgtcgtgactaaagacgtacatgcacatgcagaagaagctgttgatgatgctaagggatttccaggtgggccgcatgacccatcagtgttgactgactatggtgaccatgttgtagtcatcgtatggaatggagaggaacatcctgaattgaagctatcctcccatggaaggaaggttcagaaatttgggaggcttgctcctaaagttgaagggccagtcgctgccacaggattaagtcttttgatcgcatgttccgtagacactggcgatcggggacttatatccgcttttgtggagaggtggcataaggaaactagcagtttccatcttcctgttggagagctgaccatcaccctggatgatgtggcctatctgcttcatcttcctattataggcgcattccacagcttcgagactctgcatgtcgacgaagcagtcttgatgttggtggagttacttgaagtctctggagaggaaagtcagagtggaagctacgcatggggagctgctgccctagttcatatgtatgatcatttgaatgatgcttgtaagagtgacggtcaacaacttgctggttacatcaccctattacagtgttggatatatgagcattttccctctgttgctgagtctttgagtgatccagactatgatgagatgtcaccacgtgcctgccggtggattgctatgaaggcttcttcaaagttattaccagcatcgacgtactga

SEQ ID NO: 13782 - DNA, 282 bp, Glycine max
  Peptide Sequence Number=SeqID_105467
atgtggggaggcgaacaagacattgaggtagcagcaactccagaaggacctctatcttctgaggcatcttctagttttccaactcaagggcaatctcacacagttttagctgaagcaaatatcatggctgaggagccaagaagagttactctggaggactactcaagctcaagtgtgtcgcaattctttactagtatagcgtggccggaggttgtgtcatatgtggtggagcacatgagttcgactgatgtattccccaagaagaaacaacacatgaagtga

SEQ ID NO: 13783 - DNA, 378 bp, Glycine max
  Peptide Sequence Number=SeqID_105468
atggcttcccgcaaaagaaaggcaccagccttagcatctcaagctcgctatgatagatcaagattcacatcccaagaggcctggaatcgctattctgacattgtgattggcaggaagattcttcttgagaggaatgaaatgatatatcatacagattttgatgaattcaagattgagttggaaaaaaggaattggcacaaggagctgaccaattttctagacgggagcattgatgttgctatagtgaaggagttttatgctaatttgtatgaccctaaagataaatctcctaagcaagtaagggttaggggtcacttgataaagtttgatgaggatgcccgcaacactttcctcaagatgcctgtgattattgattga

SEQ ID NO: 13784 - DNA, 130 bp, Glycine max
  Peptide Sequence Number=SeqID_105469
tatgcccgagtcattcatctctatgaaatgcccgagtcattcttccttgggttatggggttgaaccaaactcattgatggaagcttgcttgtggagcttctatggaggctggatctttgagcttcaatga

SEQ ID NO: 13785 - DNA, 800 bp, Glycine max
  Peptide Sequence Number=SeqID_105470
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccatcatctctccccagaccgtggacacagctgccaacgtcttgccctcccatcatctctgcacccagggaccagggtggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13786 - DNA, 432 bp, Glycine max
  Peptide Sequence Number=SeqID_105471
atgatgggagggcaagacgttggcagctgtgtccacggtctggggagagatgatggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13787 - DNA, 666 bp, Glycine max
  Peptide Sequence Number=SeqID_105472
atgcagaagaaacatacaaagaaaaaaggagaaataactgaactcaaagtcaattctccaaatgaagactacaaagaaagctctagtgatgatgaaaatgtagagaatttaagcttgatggtgaagaagattagaaaatttctcaaaagatccaaagacataaaattctctaaactaagaagaagattcaaagcaacaacaaaaccttcacatgcttcgaatttgggaagcaagcaacaattaatagtcttgatagtgtctctgcctctgggccttcatcattctccacttgggcattcatccttctccactcgggggctttatccttctccacttgggcctttgcccttctccacttgggcctttagcctgtatttggccaatttcaggattctcatcaggaagctctcgagaaattcaaatggtcatgacttgtcacaggaaagtccgattctagcgcataatataccgagatgctcgaaattgaacaacggaagctctcgagaaattcaaaatggtcataacttatcacacggaaggccgactccggtggatagtatatcgagaagctcggaattgaaaaccgaaagctctcgagaaattcaaatggtcataacttatcaaacgaaagtccgattcaggcgcataatatatcgagaagcttga

SEQ ID NO: 13788 - DNA, 237 bp, Glycine max
  Peptide Sequence Number=SeqID_105473
atggcggcagcgacacctaatgaggcagacgttgatgtgcatcatcttcgacatgcagtggatggttatgtagctattgttgataagttggagaggctactaaacctaaggatcctgaccgaaagaacagaagcctatactgttgctgaagaatgtctgggcatcgcaagaagttacattagccaaccaactgtaggtcacagatcgagacgtaagtggcgtacagacagtcattga

SEQ ID NO: 13789 - DNA, 462 bp, Glycine max
  Peptide Sequence Number=SeqID_105474
atggtgaattggtacctaaagaatgggatgagaagaaaaatgatgagaaaagaaaagcacaacggatgtgagaagagcaagcacactcttgtatccgaatatgaagcgtttcgaatgaacaatggagaaaccatttcagaacatcaaacaagattcacccatattgtcaatcatcttcttggtctaggaaatacgtttgaagattgtgagttgaacatcaagatcctcaattgccttacaagaacttgggaatcaaatattacagcaatcaaggaatccaaggacttagctacaatgatgatggaaactttcttcggtaaattgcttgcatatgaacatgagctgattcaacaatatcatgcaaaagaaacagaaaaggaattgcactcaaagtcaactcctcaaaggaagattacaacaatagctccagcagtgaggaagaggcaaagaatttcaacttaa

SEQ ID NO: 13790 - DNA, 528 bp, Glycine max
  Peptide Sequence Number=SeqID_105475
atgacggtgaaaacctctgacacatgcagctcccggagacggtcacagcttgtcagtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccagaaaggttctgtgacatggacgcccaacaaaactcgaacagtggagctttcgatcaagacgttctcgcctcccctgtttgggctctcgctcgaatcggaacctttatgcgttgcctcctctataaaagaaaggcattccagcttcagaggcaggtgagccgggtcaggaaggagtttgactgctgggatggggtcggatcctactcgaagcactccaccatgaataagaatcttcgggttggatag

SEQ ID NO: 13791 - DNA, 441 bp, Glycine max
  Peptide Sequence Number=SeqID_105476
atgctaatcctttcattgcccttgagcctctttttgtgggtgaacaactcctttagaaacttggcatatcttggaatttgcttgatggcatctagcagaggtggaaatggaagagggataagaggctgctgcaagtcagaactactagaagaaggttcaggtgcaggtgctgctactggtggaggtacatcaatttgcttaccaaacctcaagtcatttgcctcactaactcctctaaggaaggttgagaaggggcctcaattgcttgttgtctttgttgttgttgttgctgctgttgctacattggaggaggaacatatggcctgcttggaccagcagcattctggaagggagggacaggctgttgttgctgttgttgtggaggatttgcccatctcagatttggatgatcctccaacttggattgtatctgttgcttga

SEQ ID NO: 13792 - DNA, 420 bp, Glycine max
  Peptide Sequence Number=SeqID_105477
atgcaacgccttggcgagctccgctcgcacaatcttgggcttcccgatgcgcacgacgagatcggagccgcacgcctagaggaaggcgacccggtaggggccggtcttgtcgaagccggatgccgacttgccgttgtcagaggggtcaaagcagtagacagggaagacagagaaggagtcgttggtggcgatgaggcactcattatcgaggaggtggaggtcgttgcgaaaccagacgagggcggcgtgacagagggcggtggcattggaaggatcacgggggcggtggggagcaaaggagagaggggcgtggaggggattggcggagatggtggatttgaaggaggaggagtggtggtggagagagaaaggtctgtgagggataaggcttggtttggaactttgagcttgcttggttga

SEQ ID NO: 13793 - DNA, 109 bp, Glycine max
  Peptide Sequence Number=SeqID_105478
atgtcagtcgcggctgttatgacgccgatgtgggctgttgttttgtctattcaatccctgaaaaatatttggatgatgtcgattaggaaatgttcgatcggcgttccag

SEQ ID NO: 13794 - DNA, 252 bp, Glycine max
  Peptide Sequence Number=SeqID_105479
atggagaattgcactaagcaagtcactacgcatagctccaaactcgaaggtgggggacacgtgaacggaaacgcaattcatgggactccgaaaaaggtggaggacacaatgaacgaaaacgcaattcatggggctccgaaaagattgagaatggagaattgcactaagcaatcactacgcatcgctccaaactcgaaggtaggaggacacatgaacgaaaacgcaattcatgggactccgaaaaagggttga

SEQ ID NO: 13795 - DNA, 165 bp, Glycine max
  Peptide Sequence Number=SeqID_105480
atggcatcacgatcaactgagccacatggacgctcatccgtgtcaggattgcatacaccagctgacacttcggcagagggaggtcggaattatgatccctgggtagtcatgttggtgcgcatgatccgcacccgtctcccggcagcggtccgggcaaaatcctga

SEQ ID NO: 13796 - DNA, 180 bp, Glycine max
  Peptide Sequence Number=SeqID_105481
atgacactcctgcggtgcgtggatgccaaagaggcgaaccacatgatcgaggaagtccatgagggctcgtttggaacgcacgtcaacaggcatgctatggccagaaagatcctaagggcaggaaatgccacaaatgtcaagcgttcgcagacaatgtcaatgctccaccgcatcctctga

SEQ ID NO: 13797 - DNA, 74 bp, Glycine max
  Peptide Sequence Number=SeqID_105482
atgccacctctagcaccagcatcgacaaggtatgacaaaggttggcatcctctacttgaattgatgataggggt

SEQ ID NO: 13798 - DNA, 386 bp, Glycine max
  Peptide Sequence Number=SeqID_105483
atgaagctgcacaagaagtgaattatatggggaatcagcacagaccaggatttaatgcagatggatttgcagaccaaggaggatcatccaacaggcctcaaaatcaagggcctagccattatgagagaacaaccaagttggagaagactttggctcagttcatgcaggttactatgtctaatcacaagagcacagagtctgccataaagaacctggagattcaagtgggacagctagccaagcaaatagctgagaattcttctggaaattttggagctaataccgagaaaaatcccaaggaagaatgtaaagttgtcatgacccgaggcaagaaggcgatcataatggaagatgaaaggaggaatggtgatgagcaagagttataa

SEQ ID NO: 13799 - DNA, 219 bp, Glycine max
  Peptide Sequence Number=SeqID_105484
atgaaactaacaaggaacaagtgtaggatcacggttaccttgaagaaaactgcgaaggtcagattgggcttcgttctctaccgaaaccgcgagacaagcttggaagattccgctccgattgaagggttcctctcggtgtggggtttcaacggagaacaacagcggtccatggtggccactagtggagaagaatcttgggacgttggggaagggttttga

SEQ ID NO: 13800 - DNA, 219 bp, Glycine max
  Peptide Sequence Number=SeqID_105485
atgaaaactgaagtacaggtgcttagcgcgcgtcacgcgctaagcgtgcaaggcagcacaagcgctaagcgaggcgttaagcacaaggatgtaggattcattacgcgcgctaagcgtgaggcacacgccaagcgcgcgatccaacagaagcacatgctaagcctacagcacgtgctaagcgcacgatctgaacgcgttaagcgcaaggtgtcgcgctaa

SEQ ID NO: 13801 - DNA, 549 bp, Glycine max
  Peptide Sequence Number=SeqID_105486
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccttcgaacggcaagaatgactccggaagtttcgcgagcattgttgagaatgtctttcttgatcttttcatggaggtttctcaagtaagtctcccctgccagcaagtcagccagtggatcatggatggcatgcttccacagagcccttcccgcagcggtttggcaagctga

SEQ ID NO: 13802 - DNA, 378 bp, Glycine max
  Peptide Sequence Number=SeqID_105487
atggcccttagacttgttaagtctagtgcgcagggctctgaggatgactttattggctgcctttgcctgcttgttggtttggggaagttcgacagaggtgacaagttgtcccaatatgtccattccccacttggcaaaggaccaaatggagctcaaactatggagattgtcaggaggggtgcatggaacatgtacaaactcttgacattgtttggatttctttgtgaagtcaagggcatctgccctgagtgttggccagtagtagccaacacacaccacctttgttgcaagggatcatccccctatatggagactgcaaattccttcatggagttctctcatgacataatttgcctgttggctattcaaacactttaa

SEQ ID NO: 13803 - DNA, 228 bp, Glycine max
  Peptide Sequence Number=SeqID_105488
atgggaggggggaaaagagtgcagctaaaaagtaataacaggaactatagtcaactgtcgcaacctacccttttgtgggtgagcgaggcgaggctcacgggtgtgtcttccaaaggaggaaaatgcgcggagtcgccaccaacgtttattgaaaggaaaatgttagaaaaaccaaaggaaatcggtcgtgaggaatattccagattcgggagtcgtatttacgtttga

SEQ ID NO: 13804 - DNA, 324 bp, Glycine max
  Peptide Sequence Number=SeqID_105489
atgagccactgcgagagagaagaacccaccacggagagagcaaaccaagtgagggagaacgaggctagaagggagaacgagagtcacacgagagaaagggtcgttggagaggaagtgaggtcaaactcaaaccctgataacatttgtaagggtgattccatgatcaagaacccaaacgtcgttaggggattcaaagcattcgatgagttcatgcttatacctgaaaaggattcagagggtttacacatcactttggcggtttgctccctcttggtgattggaacctctttgccagtacaaatggtacgaatggtgtgggaatga

SEQ ID NO: 13805 - DNA, 573 bp, Glycine max
  Peptide Sequence Number=SeqID_105490
atggcttcgtctggtccagttctctccttctccggaactccaaccatcacaacagctaaactcaattggaaaattatttatcttggtctgcttcagtggagctgtggtttctcggccaaggtcaccatgaccacttggagaaaggtgctgaggagttctctatctctctctaaatgtaacaataaaagacctgaatgggagaagctggattatcagctttgtgcagttttatggcattcagttgagccaaacgttttggagattcttagatcattcaaaacatgttgttctttctggaagaaggcccgagaaatctttgcgaatggtattcagtgtttgtttgatgcaaccatgaaggttacagccctcaagcaaaccagccatgacatgattgctcatataggaaaagctcaggctgcagtagaagagctggagaggtttctggtggctgactcgttagaggaagtgaatagaaaactagataagttctacatggtccttatattgaggagtctacattcagactttgaccatgtgcgagatcaggttcttgctggagatcaagtcctataa

SEQ ID NO: 13806 - DNA, 309 bp, Glycine max
  Peptide Sequence Number=SeqID_105491
atgccgtccagcttcgcggacctagtgttcgccggggaaagaatcgaggtaggattgaaaagaggaaagttcgattacgtttcccccacgagtgcgaatgccaaaagaatcgggacaacgggggcaaaaaggaaggaaggagatgcccatgctgtctcttcaacgcccgcatgggtcaaacccccgcagccacctcatggtacccatcagtacgcgcaacatcacccgagcttctcggctcacaccgggaacgcctctagttcagcacctgtgcagcctaaggcaaccacccagagggaagctccccaa

SEQ ID NO: 13807 - DNA, 846 bp, Glycine max
  Peptide Sequence Number=SeqID_105492
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccctagtaatgtttccatggctagccttcggacacttaatcccaagccttgaacttgccaagctcattgctcaaaagggtcatcatattagtttcgtgtccaccccaagaaacatagagtgtcttcccaaattgtccccaaacttggcttcattcatcaaatttatgaagcttgcactgcccaaagtggacaaccttccagaaaacgttgaagccaccattgatgtcccttatgatgtcgttcagtatctcaaaaaagcctacgatgatttgaaagaacccttgacctgttttctcaaatcttccaaagttgattggggtaccgagctcgaattcgtaatcatggtcatagctgtttcctgtgtgaaattgttatccgctcacaattccacacaacatacgagccggaagcataaagtgtaa

SEQ ID NO: 13808 - DNA, 255 bp, Glycine max
  Peptide Sequence Number=SeqID_105493
atggaaaaacgccagcaacgcggcctttttacggttcctggccttttgctggcttttgctcacatgttctttctgcgttatcccctgattctgtggataaccgtattaccgcctttgagtgagctgataccgctcgccgcagccgaacgaccgagcgcagcgagaaacagctatgaccatgattacgaattcgagctcggtacccctttttccggaactatattcaaaaggaacaacaccgcaatagcaggctaa

SEQ ID NO: 13809 - DNA, 393 bp, Glycine max
  Peptide Sequence Number=SeqID_105494
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggttattatgggtgactttgcttgtaggtcactagtgaagcaggtcagacctactggtgggattgtaccaccgtctactatcattcctcctactggagaagggggtcaaccagctattgaggttggtcgtactgctggtattgttgaggtctccccaatgttccttcctctattttggttaagaggaagcgagatgatggggctggggtgtcaggccataagaagtcgaggggccctcttagccttcgtgcactga

SEQ ID NO: 13810 - DNA, 328 bp, Glycine max
  Peptide Sequence Number=SeqID_105495
gttagtatggacaaaatggatggatataacggatatgggatatgtaattgcgtcaagatataatagcttcacattttttcctctcagacgtcgaccactggccaattctgttgcgcaccgcataatatgcgtcgaccatgtgtatggcagtcattttgttcaggtttttctgaaagatcgttgtcccttaccgcctatggcattgttgtggtcaagcaatgcgtatccggaggcaaaacaatggccaactgcatatgtaggtagaatgcaacaatacttaagcctaatgacaattaatacaacgcatgtagacctaagcggacactaa

SEQ ID NO: 13811 - DNA, 282 bp, Glycine max
  Peptide Sequence Number=SeqID_105496
atgcaaaagcttcaagaaaagacccaaactcccctccaaaatctgatttcaggcttaataggtggctttgtttgtgcttgcatgcttagcacaattttgaaccgcttagcactcattagtggatttcggcttagcgtgtgcttttctcgcttagcggatggattgaagcggtgcgcttcgctggatgacccttcgcttagcgcaaatgcacaactcatccttcttccagattcttcctcgtgctcagccgaggagtgttgcactcagcggatggctcgctaa

SEQ ID NO: 13812 - DNA, 285 bp, Glycine max
  Peptide Sequence Number=SeqID_105497
atgacatgcgggggtactatggttatccgcacctttggtcatcatagagacggcaagtccgatgacatgcgggggtaccgtatggttatccgcactgtcgcaacctgcccttcggcgggagggcgacgcgtgactcgcgggatgcgtgttccacgaaaggaatacgcgcggagtcgccaccaacgtttatttgaggaaaacgtcggaaaaaccggaaaagacgtgatctacgaacttttaagtgaaaggttcgggagttgtatttacgcacggggaaggtattag

SEQ ID NO: 13813 - DNA, 335 bp, Glycine max
  Peptide Sequence Number=SeqID_105498
tgcgcaacaaattgattaaagaacttgatagatggtcgcatgactacaccaacctcttcggtgccatagagagatttgaacaattaaggttgtccctacttgttgatgggttttccaaggttagtaaggacaagtggatggatataacggagatgggatatgtcattgcatcacggtataacataatccttgtattgttgtccccacaacaaagcatgacattttttccacttagaagtcaaccaccacccggttcttctgtgcaccacatgatatgtgtcggtcacgtgtttggaaatcattttattcaggtttatttgaaagactgcctctag

SEQ ID NO: 13814 - DNA, 676 bp, Glycine max
  Peptide Sequence Number=SeqID_105499
gggagaagacccctgaagttctatctggaaatcacgatgaacgcgctaagcgtgcctgtgcccttagcctgttcatcacaactgtaaaaattttggatttccagataaacgcactaagcggaccatgtcacgctaagcaccttgttgcgcttaggaaagcaccctttacacctacccaagccagatttgatagatccagattcacatcccaagaggctttggagagatacactgacatagtggtgtcgcgaaagctactaccagaaaggaatgtggtagtctattatacagagtttgacaagttcaaggaggaactcgagagatgccattgggatgagaagctgactgatttttctgacaatagtatagacatcgccattgtgaagaagttttatgccaacctttatgaccctgaagatcacctaagcagatttgcactcctgaggcctgatcctcaggagttggctgctaagctttgtatcccagggaggggattcgagcttagtgctgatgggcagcctttgaagattctgacgaagaacatgactactctagctcagacatggagcgttctttccttttctaacctcattcctacctcccacacatctgatgtgaccttggataaagccaaattgatttatgggattattatgaagatggacatgaacctggg

SEQ ID NO: 13815 - DNA, 437 bp, Glycine max
  Peptide Sequence Number=SeqID_105500
atggaggcccgaaacacacacgcttcacttgagatgcggagaggctaccattactcttcaagatgtgagtcagaccataggaaggcaaacttgaaggtagtgtggtttacctgtgcatggatccttcgattcataggaggtgtcctctttgttaacaaaagcagtagcagagtttccttaagtgcagcacgtatgcgtggggacctgtcgtgcttgcgtatttatatagagagatgtgcagtaccaccgattacaaagttaaatcaaatcaatcggaggtggctgggacgtggaaatcagcatattggcaatgatgatcttagagtttttcgtcgcaaattggatatcatgaaacaacatgagtttgtctgggagccatacacaacaactgtgatggcagcgttgcctctaatttgtgtggttggaagtgtagcctg

SEQ ID NO: 13816 - DNA, 837 bp, Glycine max
  Peptide Sequence Number=SeqID_105501
atgcggttcgcgcgcgcaggccgcgcgcatggcgtggttggccagtgtcatgaggttggccgcattggtcatggcttccagtccgtccgggccggggccgatcttgtcgaagcgttccttgaactcggtggcctgcttgctgtaggcgaaggctcgcatcacatcggcataggcgatggcgcgcgaaatgtcgcccgcggaagtctcttgcgggttgtccgaggagaggccggccggcggggcgcttgggcgatccgcgtggcgccgccgtcaccacatcttgcaggtcgtgccgttgttgacgagttcgccgccgacgacgatgcccttctcgtcgacgtgcagcatggtgtagcagctggcgacgcccgtgcgccgctggtagatggtgccggtgttgttgccgaaaccgtagctgacgccgccgggcggaggcacgtagaaggtgccgacggcctcgtcccaggagacttcgccggaggtctgccacatgtagaccagttgcccgatcggcaggtcttcgctggcatagacgcggtcgggcacgccccaatcggccacgatgtcattcacgggcttgcccttgtggcgcatcatcgccacgtcccaggtggtgcaggcgctcagcacggcgccgcacaggcaggccagcagggccttgaaaaaactgaatcgcacgtttgttttccttgttcagatgctcgacaggtgccctacgcgccgcatgatgccagcgcgccgcgcccgtggcgagagggggtgtggcgcgcattccacacccgccgtccggggcgccgggctggctcgcctatttttccggggttgccaccggggaag

SEQ ID NO: 13817 - DNA, 594 bp, Glycine max
  Peptide Sequence Number=SeqID_105502
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcacattgaccctaataaagaagagcagctccaggaagctaaagcagaaattgaagacaaagtgaaaaggatattgaaacttattaaagaggacgaccttgaagaggatggtaccccagtagaactttctaagaaggaaccgcttgttgaactgattgaagatttccacaatcaataccaatcactgtatgcacaatatgatcatctaacgtgcgagttaaggaaaaagatcaatggcaagcaagaaaaggggagttcttcatccagctcagactctgattcagattcagattattcttcaaaggagaaagacaagaaaaatggacaactgggtaccgagctcgaattcgtaatcatggtcatagctgtttcct

SEQ ID NO: 13818 - DNA, 135 bp, Glycine max
  Peptide Sequence Number=SeqID_105503
ttgagcttagctcatcagtgggctaagcgcgcatccaccgataagtgcagcttcagtgcactaagcgcaacagttgtcttcagcctggctcagcgcacgactggcgctaagctcaaatccacttactcgcgctaa

SEQ ID NO: 13819 - DNA, 621 bp, Glycine max
  Peptide Sequence Number=SeqID_105504
atagcctctaggaaccggtacacggataatgtattggggagaaacatcttgccagataggaaggtggagctctaccacactgagtttgatgattttaagactgagttggagaggtgtaatctccataaatgcctcaccaatttggttgatgggagcatagatgtggctttggtgaaagagttctatgcaaaccaatacatctttgagggtccttcaccaaagcaagccagggtcagaggccatctggtgaagatcgacactgacagcctcaacacattcctagagacacctgtggtgttggcagagggtgagactttgcccacatactccagatactgcaggctgccttcagatcttattgagattgaggctgccctatgcataccaggccgagggttcatcttgaacgttgagggccatcctgggaggatcttgaggaaggacttgacaactttagcccaggtgtggagtgttctctcatactccaacctggcccccacatctcacacatctgacctgacaatggatagagctaggttgatctttggcttagtctctcgcatggacatgaacataggagcactcatttcttggccagatgacttctatagcctagtctaa

SEQ ID NO: 13820 - DNA, 620 bp, Glycine max
  Peptide Sequence Number=SeqID_105505
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcgtgcggctgcgaatatcgcggtcaatcggcagatgcagcatgccgtacaccagcccttcgcgcagtgcgccgccggccagcgtcatgctctcaatgctcagctcgtggaaaatggcgatcagaatcgacaggccgctggggaacaccagcgcacgctccagcgtcagcccttcagggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaaaccg

SEQ ID NO: 13821 - DNA, 201 bp, Glycine max
  Peptide Sequence Number=SeqID_105506
atgtttatttgctgggaattgggtttgaaattgcattttacagataacaatgaggcacacttcctgatggaagcttgcttgtggagcttctatggaggctggatctttgagcttcaatggggtcctttaatggtgattttccaccatggagatgcagcggaagacaaaggaaaggaggtgagaggaggcgccatccattaa

SEQ ID NO: 13822 - DNA, 878 bp, Glycine max
  Peptide Sequence Number=SeqID_105507
atgtcgcgcggcgattggccagcggcactgacagcgatccgcaagatggccggcaagcagcgcagcgacccgcgctggcgctacttcgaaggccgcatgctggagaagaccggccaggcccagcaggcgcagccgttgttccgcgaggccgcacgcgcaccgaccttccacggtttcctggccgccgacaagctgcagcagggctacacgctgtgcccgtggaagccgaatgacagcgcgcaggcacaggcagtagtcgcgcgcgatccggccatccagcgcgcgatggcgctgtaccagatcgaccgtgccggctgggccgtggccgaatggaacagcgcgctgtcgcgcttcgatgacacccagcgccgcctggcggtacgcgtggcgcaggacaacggctggttcgaccgcgccgtgttcgcgctcggcaagcagccgcaggaacagcgcctgtacgacctgcgtttcccgctgcaccacgacgccaccatccgccgcgagtcggcacgcaatgccgtcgacccggcctgggtggctgcggagatccgagccgaaagcaccttcactccgcgtgcgcgctcgcctgccaacgccatgggcctgatgcaggtgctgccggccaccggtgccggcgtggccaagtcgatcggcctgaccggctacggcggcgccgacagcctgtacgacccggacaccaacattgccatcggcaccgcctacctgcgccagctgatgaacaagtacgacggcctgccgtacgtgaccatcgccgcctacaacgccggcccgaccccgaccgcacgatggcagggccagcgcccgggctttgacccggacctgtggatcgagacgatcagctacaaggaaacccgcga

SEQ ID NO: 13823 - DNA, 519 bp, Glycine max
  Peptide Sequence Number=SeqID_105508
atgggcgaagggaagctggattatgaccggctgatcgccagcgtgcggccggtcgatcgcgacatcaaccaaatcattgaacactggttgccgtggcaggacgatgccgcgcagacctgcgcgcgggaagccgaatggacccgccgcgccgttgaattcctacgcacacagcgcttatcaggtgtttactgcgagaattcaccgcaggcgcagcagcaggtgactgcacagggacgcgagctgtcggatgccgcgtcggtggtgccgctgagtgacgtggtgatcctcgccgtgccggatatcgtactgggcaaagtctcgcaaagcgtggtgccacagatgcaaagcggtgcggtgctgctgacgctcgatccggccgcggcctacgccaacctgatcgcccagcgtgacgacatcgaatacgcggtcgcgcacccgtgccatccgtcggtatttctggctcgctacaccaaagaggagcacgccgatgcgtttggtggcgtcgctgccgttcagcac

SEQ ID NO: 13824 - DNA, 1212 bp, Glycine max
  Peptide Sequence Number=SeqID_105509
atgcttcctttcgacttccggcatgtcatgaaacttcacggattgtctaacgatgggtgccaagtacctcaaagtggtcaaacaagggtcgcatcccaacaaacggatggtccccagacgaaattaggatcaaaggcaacaattcagttatccaaatccaagaaaaagatcatatttcagcatctcccaccattcaattgcaaaaccaagacaacccagcaacacaatcaatcctttgaggtgcgccgctgcccgctggtactcgcagaaagaagaagaagaatattagggtttaggataatgtgtccctttatagagagggaatttgattgtcaaaacaatggtagaccagataagttttatcttaagtatagatggcagcccgcagggtgtaacttaacaagattcaatggtgaagatttcctaactagacttagagggaagagtatcatgtttgtgggagactctttgggtttgaaccaatggcaatcactcacttgcatgcttcacatagctgtgccacaagccccatacagcttagcaaggaatggagatgtctccattttcacctttccgacctatgatgttaaggtaatgttctcgcgcaatgcattacttgtggacattgttggtgagagtatcggtcgagtattgaaactagattcaattcaagctggccaaacgtggaaaggaatagatgtaatgatatttgactcttggcattggtggattcacacaggaagaaaacaaccatgggatttgattcaagtagggaatcatacatatagagacatggatcgcttggttgcatatgagatagcattgaatacatgggccaaatgggttgattacaatattgatcctacccgaacaagggtgttcttccaaggagtctctccagatcatcaaaatccagcgcaatggggtgagccaagagcaaacttatgtgaagggcaaactaggccaatatttggattcaggtacccaggaggaccactcccagcagagttggtattggagaaagtgctaagagccatgcaaaagcctgtgtatttgctggacattactaccctatcccaactaaggatagatggccacccgtctgtttatggctttggagggcatttggacccggattgtagccactggtgcctagttggtgttcctgatacttggaatgagcttttgtatgctagtctcattaaaaattaa

SEQ ID NO: 13825 - DNA, 357 bp, Glycine max
  Peptide Sequence Number=SeqID_105510
atgatgacaaaaagcccaaagaatgatttcaagattgagtcaacaagttcaagatcaaaaaacaaaagtgtgctattcatcttgtcacaacctgcccttcggcgggagggcgacacggggctcacggatgcgtcttccaagaaaggaaaatgcacggatttgccaccaacgtttattcgaggaaaacgtcggaaaaactcgaatgtgtgtggtctacaaactttaatcgttaaaggttcgggagtttgtatttatgcatggggaaggagaaaagagggaggtggttgccgcccaattcgcccaggaaagctgggttacttccaccagaagacaccgccttctgttggaaccccatga

SEQ ID NO: 13826 - DNA, 465 bp, Glycine max
  Peptide Sequence Number=SeqID_105511
ggattaagaaatcgagggtctcttgttgtaaaacaatctgaacgcaaaggaagggttgtccttgtatggttcagaacttgtaaagggcttttgcaagatagtggaactctcaagcgggttgcttggggactagacgtaggcacaaagaaaaatgtatgtgatagtgtcattgggatgctccttaacattcaaggcaagacaaaagatggtttgaatacttgtcaagatctaccggagatgggtatacgagtgcagttacatccaattttgatgtgtgtcgcaacctacccttcggcgggagggcgacgcgtgactcgcgggatgcatgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 13827 - DNA, 330 bp, Glycine max
  Peptide Sequence Number=SeqID_105512
atgatgcgggaaatgtgcatggatttcaaaatccagcatcacaattccaagccctaccggccaaagatgaatgtagaagcaaagcttcatgatgatgacaaaggtggtgacaaaaaactcaaagatcaatcaaagaacaactcaagtgaatcaggaacaattcaagagttcaagataagaatcaagaagaatttaagactcaagaagaaagttaggagtcaagaatcaagattcaaggttcaagatctcaaaaatcaagatcaagaatcaagagaaggcttaatcaagatatgtataaaaaaaatttctcaaaaattgagtagcacatga

SEQ ID NO: 13828 - DNA, 693 bp, Glycine max
  Peptide Sequence Number=SeqID_105513
atgggaacaagaggttgtattaattataatcccgtcctcgccataagacagcttggctaccccatgagaggagcgccatcggaggaaagtgtcacacctttcatcacacggggtttcagtgaccccaacgcgaggctacttcaaggagttcgcaaggcatgggaagcggcgcaaaggaaggacaaagagcttaggggaagtagtaatggggtcatcgacgtctatcataagtgtctaagagtccggacacaagggttggattggctcccaaagctaaaggctgcaagagaggaagaggctaaagctctggaagaaagtgaagaggtacaagccctaaaggcggagctcgaaaaagcccgagcaatcaaagagaagttcaagtcaacggttatcaaagtccgaaaagaatacaatgaactaaaggatatcaatatggccgctgccaaagccttggaacgagaaaccaagagggcccgaaaagaagaacacggccgaaacaattttcgaggagctttgtggggtaggaacaatgagcttaagctccaaagagatgaaatggatcagtcgcgggtcaaaggcatgatcatgaaagacgagttaaaggcttgccttaggtcgaaaagaggcttgtcccagcagttaagcaagattgaaggaaatatgtgggccatcatcgatgagtacaaagtgtag

SEQ ID NO: 13829 - DNA, 360 bp, Glycine max
  Peptide Sequence Number=SeqID_105514
atgaattttgcagcgagaaagcccgtagaattcaccccaattccggtgtcctatgctgacttgctcccatatctacttgataattcaatggaagccataaccccaaccaaggttcatcaacctccatttctccgagaatacgactcgaacgcaacgtgtgcctgtcatggagaagccccggggcattccattgagcattgtaggggcccgaagcgtaatgtgcaaggattttcaactttcaccggaattgggtgcaagccattggtctatttgttcaagcgacctgtgctcctgagtttggacttccaagaccgttcaatcggagattactcgtcttgcacgttggtggggctgccgtaa

SEQ ID NO: 13830 - DNA, 330 bp, Glycine max
  Peptide Sequence Number=SeqID_105515
atgacacttggaacacttccccatgcaaacactccgaatgatgaaatcaaggaatatctggattgcagaggaccaatctcatctgaagatatcagaacagttgctggtgttgaatatcctacatatagagaagcatgttttgctatgggttttttacaggatgatagagaattcattgccgcaatcaacgaagcaaaagactggggctcaacaccttatccaaggaatctttttgtattattacttttgaaaggtaccattgataaggacacaactaaggataaggaccatgaagcacttgaagggcccatgaccagaggcaaaacttaa

SEQ ID NO: 13831 - DNA, 579 bp, Glycine max
  Peptide Sequence Number=SeqID_105516
atggcagaaccatcgaagaagcgaaagggtgtttcgacttcatccgcagtcaccggaactcgaagctacggagcatccaaagcacatacaactcaaattcctccctccatatcatctcctacgttgttttcctcggaagaacaacatatctggtgcaattcccttttctcttctcgttccattatcgaccctaagtttgtagacttaactttctttgatgatgaaatgtttgattgttttcaagcatttcaaaattctggattaatccaatttatttccatgaaacttcctttttatcctgaattggttagagccttttattccaacttagaaattcaagaagattccttgatttccgaggtatatgggattaagatggtcatagaccagtcccttttcttcgaactcacccagttatccagtgatggtgtaccgtttgaaggtacactagatgatgattggaagttcaacttttctatttctgatgcccacttattggtttgcaccaatcaagtggatatgaccggaaggcttcttgtcggatcaccggcattcgaatgccacatcatgcactactag

SEQ ID NO: 13832 - DNA, 348 bp, Glycine max
  Peptide Sequence Number=SeqID_105517
gtcgacttcttagaggatccccttccggtgcactcgctttatatctccgacacacaaggaaggacgcggtgggaaggaagcagccctagcctctgtccggccgatcattccgctggcatcttgcattcacgcctccgtttgactgccgctcggggatggagttgtagatacgttagtcttagcggatcgttggctccacctgttatctccttctacgacatgctgttgtcgtcgccatattccatatgtaacttagtcatctctgcctcgctgcgggtcagcacctccgaaagaaacggaggacttcattcagtgactccgcgatcgccctctaaacgatcagaataa

SEQ ID NO: 13833 - DNA, 267 bp, Glycine max
  Peptide Sequence Number=SeqID_105518
atgaccatgattacgaattcgagctcgggagaccaatattctcctggtatcataccactggctatcaaagatgttttcagcattatccaagagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 13834 - DNA, 782 bp, Glycine max
  Peptide Sequence Number=SeqID_105519
gtcgactctagaggatcccctgactgggtactggcgctgccgggctatccccaggcgaccggacgacaccagctggtgctcaatctcaacatcccggaggcctttgattacctggtggagcgcatgagctggctgctgggtgagcatgcggtcgactacgtgaagtgggacatgaaccgcgagctggtgcagccgggacacaacggtaaagccgctgccgacgcgcagacccgccagttttaccgcctgctggacgtgctgggcgagcgcttcccgcacattgagtttgaatcgtgctcctccggcggtgggcgcattgattatgaggtactgacccgcagccaccgcttctgggcgtctgacaacaacgacgcgctggaacgcagcaccatccagcgcggcatgagctacttcttcccgccggaggtgatgggcgcgcatatcggtcatcataaatgtcacgccaccttccgccagcatagcatccagtttcgcgggttgacggccctgtttggccatatggggctggagctggatccgctcaccgtggacgcacaggagcgcgaaggctatcgccattacgccgcgctgcacaagcagtggcgagaggtgatccaccatggtacccagtggcgtattgatatgccggatgccaccacgctggcgcaggggattgtgagcgaagataaggcgcaggggctgtttatggtcagccagctcgcgatgccggattacagcctgatgatgccgctgcgcatggcggggctggaggctagcgcgcg

SEQ ID NO: 13835 - DNA, 189 bp, Glycine max
  Peptide Sequence Number=SeqID_105520
atggagaagtctgagaagaacaatattaatgaaaagaaattgaagaaagcatacattacatgggatgaaaacgatttggaatcttctgaagattcagaaaatgaagaaataaatctctgccttatggcaaaaagttatgaaagtgatgaagaggaaaacaaagacatgtctctaataaggctggactag

SEQ ID NO: 13836 - DNA, 519 bp, Glycine max
  Peptide Sequence Number=SeqID_105521
atgacattaacctataaaactaggcgtatcacgaggccctttcgtctcgcgcgtttcggtgatgacgcggatgccgggagcagacaagcccgtcagggcgcgtcagcgggtgttggcggttgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctcggctagattatggtggggtatttcatgtgcctccctcatgggttgagagatatgtgcatgatcagattgaggttgttggctctcaatga

SEQ ID NO: 13837 - DNA, 84 bp, Glycine max
  Peptide Sequence Number=SeqID_105522
atggcaataacggaagctacagggctccaagggagcttatatagaagctttacagcagatttcagtaatgacccactaacctag

SEQ ID NO: 13838 - DNA, 186 bp, Glycine max
  Peptide Sequence Number=SeqID_105523
atggagtgggcatgtactgaagacgcaatacgtggggattctaagcctacaccaacacatagtggtgtagtttcaacttttaaacattggctaactgttatggaagtgatgaagaacaagcaagaacagcagcaagagatgcagcagaacagaaatgtcatacacacagatgttgtagcaaaatga

SEQ ID NO: 13839 - DNA, 552 bp, Glycine max
  Peptide Sequence Number=SeqID_105524
atggaatcctgggggaaaaccttcattgtagccttgaagggatttttgtctcaatattctgaatcttcatcagatcctaaggcgacatctacccaagttttctttggtagtttgggaaggcataatcagcctttgtttgtttggaagccaagtttgattcatattatctgggtcgatgacccctctattttgggtttctgggtagatgacccagcctgggttggtgaccaagatgttgtagatgaactcttttttatggttggcttaggtagagccaacttaaaacctttgcatgtgcttcttcctccccttagggagacttatcaaggtaatccttgtggcgtctatcctaacttatcttccttcactggaagtggcgtctatcctgagttatcttccttcaccggaagtggcgtctacccggatttatcttccttcactggaagtggcgtcaaccaaaaactctacagcctgtatcaagcgatccgccccgtaaggttcacgtcatctggtatcagagcttcggctcttgatacagactttgtgtcataa

SEQ ID NO: 13840 - DNA, 335 bp, Glycine max
  Peptide Sequence Number=SeqID_105525
aagtactgtacccagagacagggtcagggtgatgctccacaggccgcaggcgcgcccccaccacctcatcaggctggccaggctagggcatttgacatggagcagtatttacggcatttggttcgccagcaggcggccaaccaccgagcacatggctccgcttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatac

SEQ ID NO: 13841 - DNA, 357 bp, Glycine max
  Peptide Sequence Number=SeqID_105526
atgggcagaaatgtgtcagcattgataggtaaatctgttcctcacatttctgagaaatgtaagaacccaggtgatgacaaaaagctcaaaggtcaatcaaagaatgagttcaagatattcaagatagaatcaagaacacttcaagattcaaaaggaaagttgatttcaagaatcaagaatcaagattcaagagatcaagatttcaagaatcaagattcaagagatcaagattcaagactcaagattcaagaatcaagagaaggcttaatcaagataagtatgaaaaggttttctcaaaaattgagtagcacgtggatttttctcaaaacatgtttaccaaagagtttttactctctg

SEQ ID NO: 13842 - DNA, 510 bp, Glycine max
  Peptide Sequence Number=SeqID_105527
atggcctctggtttccatgtgcagaagctgtgtaactcgagtttgggcactggtaatcgattacatactttgattgtgatggcagcgcagttaatccatgatcgcgtggtgatggagtgcctagagggagtttgggagaccctcgaaggcaatgagaggtgccgattccgtggcacgattcgactcactgctacttcattggtacatccagaggaacccgcacgcacgcttcagcagcctgtggagtggatactacctacacctactccatatcgactagtggagccagttcaagtgatagaggtgtcatcctctgaagaggatcctgaggaggacccagaggagttacctcctgagtctgctatggatgctcttgacttacctgaggatgatgaagacccactccttgatgttgattttccagaggatatcatgtcagcatctgaggcagactctacagaggagagcggccctggagggacaacgaacagtgaagactcttcaacatag

SEQ ID NO: 13843 - DNA, 255 bp, Glycine max
  Peptide Sequence Number=SeqID_105528
atgatgataacaaaagataatgacaaaggtgatgacaaaaagctcaaagatcaatcaaagtcaactcaaataaatcaaagatcaatcaagaacaattcaagagttcaagataagaatcaagaagaattcaagactcaagaagaaagtctagagacaagaatcaagattaaaggttcaagatctcaagaatcaagatcaagattcaagactcaagattcaagaatgaagagaagactcaatcaagataagtattaa

SEQ ID NO: 13844 - DNA, 357 bp, Glycine max
  Peptide Sequence Number=SeqID_105529
atggaggccatgatgagcataaaggagataatggaggtcaatgcggttgcaatagccgctaccaacaccattgttgagatatggaaggtctggaaggcaaagagttggggaagtatgaggggccctcatttagtgcgaaaaacaagcatgccttcccaccatatggcttgcctcccaactatacaccacccaatgtggtatacactccaagtgaggatgtcaataactccgctcccatactcattgaaagctaacaacctcaatctgatcatgcacatgtctctcaacccatgtgggagacacatgaaatgccccaccacaattgatgcaatcctaccccgcaagggcattggatag

SEQ ID NO: 13845 - DNA, 369 bp, Glycine max
  Peptide Sequence Number=SeqID_105530
atgtccaaatcttttgaatttgggatgaccagctctctcgatgagtcgatctcttgctttctcataaggatggaccctcgggtactagtaccctggtcttcagaggactacacgtcctcgccaacagagggcttcacgccctcactttcagaggactgcatgttctcaccttcagagggatacacgccctcaccatcagaggactgcatgtccttaccttcagagggctgcacaccctcacctttagaggaccacacgtcctcaccttcagagggctacacgccctcgccatcagaggactgcgtgtcctcaccttcagagggctacacgccctcgccatcagaggactgcatgtcctcaccttcgtag

SEQ ID NO: 13846 - DNA, 467 bp, Glycine max
  Peptide Sequence Number=SeqID_105531
ttctggatgtttgctagtagatcccaacggtcacaatgtaggttcatgtactatagacttccaagttttctgcctttgctctgttttgcttggccgcgatagcttgtgctgtttgaatgttgttttgcttggatgttgtggaagcttgggaggattgatggggacccggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatatcgcgggggtcaggagaccttggggacgtcaggcttgaaaacgaggtcaggaagctaaggaagcctctggtaatcgattaccaaggggcctctggtaatcgattaccagcctgtgtaatcgattacacagaggaatgggtcactggtaatcgattaccag

SEQ ID NO: 13847 - DNA, 54 bp, Glycine max
  Peptide Sequence Number=SeqID_105532
atggcattaggggtcatggcagctcgcccaggcaagctaatgctttatcctaaa

SEQ ID NO: 13848 - DNA, 258 bp, Glycine max
  Peptide Sequence Number=SeqID_105533
atggtgcctcccctatcctcttctcctttgccttccgctgcatgtccatgtgacaattacctggacaccccacatataagggtgagcatagggactttgatgagaatcatgaaactggccaaatacaggttaaaggcccaagtggagaaggacaaagcccccgagtggagaaggaagaaggcccaagtggagaaggatgaaggctcaaaggcagagacactatcaagactattaattgttgttgaaggcccaaactaa

SEQ ID NO: 13849 - DNA, 392 bp, Glycine max
  Peptide Sequence Number=SeqID_105534
gtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttagaacctctaaggggtccgaatggtttagacttgagtagactgaaaaaagatatacagccttggcaagaacgccgttctgcggaatatatgactcatgctcctttaggccatttatggcacgcgggaagagctcgcgcagctgccgcaggatttgaaaaaggaattgatcgagattttgaaccagttctttccatgactcctcttaattga

SEQ ID NO: 13850 - DNA, 447 bp, Glycine max
  Peptide Sequence Number=SeqID_105535
atgggtaaagcggaggaggtacaagagaagatgaaggccgacatggaggccatgaaggagcagatggccacaatgatggaggccatgatgagcatgaagaagataatggaagccaatgcggttgcagttgtcgctaccagcgctgttgctaaggtgaacccgacgtccccattcggcatcaaccaaatgaatcatccaacctcagatatggtaggcaaagaattgggaagtacggacggccccatgatgtgcaaattcaaaatgagcacgccttcccgccatatggcttacctcccaactatacgccacccaatgtggcgtacactcccaatgggaatgtcaataactccactctggtactcattaaaagccaataaccccaaactgatcatgcacatgtctctcaaaccatgggggagacacatgaaataccccactacaatctag

SEQ ID NO: 13851 - DNA, 471 bp, Glycine max
  Peptide Sequence Number=SeqID_105536
atggataatgaagagggcatgcaggaacagatgaaggccgatctatcggccttaaaagatcaaatggcttccatctcggaggtcatgttaaaactccataaaactatagaggataaagtcacggcaaccgcctccagtacagttagggaagcggagccggtgctgcagcccgccttaaatctgggccgagacagaaacacggcagtgtttggtcggaggtatagtccgcaagcttacccctatggcttgcctccggacttcactccccgtgccaccccggaagatttaagccaagcccctactttcgaggggcaactcccaccttatgacgactatcctgggcaagacgatgaggaaggagatacccatctcggccccctgctccacctcaaagatccatccccccatgaactaccccaaccaaacatagtccgccatatctcggcttcacccacacccgtaaaagaatct

SEQ ID NO: 13852 - DNA, 111 bp, Glycine max
  Peptide Sequence Number=SeqID_105537
atgaagaatattccagattcaggagttatctttacgtttgaggaaggtctacaaaagcggggcgcttgctcctacgtaccctccatcgaagaggaaatcatacctacgtag

SEQ ID NO: 13853 - DNA, 530 bp, Glycine max
  Peptide Sequence Number=SeqID_105538
gcctggaagttgaaactccggaagaagacgaagaggtacaggccctcaagacagaacttgagaaagcccaaacagtcaaagaaaagttcaagtcaacaactattaggatccaaaaggagaatgtcgaactgagaggcattaatatagccactgccaaggccttggagcaagagaccaagagggcccgtagggaagaatatggccggaacaaattccgagggactctgtggggcagtaacagcgagcttaagctccgaagagaggaaagggaccaatcgtccaagaggagcttgtctcagctgttaagcgagaccgaaaccaacatgttagccatcatcagcaagtaccaagaagaattaaatctagccacggcccacgagcacaaagtagcggacgaatacgcccgagtgtatgcggaaaaggaggctagaggaagggtgattgactcgttgcatcaagaagcaacgatgtggatggaccagtttgctcctactccgcccccgaggagatccacgggctcctccgctatt

SEQ ID NO: 13854 - DNA, 219 bp, Glycine max
  Peptide Sequence Number=SeqID_105539
atggaaaaatctgacaagaaaaccttcaaagacaagaaaggaaagaaaacatacatcacttgggaagataatgacatggattcatcaggtgattcagaaaatgaagtcgtaaatctaagtctcatggccaaaaactatgaaagcgaagaaaaggattcattgaagaaaagttggtacattgacaacagatgctctaaacacatgacgggagatgcatga

SEQ ID NO: 13855 - DNA, 138 bp, Glycine max
  Peptide Sequence Number=SeqID_105540
atggagacaacaaacaaaggccacttgatcaacaaccccaacaattactggaagttggaagttggaaatgaaagttattggaagttgaaagttgaaaatggaggttggaagttggaaggggaagttactaaaagttga

SEQ ID NO: 13856 - DNA, 299 bp, Glycine max
  Peptide Sequence Number=SeqID_105541
atgggatcaagtcaaacgccttcgcttaaaaagaggttttaccaagtcaaggtcaagagcctagggatcaccagtctaaaggagttagggctgttaatgggtcagctccagcggcaagcttttcgcaaagcttacggtaaaatctgggacttagccatggtagaagtctccacagaggccattgcctcccttgcccatccaaatctcggcacaggaactagaccaccaaaagcaagtcgaaaatggggtggtcgggataccgagaaaatgtttggaggaaaaagcaagaatcttggcag

SEQ ID NO: 13857 - DNA, 416 bp, Glycine max
  Peptide Sequence Number=SeqID_105542
aaaccgacaagaggaaacgaagcatagcactcaaagcctcctcctcaatacaagaagaagaagaagatgaagaatcagaagatgaagaaggcctttctctctttgtgaagtttcacaaatttgtcaagaaaagaagaattgagaggcgtcaaaatttcaaccatggaaaaagattccaagaagactctccaactcttagatgctacaagtgcaaccaacttggtcacatcaaagcaaattgcccctcaaacgagcaatggcctgagaggaatgagaagaaaagtcatgaagaaagaagatccaagaaggcgtatattgcatgggatgacaatgactcatcagatggtttggagaaggagattaaccttctatccaaggactatgagagcgatgagaacatctctcaagaagactaa

SEQ ID NO: 13858 - DNA, 426 bp, Glycine max
  Peptide Sequence Number=SeqID_105543
atgaaagccaacaaaacaagaaatgaattgaaagtctcggattcagaaacttaccggttgaagaacgtagaacgaacgaagaacggcggaaaaccttcacggatttgctcacgaaaacatctcagaagcgttacggaagcacctcggctaggattttcttcactgaaacattttttttcacccaaaacagctaaaatgcatagccaagggttatgggaattttacggaagcattacggaagccttacggaagcatatacggaagacaaaggagaagaggagagagcaggcgccatccactaggaataagccatggaagaaggagcttcaccatcaagatgagccttggataagaagcttggagaggatgcttgaatggaggaaaagaaagagggagagaaagagagaggggggagcacgaaattga

SEQ ID NO: 13859 - DNA, 654 bp, Glycine max
  Peptide Sequence Number=SeqID_105544
atgacccctaccactggaaattgtgcagtgatcagttctgtcattcttccacaccgggaggtcatctgggtgttcaaaggacagctcgcaaagtgcttgactgtggcttttactgacccaccatctttaaagatgcgtggaagatttgtagcacttgtgagcagtgtcagagagcaagaagtgcacttacatggcaacaacaaatgcctcagcaacctatgctattttgtgaggtgtttgatgtctgggttgattatgtttcaaaatgggtggaagccaagcccactagaactaatgatgctaaggtttggagtacctaaagcaatcgttagtgatcaaggaacccatgggacgagtgaacggtggaacaaaaattgtatgcattctctttatttcaggactgccatcataaaaaagggggagattgtggaagtattgccttccaaggttattttgatgatgctaaagaatcaagagttaatcaagattcaagaatcaagtttcaagaatcaagatacaagaataatgaagatcaagtttcaagattcaagattcaagaatcaagtttcaagaacaatcaagatcaagattcaagaatcaagagaagactcaattaagataagtactaaaaagttttttcaaaacattgagtag

SEQ ID NO: 13860 - DNA, 174 bp, Glycine max
  Peptide Sequence Number=SeqID_105545
atggaggagcttgccgcccagttgcttcctccttcacaaaactttacggattcctccgcgatgagtattaagccttctgaagagataaacaatggccctcggatgaaattatatgaagctagcgttgagcggttaagagatccgcttagcgtacaagctaccgcaagcaattaa

SEQ ID NO: 13861 - DNA, 369 bp, Glycine max
  Peptide Sequence Number=SeqID_105546
atgccctttatcattcaggaacaacaagctgagtggataaacgtgcagatacatattctgcaccctttatcattcaagaacaacaagctgagtgggttccgctggcaggaaggttcactggccgaaaggtgtttcgctcgaacgaaattagtgtcttatctttacttcccttttatctccaataaaagacaagtaaagaggggcaactgtcataccctaatttcgtccggggacctttgcttggtggcatgcaactttcatttgaccattttgaggtacttggcatccatcgttaggcaattcgtgaagttccgtgacatgccggaactcaaaaggaagcatcattgcacaattcgtgaggttacgtaa

SEQ ID NO: 13862 - DNA, 171 bp, Glycine max
  Peptide Sequence Number=SeqID_105547
atgtcgttggacatgtgttccaaaaaaccttataatgaggctattggaatggtttcaaggtatgctttaaatcagattgctgctgaattagagtgtgttgactatgttggcaagaatcccttaagttgtgagttgcgtggtgagaaccacgctgtggtcttctttgtgctt

SEQ ID NO: 13863 - DNA, 504 bp, Glycine max
  Peptide Sequence Number=SeqID_105548
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcagcgagctgcgcgatgagtccgacaaggacggcatgcgcatctacatcgagatcaagcgcggtgaatctgccgaggttgtgctgaacaacctgtaccagcagacgcagatggaatcggtgttcggcatcaacatggtatcaagcttatcgataccgtcgacctcgagggggggcccggtaccagcttttgttccctttagtgagggttaa

SEQ ID NO: 13864 - DNA, 309 bp, Glycine max
  Peptide Sequence Number=SeqID_105549
ctgtcccctcctgtttcagctactgacgtggtggtgcgtaacggcaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 13865 - DNA, 192 bp, Glycine max
  Peptide Sequence Number=SeqID_105550
atggaggactttaaccagttggtgggagttctcagccaattaacagggtgtctcagcctgtgtgggaagtgtggtcggcttgggcataatgctcgtgagtgcatagatagagaggtgacttgctttaactgccaaggaaaactgatgttaagttacacaaacaacatcggtattttgaggaaccgatgttaa

SEQ ID NO: 13866 - DNA, 582 bp, Glycine max
  Peptide Sequence Number=SeqID_105551
atggtcatagaccagtcccttttctttgaactcactcaattatccagtgatggtgtaccatttaagggtacacttgatgatgagtggaagtttgacttttctgtgtctgatgcccgtcagatggtttgcaccaaccaagcggatatgattggaaggcttcttgccggttcattggcatttgaatgccgcatcatgcactacttgattgtgcgtatcctactccctagatcttccaaccttgcacagccctttgtcaaagtcaagagatccttctctatcagtgcaaatgtagtctcttcctttggttaccgcaaaaagcgtgatggctcttgggtaaaaaagggtgctcaaccaaatgatgatgaaggacacttaccggttgaagggaactcttctctccttcagagcattttggacaggtttgatggacttcaaacctatgttggtgagaggtttgactccttggaacgtcaagtggatacacaattcgaggagataaactcaaggattgcaaaggttgaagaatatgtcaccatcattcacgactgccttgatttacctccaccaccaccatcctcgtag

SEQ ID NO: 13867 - DNA, 428 bp, Glycine max
  Peptide Sequence Number=SeqID_105552
agagacctctagtctatgtgtatcctgcaatcgggaaagccaatggtccccacagaaagaagttaagaacatatttgggaatcgtcgctcgtgataaggtcgatgtcacatacgagaattggaaacaagtccctggtactcagaaggattttatatgggaaaatattcaggctgaatttgatatccctaaagcatcagatctaaggacaaaaaagaaaatacttcagactgtgggggagcggtggagacaatttatgtttgacttgacctccaaatgggcacttgcaaccggcaaggaaagtgtcgatgacactgtatgcaaaaagtacgacattggcaaagagaagatgtgtgaaaaaagacacaggtcatccagaaacaaaacattgtccctcacgtgttgtctcgtgggagttatgaatatctag

SEQ ID NO: 13868 - DNA, 267 bp, Glycine max
  Peptide Sequence Number=SeqID_105553
atggtgaaagttggaacctcttaccgtgccgatcaacgtctcattttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 13869 - DNA, 384 bp, Glycine max
  Peptide Sequence Number=SeqID_105554
atggtgaaagttggaacctcttacgtgccgatcaacgtctcattttcgccaaaagttggcccagggcttcccgggcgcgtccctttcgccattcaggctgcggcaactgttgaggaagggcgatcggtgcgggcctcttcgctattgacgccagctggcgaaaggagtgctaaggcgattaagttgggtaacgccagggtttcccagtcagaagtgctcatgtggcaggagaaaaaactgaccgggccagtcagaatatgtgaatacagactcactataggtcgcgaattcctcggagctccaccgccggtcttcggcggcgagcgcagaaagtggtccccacgggcgcaggaattcggacaagatgcttcaggagatacttaa

SEQ ID NO: 13870 - DNA, 213 bp, Glycine max
  Peptide Sequence Number=SeqID_105555
atgggaaagttggaaccttctcacgtcccgatcaacgtctcattttcgccaaaagttggccccagggctttcccgtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 13871 - DNA, 177 bp, Glycine max
  Peptide Sequence Number=SeqID_105556
atgctagaaattgaaaatagatgtgtcgcaacctacccttcggcgggagggcgacgcgtgactcgcgggatgcttgttccacgaaaggaatacgcgcggagtcgccaccaacgtttagttgaggaaaacgtcggaaaaaccggaaaagacgcgatctacgaacttttaagtgaaaag

SEQ ID NO: 13872 - DNA, 105 bp, Glycine max
  Peptide Sequence Number=SeqID_105557
atggcctcaaagaaagaagacgacagacatgctgggaaggaaaaaggaaggagatgtggcctaagtaggtacaacaaaaggccaccgactgagacgatggcttga

SEQ ID NO: 13873 - DNA, 908 bp, Glycine max
  Peptide Sequence Number=SeqID_105558
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatataccttgaaagatatagagaaaaccagaggagcccaatctttcctaagcactgacaacatttttgtcacaaccaagtatgtgacatttcttatgttgtcagtgcttaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 13874 - DNA, 90 bp, Glycine max
  Peptide Sequence Number=SeqID_105559
atgtcttgcaaagaaatggcttcgagaaagctttccataaagagatctaggaaggatgccgcggctgaagggactagtgctgctccttga

SEQ ID NO: 13875 - DNA, 120 bp, Glycine max
  Peptide Sequence Number=SeqID_105560
gagcaagctggcaatggagtactaaagtcaatgagacgcaagaagtatccaatccaagctcgtgcacactgccaacatcaccaacacagcatgaccaacagcaccggcaagaagaagtag

SEQ ID NO: 13876 - DNA, 638 bp, Glycine max
  Peptide Sequence Number=SeqID_105561
tggcttctgtttctatcagctgtccctcttgttcagctactgacggggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttctgagttacttgagttaaatccaataataaagaatatcaatctaataagaccaggttggaaacttgtttattacaagaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13877 - DNA, 216 bp, Glycine max
  Peptide Sequence Number=SeqID_105562
atgagtgtctctaccgattcagccttagtcagcaggggtagggttccgctccttttgcatgccctactccgaagcagtttggggctgaggtcgcatggcccagagattgccccgaggactaggcaggggaggagcctacaggatcccccggtgaggcagaggaggccccttaacattacgtgttttttcgtttaccttgtggttaggcgtgaatag

SEQ ID NO: 13878 - DNA, 908 bp, Glycine max
  Peptide Sequence Number=SeqID_105563
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgtttataatccagctttcttgatgtcacaagccgatacttcacatcaattgacttccaccaaagtcccattggataacctcaaatgggttttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13879 - DNA, 189 bp, Glycine max
  Peptide Sequence Number=SeqID_105564
atggcttcctatggtggtgagcttcttcttgactcaacttctcctggaagtgagcgtctcctctcaactcttcttcttctccattccgctgccattaaaattcaagaagcaaaggacaacattgatgaagaggacccaaggcctacaagctccaatggagctacatcatgtggttctatcattttttag

SEQ ID NO: 13880 - DNA, 633 bp, Glycine max
  Peptide Sequence Number=SeqID_105565
atgcaagtacaaccagaggaggaggctatcgtgcggctactatgcataccagggcaagattttaaccgtgccgctgcaaagagacgagtgcggatcatgcgtaccaacatgaccgctattacacagatatggatgatgttgctacttagcaacattctgcccagcgaccgtaatgccgatctctccctgcgaaaggatcgtgcccacaaaacacccagtggacccagagaagtccaacatggtcctggggtctctagctttggttacgggcctcaagatcgcgcccgcaagacacccagtgaacccggagaagtccaacagggttctggggtttccagctctaattacgagcgtctgtcaattttacggagtgcctgtcacccccagcaaggtcatctaggccccgcattaaccgggctttcatcaagaagtattacgccccctgtcgcaacctacccttcggcgggagggcgacatgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgcggggaaggtattag

SEQ ID NO: 13881 - DNA, 780 bp, Glycine max
  Peptide Sequence Number=SeqID_105566
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacggctgctgagtttgactacgctgggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13882 - DNA, 145 bp, Glycine max
  Peptide Sequence Number=SeqID_105567
atgggcgcgctcggcacccagcggcgcgctggcgccgatataggtgccgaccggcatgatccgccgttccagctcgggcagcaggccctgcagccaggcgttgccggccaccaccagatgcgcggcgcgcacgcttccctgcgcg

SEQ ID NO: 13883 - DNA, 351 bp, Glycine max
  Peptide Sequence Number=SeqID_105568
atgggcatgcttactcatctcagtgtttggggtcgatgtgatggcatcaagtccttccctaaggagggtttgctgcctccctcccttacgactctgtatctatttgacatgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaaatttcccacatccctagcatttggttttacggtagattgatttag

SEQ ID NO: 13884 - DNA, 1257 bp, Glycine max
  Peptide Sequence Number=SeqID_105569
atgacttcctttcgcgatttggagcagaaatggtgtgcaaaggttggagctttgttggagcttcaatggtggaggaagaagaagagaatggcaacgatgtcacaatctacaggtgtcctctaccagaggaatgagaagggggtgcttgcaaaaaggactttgacgctcaagaaaggctcatttcaactcccgccagttagcaaaagtttgcatcctcatttaaataaggcatacattaggatttcatcatcatcacgcttaagcaccgctattgcttcgtctctgcaacttgctctgattgttatgttctttgcaactccggctgaaagctatctggaactgttggatccttcctccaattttcttcttcattctaggtactcctcattcttgacaatgtcttctcttttttattccacattgggtatgggtggaagcgcttccaagggttccatccaacaacccttggtggaattggaagtggttcccattagcgattcctcgttagaggagtttcctcataaggcttccgaaagcgggtcctcctccttcgagaggttgacagatttgagtcatgttggcgagggcagctctcaacactgtgagggggtggagacctctattactactctggaaaaagaacatatccctatcacaacaatccttccctttcccctttcagtggctaatggaaggggtgacgacaatagagtcagggtttcaccccgaaacaggtgtcgtcatggtggcaaatacgagcttgagctggccaagccaagcgaccccagcaagatgactgtccaggcttgcagggaggacaagttcccattcatgtgcgctgatccaggttatccacccttcttctacgtctatcactgcatgttcaaggtcctgaacttgacctttctgttgaacaccttccaaattgccatactgaggcacttgaacgtgacccagtgtgctcgtgttcccctatttctttcaaatgaagccaaccgggaagattggttaggtgtcactaaacaacgtgctaaaaagatgttcgagttcaactcaaacatgtttcacaaattcaaggaccatttcttcaaggtcaaggcaactagcatcattgcttatgggttgccacagatgcatgatgggaatggggaacctcgtatccccttttacgggcaatcgggccccatgaggttgaagtccttcgatgagcatctgatgcctctagaggatatggcagacaaggctctcttggaatga

SEQ ID NO: 13885 - DNA, 300 bp, Glycine max
  Peptide Sequence Number=SeqID_105570
atggctggggagcttagtttcctccaatgcaataatcaacaagatctaccatgtctttatcttcctctgctcttcctccatctccttgggaaacttcttgggaaactacaggacatgcctcctcctgaaaataggcctatctctaggccatgcaacaatagctctaaattgcttggtagtaggccaagggtagggattagggtcctggcgatgctgagctccatcctttgcaggtatgctgagatggactccaaggatggtgactgttgtggtggtggtggagcatctgctactggttga

SEQ ID NO: 13886 - DNA, 399 bp, Glycine max
  Peptide Sequence Number=SeqID_105571
atggatgaatatccacacttagtcaccctcttccttcaacactttaacatccctcttgattttgaaccctatgttccaatgaaggggtcctttctaataggcgcttcagtcattgcatcctttggttatcaaaaagagcatgatggctcttgggtgaaaaagggtgctcgacatgttggtgaagaaggacatgatggagaagattcatctcttatttcaaagattttggacaggttcgatggtcttcaaacctttgttggtgaaaggtttgatactttggagttacaagtggacatgcgcttcaatgaaatggagtcaagaatcaccaaggtcgaagaagatgtctcttatattcgttcaagctttgatctaccaccatcgccgccaccatcattttag

SEQ ID NO: 13887 - DNA, 409 bp, Glycine max
  Peptide Sequence Number=SeqID_105572
atggcagcagaatccgcagtgattgtggcaatcagtcctttagccattattgatatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 13888 - DNA, 504 bp, Glycine max
  Peptide Sequence Number=SeqID_105573
atgaaaagaagcattgcgggaaggaagaacaatggtcaaaattcgcattggagacaagaaggtgaaggaagcccgccctgccacataagtagaagctttataagtgcgggttcgggagacaaaggtcaagcgttcgcgatatgcgaagatgatattccgagtactttggatttggtacgaccatgctctcctgatttccagctgggaaattggcgagtggaggaacgccccggcatttacgcaacaagcataatattcgatgacgagtcccccgaaggtactaatacctgggacccgtctatcaacttcgagcaagaaatgaatcaaacggaagatgaaggagatgaggatgtgggacttccttcggaactagaaagaatggtcgcccatgaaggaccaagaaatggggcctcatcaagaagaaacagagctagtagacttaggaattggcagtggaaagagggaagtaaagataggtacaggcattaccgcacctatccgtga

SEQ ID NO: 13889 - DNA, 836 bp, Glycine max
  Peptide Sequence Number=SeqID_105574
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgagggagtcattggaaatgacgatggagttatgggacttggaccaaaacgcgaatggagcgggttcctagtaagggttaccaagaggttggatgctaggggtgctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13890 - DNA, 309 bp, Glycine max
  Peptide Sequence Number=SeqID_105575
atgaccattattgtcaatgcgaaagatgttgtttacacaaatgagcacatcttaaaagaatactccgcacaatggtggcctcttaggaatgaagcggcatttcctccttctgatgatgcatggacacttatccctgacccaactacaattcgtgcgaaaggtcggccaaaatcaacaaggataaggaatgagatggattggctcgaaccatctgaccaccaacaaaaatgtagtagatgtggagcagaatggcacaataggcgccgatgtccaatgcaatctgaccgtgggagtaattcatttaattga

SEQ ID NO: 13891 - DNA, 171 bp, Glycine max
  Peptide Sequence Number=SeqID_105576
atgttgttaccaccggtgctgcctctgattccccatctgacaggaatcaagcacacatactgtgagcatggggaatcggagtatggcacatgtgttaggagaaggtcaagtgaagctagagttatcttcaaggaatttcattattttagatggcgtctatcatatttctga

SEQ ID NO: 13892 - DNA, 411 bp, Glycine max
  Peptide Sequence Number=SeqID_105577
atgagtcatcattcatctagtgttaatggggagggtactattcataaggaccctctatctagaatattagatgagttgagttcccttaagttatggaaagaaaaactagaaagaaaagaaaaaggaaaagagaggagcctaagtgaagaacttagtgactattatagaggaaggcataggtcacatcctagacctcactcccatagtagagaaaaggaaagaaagcctcaagaggctaacattaacctcccatacttacatgggaaggacaatgtaaaggcttatttagattgggaaatgaaggttgagcaactctttacttgccctcatacaagtgggaaaaggaaggttcctttgactacccttagcttccaagggtatgccctctatcggtggacttccctttgttag

SEQ ID NO: 13893 - DNA, 864 bp, Glycine max
  Peptide Sequence Number=SeqID_105578
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttccgg

SEQ ID NO: 13894 - DNA, 723 bp, Glycine max
  Peptide Sequence Number=SeqID_105579
atgccgatcaaaccacgcatgcgaatcgccgctgtggttgaacacgccgtccaggatcaggcgcatcccctctttttgcgtattcttacgcaagcgcagcagcgcctcgtcgccgccaaactgcgcatcaacgtggcgataatcttcggtatcgtatttgtgtacgctcggggctttaaacaccgggttgaggtacagcgccgtcacgcccagttttttcaggtacggcagcttttcgctgataccgtcgagatcgccgccgtagaaggtcgagccgcccgcctgcgcgatcttatcctgatcggcagtgcgcttttcgctgcgcgcaaaacggtccgggaaaatctggtaaaagacctgatcgttaacccactgcgggccgttatccggataatcgaccgcaaactgctccagccgtgcaggcgggaaacggctaaacccctgcggggtaaaccacagttggcggttgttccacaaaagcttaaagctgtagcggcggcgcggctgtccgctgttcagatcgatattcgcccgccaggcggtaatacccggctgcggctggctgcgcagcttgtgcattttcaacccggtctcttcgttatcgatttcggcgcggagcgtcacgcgctctggctggttttcccccgccagccagagcgtaatcacaaggttgtctttgttttgcttaacaaatggggcaaccggaaggtgccaggcgtttaa

SEQ ID NO: 13895 - DNA, 1167 bp, Glycine max
  Peptide Sequence Number=SeqID_105580
tggctggcgctctacccgctggcggcgctgccggtggcgttcgctatcaccgccgggatcggcatgctgctggagcgcacggtgatccgccacctgtatggccggccgctggaaaccctgctggccacctggggcatcagcctggtgctgatccaactggtgcgggtgctgttcggcgcgcagaacgtcgaggtcgccaacccggcgtggctgtcgggcggcgtgcagctgctgccgaacctggtgctgccgtggaaccgcatcgcggtgatcgcgttcgtgctgctggtgctggcgttgacctggctgctgctgaacaagacccggctcggcatgaacgtgcgcgcggtgacgcaaaaccgcgcgatggcggcctgctgtggcgtgcccaccgggcgggtggatatgctggccttcgggctgggatccggcatcgccgggctcggcggggtggcgctgtcgcagttgggcaacgtcgggccggagctgggacaaggttacatcatcgattcgttcctggtggtggtgctcggcggcgtcggccagctggcggggacggtggcggcggccttcggcctcggcatcgtcaacaagatcctcgagccgcagatcggcgccgtgttgggcaagatcctgatcctggtgctgatcgttctgtttattcaaaagcgtccgcaggggctgttcgccctcaagggcaggaaagcgccccggctggcgttgagcatcggcgcgctggcgttgctggcgctgctggtcatgccgttcatgacgctgttgccggcggatcatccgctggcggtgtctacctataccctgacgctggcgggcaagatcctgtgctacgcggtggtggcggtggcgctcgatctggtgtggggctatgccgggctgctgtcgctcggccacgggctgcggcgggcgacgggctgccggcgtttatggcgttcctctcctggaatgagctgccgtggttctggagcggcacccagcatttcgcctgggcgctgtgcctgatcgtgctggcgctgacctatgccggcatgctgctgttctttcgcaatgagaccggcttcggcggcaataacggctttaccggtttcaccacgctgctcggctttcccatcaccggccccggcacgcggcgtggcgctgttcctggcgacg

SEQ ID NO: 13896 - DNA, 432 bp, Glycine max
  Peptide Sequence Number=SeqID_105581
atgaacgaaatcactgtgtcacgcctcggttgcatcgtcctgtccctgtttccggccctgtgggggctgttcagcctgttgaacaatacggcggatttcgccggcaccgcgcgcaacgcggtggggccattgcttgccatgcaggatacctatcaaacgccggggctgatgtggcgcgcgatcggcgccgactgggcctgcatgttggggttggctgtcatcaccacgctggaaacgctggccggcctattcgcggcggcgggcgttttgctgatgatcgggcgatttaaaggcccttacgccgccttcgccaagggcaaaatctgggcgatgctgggggcgctttgcgcgatcgcggtgtggggcgtcggctttatggtggtcgccggcgactggtttatggcctggcaggccaagcaggatccgctggcg

SEQ ID NO: 13897 - DNA, 327 bp, Glycine max
  Peptide Sequence Number=SeqID_105582
atggataagagcttgaaggtaggagaagatgagtggagggaaaaggagagaaggagcatgaaattttatgcctcaaatgagctatggttcagcccactaattcaagatcaagtccaagattctccacttagtgtgcttaggtgtcatgaggcatatgaatggcagcggaatggagcaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 13898 - DNA, 135 bp, Glycine max
  Peptide Sequence Number=SeqID_105583
ggaaggttgaggaggagcctcagtgatgcaatcctccctaggaagggaccaatcactagaaccatgagcaagaggctccaagaagattgggctagagctgctgaagaaggccctagggttctcatgaaccttagg

SEQ ID NO: 13899 - DNA, 213 bp, Glycine max
  Peptide Sequence Number=SeqID_105584
atgacgtttccacatgctatcaaactcgatcgtcctcgcctagcagagaagaatctcgtgcgtcatcgggcttcaatgtctctgaatgacgaaagtgtggataaccaaaaggtatcccccgcatgtcatcggactcattgtccctggatgacaaaaggtgcagaagacgatgttagtctctgcgcgtcaacgggctcatttgcctctggttga

SEQ ID NO: 13900 - DNA, 63 bp, Glycine max
  Peptide Sequence Number=SeqID_105585
ttggacgcatggccgagtggtaaggcgggggactgcaaatcctttttcccagttcaaatccgg

SEQ ID NO: 13901 - DNA, 445 bp, Glycine max
  Peptide Sequence Number=SeqID_105586
atggcgtcaacaatcacctgggccacatggacgctcatccgtgtcaggatggcatacaccaactggcacttaggcagagggagatcggagttcgctaggcaagacattgctgagcagcagtgtcatccacgtctgggtcaaggtggtcatgttgtgtgcatgatctgcacccgcctccctgcagcggactaccttagggtcaaacttagccatgggagtcaccaacgacgtccaatgcctgcgagctatctcctcctaaaaatctgtatactcatcctccctgagctggacgcgcctctctctgtggaacgaccatcctttgatggcctcgaagcgttgctggtgctcggcgctccggaaacagtggctatcaaacttaggggcggcactggacccttccgctgcggcgtctctcctagacctcttcatggaaagctttttcgaa

SEQ ID NO: 13902 - DNA, 270 bp, Glycine max
  Peptide Sequence Number=SeqID_105587
atggcttcctcttcaagctcagttctctgccagtctttgcatagcaaaagcggccttgttggtgcctacacgcttagcgcaactctggctcgcttagcgcgcataagtgaatttaggcttagcgtgcgtcttctcgcttggcggatgcatgcaagcgatgtgcttagcgggatgagcccttgcttagtgcgtgtgtccaactcatccttcttccagattcttcctcacgctcaatcgcaagagtggtgcactcagtggatggctcgctaa

SEQ ID NO: 13903 - DNA, 237 bp, Glycine max
  Peptide Sequence Number=SeqID_105588
atgtctccttatcgggttgcctttggaaaggcatgtcatcttccagtggagattgagcacaaagcatactgggcagtgaagacctgcaacttctctatggagcaagttggtgaggaaagtgttgaagcaaagcttcatgatgatgacaaaggtgatgacaaaaagctcaaagatcaatcaaagaacaacttaagtgaatcaaaggtgaatcaagaacagttaaagagttcaagataa

SEQ ID NO: 13904 - DNA, 459 bp, Glycine max
  Peptide Sequence Number=SeqID_105589
cgcgcagttgggcaccgtaacccagctttccggttcatccccgcatcgccagttctgcttaccaaaaatggcccacttggagctctcgattccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcag

SEQ ID NO: 13905 - DNA, 827 bp, Glycine max
  Peptide Sequence Number=SeqID_105590
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagagctgtatccagaggtaggttggaatcatccttgtcaatttgatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13906 - DNA, 754 bp, Glycine max
  Peptide Sequence Number=SeqID_105591
atgtcagaaagatacacccctgcgccatcaaccactggtacctggaccgaagaagagatccgccagcaaccaggcagctggatccaatctttaaagcatatcgatcgtttacgagcggagattgacggctttctcacgccgctactacgaaaaaacgatctccgtatcgtccttaccggcgctggaacttcagcatttattggcgacatcattgcgccatggttatcccgtcatagcggtaaaaattttagcgccgttccaactaccgatctggtgaccaatccgatggattatctggatcccgctcatccactgctgctggtctcattcgcccgttcaggtaatagcccagagagcgtggccgcagtgaaattggcgaatcagtttgttacagagtgttatcacttacccattacctgcaacgaagcaggtagcctgtatcaaaccgcgctggatagcgacaacgctctgccgctattaatgccgccagaaactcacgatcgcggctttgcgatgaccagcagtattaccaccatgatggccagctgccttgcagtgttcgcacccaacctcattaatagccatacattcagcgatgtcgctgactgctgccagacgattcttaactcgctgctcgatgttaacgctggggttttcggcaacgaagcgtggaaaaggatcgtttacctcggtagtggcgggctacagggcgctgcgcgcgaatccgccctgaaagtacttgagctcacggcag

SEQ ID NO: 13907 - DNA, 387 bp, Glycine max
  Peptide Sequence Number=SeqID_105592
atggcagagatgattaaacttggtgatcaaatgaggagaatgagttatgacaatgaagaaaggatggagaggatgaggagaaagatgcggggtatgaacatgatgagggaggatagaggaatgagaggtatagggagagaagaaatcatagaagatatggagatccctacttttaaagggacttgtgattcggaagtgtatcttgagtgggagatgaaggttgagaagggatttgccttagtgtggtggaatcaagtgaggagtgatgttgagaggatgataaggcctttgattaatacttggcaagacataaagagagttttgagagagagagatttgtgtcgtcctattatgggagataccttcacaacaagctccaaagactaa

SEQ ID NO: 13908 - DNA, 441 bp, Glycine max
  Peptide Sequence Number=SeqID_105593
atggcgaggattcctgacaagattaggtctattgatggatcaaaagagacgcttaagcttactgttaggatcaccaatctttggttcgttgggactcccaacaagtatgagcaagcggaaatggtttttgttgattctgagggtgatcaaattcatgctatttgtaaatcggaccacctcaagtcttggaaagctgatttgaaagataattgcacttatgttatgcataatttcaaagttgtcaagaatgatggtcaatttagagtgtgcaaacatgagtacaagttattttttattggagtgacggttgttagagaagctgatttgcatgaactgccttttaaggaatttagatttgttgaatttgcaaatgttgttgctggcaattgtgtctggcctgttggttggagagtacagtcacaatttgtgctttcgttttga

SEQ ID NO: 13909 - DNA, 409 bp, Glycine max
  Peptide Sequence Number=SeqID_105594
gaccttgaaagcactctgtccctccgcgggggcgaagggttgcaccgggggagcgacggcaccgctcatccgtcgccgaggagttgctgcagggggagcgcgtgagcggagaagtccgctccttgggggagcatcgtgggatggccgggccctcttgaagagaccagtcgcgcgggaggagtccgacggcgtcgaacgggggacaggaggcggccaggcgcgccgccgtgccgccgcgatggtcgaagcggtcggaggccagcgccacgatgtttcacgtgaaacggacctaggcgcctggggagggggtgccggagctggaagggccaacggtgtgatcgccagtcggccttcggtcgctgggtgtctcgctcgtggggcgtacagctcatcgcgtgcagctccgtga

SEQ ID NO: 13910 - DNA, 178 bp, Glycine max
  Peptide Sequence Number=SeqID_105595
gctttaagggagccgtatgaggtgaaaatctcatttgatgcacaatcaaaatatggtttttggggatggaatttgtggcgtcaacctatgggtttcattgtttttctaatctcgtccctagcagaatgtgaaagattaccttttgatttaccggaagcggaagaagaactagtagcgg

SEQ ID NO: 13911 - DNA, 201 bp, Glycine max
  Peptide Sequence Number=SeqID_105596
atggaaaaatccgacaagaaaaatttcaaagataagaaagaaaagaaaacatacatcacttggaaagataatgacatggattcatcaagtgattcaaaaaatgaaatcataaatctgggtctcatggccaaagactataaaatcggagtagagatgcattcaatgacttgcataaagaatctatcaaacttgccaaattag

SEQ ID NO: 13912 - DNA, 867 bp, Glycine max
  Peptide Sequence Number=SeqID_105597
ccggcttcgtccctggcttcgcgcacccgcatcaaaacgctgaccgaagacacccgcatcgacaactcgcgcttcttcggcggcgacgtccgcgtggtgccgaaatatgcgctgaccgtcggcgtgggtacgctgctggacgcggaagaagtgatgatcctggcgaccggccacgccaaagcccaggcgctgcaggcggcggtagaaggcaacatcaaccacatgtggaccatcagctgcctgcagctgcacccgaaagcggtggtggtgtgtgatgagccagccaccatggaactgaaagtgaaaaccgttcagccgggagaagagatgatgtacgcattagttaacggccggatttttaccggtcatgaagttctggacaatcacgccgtggtgattgccaatggcctgattgagcgtgtctgcccgcgcgatgcgctggacgccgcgattccacaacaagacgtggctggtgcgttcatcgctcccggatttatcgatctgcagctcaacggctgcggcggcgtgcagttcaacgatgacatcaatgccctgagcgtagaaacgctggagatcatgcagcgtgccaatgaaaaatccggctgcaccagctatttaccgacgctgattaccagcagtgatgaactgatgaagcgcgcgattgaaaccatgcgtgcttacctggcgaagcatcagaatcaggcgctgggcctgcatctggaagggccgtggctgaataaagagaagaaaggcacccacaatccgcagctgattcgtctgccggatgcggagctggtggatttcctgtgcgccaacgctgacgtcatcaccaaagttacgctggcgccggaaaatgcgggcagcgcg

SEQ ID NO: 13913 - DNA, 611 bp, Glycine max
  Peptide Sequence Number=SeqID_105598
atggtgaaagttggaacctcttacgtgccgatcaacgtctcattttcgccaaaagttggcccagggcttcccggtatcaacagggacaccagcgtttatttgcaattgcaattgtgtatgctacaccaacacatcattgatgatcaagctatcgataccgtcgacctcgaggtgctccagtggctatcatggtttctatcagctgttcctcctgttcagctactgaaattggttagcggctgcccgctttccattcgaccattcggtgcgcaactggtgttccagtcgaagtgcgttcatgtggcagaaaaaaaggcgacggtgccagcagaatatgtgaatacgactcactataggaattcggaagatccagaagaacttaacaggaagcaagccgtttatcatcacataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgg

SEQ ID NO: 13914 - DNA, 226 bp, Glycine max
  Peptide Sequence Number=SeqID_105599
gggagaagcttgccgcccagctcgcccaggcgagcagggttgcttcctccagaagcaacaaccttctggaggaatcttctggagggcccaagttgtaccatttgtggtggtgctaatgaatccggccattgtattccttttgaagaacaaatgcaggaagttagttacatggcaaatcaacaaaggcaaggatacaaccaacgaggattctcaggtttccagcaag

SEQ ID NO: 13915 - DNA, 378 bp, Glycine max
  Peptide Sequence Number=SeqID_105600
atggagacagtaggttttcatgttctgaagctgcgtaattcgtgtttggcctctggtaatcgattaccaaggctgtgtaatcgattaccagagatgaaaagccttgagatcgtgatggcggcgcaactaatccatgatcgagtggagatggagtgcctagagggagcttgggagaccctcaaaggcaatgcgaggtgccgattccggggcacgattcgattcacgactacttcattggtgcatccagaggaacccgtgtgcacgcttcagtgcactgtggagtggatactacgcacgcctacaccatatcgtctagtggagccagtccaagtgatcgaggtgacgtcatctgaggaagaccctgaggaaacctcctga

SEQ ID NO: 13916 - DNA, 833 bp, Glycine max
  Peptide Sequence Number=SeqID_105601
atggtgaaagttggaacctcttacgtgccgatcaacgtctcattttcgccaaaagttggcccagggcttcccggtatcaacagggacaccaggatttatttattctgcgaagtgatcttcccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggttctcacctcaccgctgcatcttcacgtcgtctctaacggtaataccctttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13917 - DNA, 318 bp, Glycine max
  Peptide Sequence Number=SeqID_105602
atgatggtggcccgggtgatgttggggtacggctacgagcccgtaatgggtttgggcaagaacaacggcggcagaaccagcctggtaagcaccagaggaaatcgcgggaagtttgggttaggctataaacctacgcaagctgacataaggaaaaatatctcggaaaggaagaacagaggccaaggctcgcgattgggacaacaagccgaaggggccccgccctgccacatcagtagaagctttataagtgcaggtttaagacacgaaggccaagtcgccttgatatgcaaggatgactccccgagaagattggatttg

SEQ ID NO: 13918 - DNA, 456 bp, Glycine max
  Peptide Sequence Number=SeqID_105603
atggtgaaagttggaacctcttacgtgccgatcaacgtctcattttcgccaaaagttggcccagggcttaacccgcaacagaggaaaaacatgaccgcgatgacgcctaagaggtggcgtatctggtttctatcagctgttcctcctgttcagctactgaaattggttagcgtaacggcaaaagcaccgaccggacatcagcgctggcaagtggcgatcggtgcgggcctcttcgctattacgccagcggcgaaaggcggagtgtgcaaggcgattaagttgggtaacgccagggtttcccagtcagaaggcgttcgtggaaaaaagcgacggcgtcagtcagaatatgtagatacggactcactattccgcttcctcgctctgactcgctacgctcggtcgtcatgcggcgacggaaatggccctacaacggggcggaattccggacaagtttag

SEQ ID NO: 13919 - DNA, 297 bp, Glycine max
  Peptide Sequence Number=SeqID_105604
atgcacggtaacgcgtgttccttaatttctccgaaatcaagcaattctatgatttctgggtacctgcgagctgttgggagaggggttctaggagtgcctgttggggcactactgaattttttaggagctattgctgtgggggcgcctgttacatttcagtatcttcccaagactgtaaattgggctcttatgatgtctgtgttcacaacaattccagcgtcatgtgttcttggttcatcgtgggctgactggcgacgtatatttgcacaaacaaagtatgatccttctagcaaataa

SEQ ID NO: 13920 - DNA, 498 bp, Glycine max
  Peptide Sequence Number=SeqID_105605
gtggatgtcgcctacgagaactggaaggaggaccctactgctcagaaggacctgatttgggaggatattcaggcggaatttgatatcccagaggcttctgacagtaggacgaaaaggaagttactgcagaccgtgggggagagatggaggcagtttaaatcagacctcacgaggaaatgggcccttgcagccgatcaggaccgtgtcaaggacactgatgtgcgcaagaaggcacaagccatccagaagcagaatactgccccccacgttttgtctcgtgggggttatgattatttggaacagaagctcctggctgagaagacgaagaagaagctagaggaagctgcacagtcaggaagcgttgatggcgtcatcgaccctccatccctggtcagacgccacgtgaagtggaagatggcccgcacgaagaaaataggggagatgacgactgaggccacaaagaaaattgtcgagaagattgtaagtgggatcctctag

SEQ ID NO: 13921 - DNA, 872 bp, Glycine max
  Peptide Sequence Number=SeqID_105606
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgcgagcgtatcttaaaagcgatccgtgacacacgacgagcgatagaggcgggctttagcaaagaccagctgatccaacgcttgctggatgaatgcccgaacaaagcgctggcgttacgccagctgctgactgccgagcggcagatggatgaagcggcgatctataccattcatggtttttgccagcgtatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13922 - DNA, 642 bp, Glycine max
  Peptide Sequence Number=SeqID_105607
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttctcgctctgtcaccagactggagtgcagtggcgctatctcggctcactgcaacttccacctcccgggttcaagcgattctcctgcctcagcctcccaaggtttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaagagaaaaaaggctgcaccg

SEQ ID NO: 13923 - DNA, 423 bp, Glycine max
  Peptide Sequence Number=SeqID_105608
atgctgatgcagtccttggattggatgatatacgagctgtgcagccgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13924 - DNA, 929 bp, Glycine max
  Peptide Sequence Number=SeqID_105609
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatacgctggttatgaggacaatatggtcctccagcagggcgcgccgctgaccctgtcgggacgcacccaggcaggggtcaaggtcgaggcaaggctgggcaagaccggggctagcgcggtttcggacgggtctggcgccttttcgattaccctgcccgcccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13925 - DNA, 964 bp, Glycine max
  Peptide Sequence Number=SeqID_105610
agggctacacgccctcgccatcagaggactgcatgtcctcaccttcatagggctacacgccctcgccatcagaggactgcatgtcctcaccttcgtagggctacacgcccttgccatcagaggactgcatgtcctcaccttcgtagggctacacgccctcacctttagaggactacacgtcctcgccaacagagggctgcactccctcaccttgagaggactacaagtcctcaccaacgtagggctacacgccctcacctttagaggactacacgtcctcgccaacagagggctgcacgccctcacctttagaggactacacatcctcatcatcagaggaccacacgtcctcaccgtcagagggctgcacgccctcacctccagagggcgacacgccctcgccatcagaggactgcatgtcctcaccttcatagggctacacgccctcgccatcagaggactgcatgtcctcaccttcgtagggctacacgcccttgccatcagaggactgcatgtcctcaccttcgtagggctacacgccctcacctttagaggactacacgtcctcgccaacagagggctgcactccctcaccttgagaggactacaagtcctcaccaacgtagggctacacgccctcacctttagaggactacacgtcctcgccaacagagggctgcacgccctcacctttagaggactacacatcctcatcatcagaggaccacacgtcctcaccgtcagagggctgcacgccctcacctccagagggcgacacgccctcgccatcagaggactgcatgtcctcaccttcgtagggctacacgccctcacctttagaggatcacacgtcctcgccaacagagggctgcacaccctcacctccagaggactacagatccgcgcctcacctttagagggctacgtgtcctcattttcagtgtgctccatatccacaccttaa

SEQ ID NO: 13926 - DNA, 729 bp, Glycine max
  Peptide Sequence Number=SeqID_105611
ttgctcggggtgatgacggcggcatcgttggtgccggtgatgtcgacggtgatgacttgggtcgccgtgccgccgttgccgtcgtcgacggtcacggtgatggtgtcggtgacttctggccttcgcacataggtccacttgccgttctggtcgacggtgaaggtgccgtactggcccttgccttcattgttgacggaccaggtgtgcttgtcgttgacgtcgacgtcggtcttggtcagctggccggacgtggtcgtggtgccgtcttcggcgacggcgccggtggccgtgccgctgacggtcggggcgtcgttggtgccgttgatggtgatgacgacctggctcgtggtgccgtcggcgctggtgaccgtgaaggtctcggtcaggtgctccttggcgcccagctgctggatggccttggcgtcgttgtcgagcttgaagctccagttgccgttggcgtcgatcgagaacttgccgtactggccctggaagtcggtctgcggcttgaacgcagcctggccggcgtccttgtcgacgatgtccagcttgccgttggcggtcagggtggtgtcctcctggaccgtgcccttgtcgtcgcccggcttgctcggggtgatgacggcggcatcgttggtgccggtgatgtcgacggtgatgacctgggtcgccgtgccgccgttgccgtcgtcgacggtcacggtgatggtgtcggtgaccttctggccttcg

SEQ ID NO: 13927 - DNA, 824 bp, Glycine max
  Peptide Sequence Number=SeqID_105612
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgaaagcaagcaaagtgcccaccacggaacctgtgagacacacggcgagaacgattgccaagttaacgatatacaacactccgaacaaaatctgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13928 - DNA, 460 bp, Glycine max
  Peptide Sequence Number=SeqID_105613
atgagggggagggtattaaatggaaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaagtgagagggccgcggcaaagccgtttttccataggctccgcccccctgacagcatcacgaaatctgacgctcaaatcagtg

SEQ ID NO: 13929 - DNA, 1860 bp, Glycine max
  Peptide Sequence Number=SeqID_105614
atggatgaaggcatgctggatgcggaagcggccatggtgcgctttctcaacctgattgccggtgagccggatattgcgcgtgtgccgatcatgatcgactcctcgaaatgggaggtgattgagaaaggcctgcagtgcattcagggcaaaggcatcgtcaactccatctcaatgaaagagggcgtcgggccgtttattgcgcatgcgcgcaaagtgcggcgctacggcgcggcggtggtggtgatggcgttcgacgaagtgggccaggcggacacccgcgcgcgcaaaattgagatctgccgccgcgcctaccacattctcaccgaagaggtcggtttcccgccggaagacatcattttcgaccccaatatctttgccgtggctaccggcatcgaagagcacaacaactacgcgatggatttcatcggtgcctgtgaagacatcaaacgcgaactgccgcacgcgatgatctccggcggcgtctccaacgtgtcgttctcgttccgcggtaacgaaccggtgcgcgaggcgattcacgcggtgttcctctactatgccatccgcaacggcatggacatgggcatcgtcaacgccggtcagctggcgatttatgacgatctgccggcggagctgcgcgatgcggttgaggacgtgatcctcaaccggcgcgacgatggcaccgagcgactgctggcgctggcggagaagtatcgcggcaacaaaggcgagggtgagcaggacaagcagcaggccgaatggcgcagctgggacgtggtgaagcggctggaatattcgctggtgaaaggcatcaccgagtttatcgagcaggacaccgaagaggcgcgccaggccgcggcacggccgattgaagtcattgaagggccgctgatgtccggcatgaatgtggtcggcgatctgtttggcgagggcaaaatgttcctgccgcaggtggtgaaatcggcgcgcgtgatgaagcaggcggtggcctacctcgaaccctttatccaggcgagcaaagaggccggccgcagcaacggtaaaatcgtgctggcgacggtaaaaggcgacgtgcacgacatcggcaaaaatattgttggcgtggtgttgcagtgtaacaactacgaaatcatcgacctgggcgtgatggtgccgggcgacaaaatcctgaaaaccgcgcgtgaggaaaacgccgacatcatcggactttccggcctgattaccccgtcgctcgacgagatggtgaacgtggcgaaagagatggagcgccagggctttacgctgccgctgctgattggcggggccaccacctcgaaagcgcacacggcggtgaagattgagcagaattacagcggcccgacggtttatgtgcagaacgcctcgcgtaccgtcggcgtggtctcttcgctgctgtcgcccacgctgaaagaggcgtttgtggcgcgcatgcgtaaggagtacgagaccgtgcggattcagcacgcgcgtaaaaagccgggtacgccgccggtcacgatgcagtccgcgcgcgataatcattacgtcattgactggcaacgttacacgccaccggtggcgcatcgtaccggcgtcagcgcagtggaggccagtatcgatacgctgcgcaactacattgattggacgccgttttttatgacctggtcgctggccggcaaatatccgcgcattttggaagatgaggtggtgggcgaagaagccacgcggctgtttgccgatgccactgcgatgctggacaacctcagcgcgcagggtacgctcaggtcgtggggtttgatcggtattttcccggctaaccgggttggcgacgacgttgaaatctaccgtgacgagactcggcgcgag

SEQ ID NO: 13930 - DNA, 833 bp, Glycine max
  Peptide Sequence Number=SeqID_105615
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcactaatgttactcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13931 - DNA, 586 bp, Glycine max
  Peptide Sequence Number=SeqID_105616
atggtgaaagttggaacctcttacgtgccgatcaacgtctcattttcgccaaaagttggtcccatcgtgggcggttcccgggttaatttgagctctggcttcatggtttctatcagctgttctcctgttcagcctgaaagggtggtgttatccgctcaattcggcaaaagcatacacgccggacatcagcgggcaagtgtaagcggtgcgacgctgacgctaaccaccacacccgccgcgcttaattgcgccgctacagggctgcgtccgctttcgccattcagggaaacctggtgtttcccagtcacgacgtgttctgtgcaggagaaaaaagctgcacggccagcagaatatgtgaatacgactcactatagggcgaattggagccccgcggaattcgatcggaaatgcagacttaccaacggggcggaattcctggaagatccaggaacgatacttaacagggaagcgtttccccctggcggctccctcgtgcgctctcctgttcctgcctttcggtttaccggtgtcattccgctgttatggccgcgtttgtctcattccacgcctgacactcagttcccgg

SEQ ID NO: 13932 - DNA, 812 bp, Glycine max
  Peptide Sequence Number=SeqID_105617
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcttagattacaacctcaaatgaaagggatgaccctcgaggccatccattgtgtggagattgaaaccaaggccgaaaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 13933 - DNA, 465 bp, Glycine max
  Peptide Sequence Number=SeqID_105618
atggaaaaacggctttgccgcggccctctcacttccctgttaagtatcttcctggcatcttccaggaaatctccgccccgttcgtgcctttccgtcgccgcagtgagaccgagcgtaggaagtcaggtcacatcccctttcgccagctggcgtcttaatagcgaagaggcccgcaccgatcggccttcccgacagttgcgcaccgaatggcgaatgggcagccctgtagcggcaacgcaattaagcgcggcgggtgtggtggttagcgcacgtcggcacccgctttacacttgcccgctgatgtccggcgtgttgcttttgccgaattacgcgataaccaccatttcagtagctgaacaggaaggacagctgatagaaaccagatacgccatggagctcgaaattaaccctcactacactaaatcaataagttcggccccccccgaggtcgcactttgcgaataa

SEQ ID NO: 13934 - DNA, 847 bp, Glycine max
  Peptide Sequence Number=SeqID_105619
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaaaaggaaactttcctaaaactagttccatcagtgtcatcccgagactccacacatccgactgcaccgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 13935 - DNA, 417 bp, Glycine max
  Peptide Sequence Number=SeqID_105620
atgtacaacctccttctttgcccgttactgagggaacaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 13936 - DNA, 234 bp, Glycine max
  Peptide Sequence Number=SeqID_105621
atgacgtctgaggcagcaaaggaaattgctgagaagattctaagtcattttcagttaggaattgcgtcacagggttcctttgtcccccatggacgtcacgatctcctgactgttgccattgggcgaccagaacacattggtcgtgtgcatgctgctggagccagtgtgaccataaaagcaatactttggattggctccacaaacctcccacagttctttctccatggctcctga

SEQ ID NO: 13937 - DNA, 1182 bp, Glycine max
  Peptide Sequence Number=SeqID_105622
atggcattacaaattcatgaaggtcagaactttggatttggatgcctcttgttagcagtactatacgaatcacttggtgaggcatgcgatgatctgaagaaatcgaaggatgggtcttccttcttagtgtctgggcctatgtggcttctccagttgtggctaaatgccacttttgaacaggaaatgggattaataatcccacaagattatgctgaagaagttgcaaatcgctcgatcgaaggccagagagcacttcgactaacgcccaagaccttggatccaagctcacaaaagctgttcctaaagtatatgaggattttcctgagttttgacaagtttcttccccaacatgctccattcattagtcgagaagttggcccggcctggttcactgactatttccctactgtcgatccggacaatgaagaagaggtgaacgaaatatggtcattttacttgaatccacagatcctgtcttgtcgtacaggtgttcaatcgaactatttaggcctggttggataccagcctaatttggtttcaagacaatttggcctctcgcaaattcgtcctaaaagcttgttcgaagatcctcaagacgtcataagaggggccaatctttcggaaaagaccttcaagaagtttttgaagatttctcttaatgaaaactataacttgcatccttttgagttcaaccattcccacttctgcaccatggggtttgttacctggtgggaaaaatattattcgacccgttcggttggagacactactatcatgatctccaggcttgagagtggttttgcgcaaccaacgatcgagaatattcgctcaagccttcaagctcgaggcaaagcacccatgacgaagaggagtgctgaaacgtctcgagccgacgtgagacccaagaaacccactggggtgaaaatccaagaagagaaacaagaagagaagagtcaaaggaaagatgatagtactgagaccaccacgacttgcaaacgctcgaagcatgcgggcgtcgaattagacgaagaaaaagatgcaagttttatttctaatgtcaatattatagctttctttcaagtctatactctgacaattctttaccctcgtaatacaggaagaagaggaaagacctctcataagaaaaagaaagttacctacgacttcgaccaaatctgttga

SEQ ID NO: 13938 - DNA, 774 bp, Glycine max
  Peptide Sequence Number=SeqID_105623
gaagatgttgatttgccaacttttggtttgtcagttttagctaacgcctctgaaaacttctcaaacaaaagcaagcttggagaaggtggctttggaccagtgtacaagctgcacccccctgttgctaggtctactgttagttgcttcttgcacctctctctttatcattccacggcccttgcaaaaataccttgtcctcaaggtgttggggttcaacgcatggcttccaaaagtgatgtcgcgatcccaaggtctattccgacgaattgcacccgaactaccataggaagcgaacccgacaatggtggaaggaatggttgcacgggtgcgggacatagaggcacaattggcatgggaagcggaggcggcatggacgacggaggtggcatgggtagcggagtcggcatgggtgacagagtcggcatgggtgacggagtcggcatgggcggcggtggtggcatgggcggcgaagtcggcataagccgcagagttgacatgagcggagtcaatatgatggaggttgatgcctgcacagggacgtcgttgaagaaggttgtcgatggaggtggccaaggtgtcgacggtagtggcgggattgaattggctgaagttgcgatagttgaagctggtgtgacagccatggaaggtagccatgggctctcaatgaaagcaccaaaaatgatagttgcagtgcttttagctggcttcgagggccaacacctcctggagaagaagaaagttaaagggaaggaattttgtatttctcattcatga

SEQ ID NO: 13939 - DNA, 225 bp, Glycine max
  Peptide Sequence Number=SeqID_105624
atggttggagcattctcgcaaaacatcgtgaccctgactggtctccctatgatcttacttagtaagagtgaccagatcaacaaacccattgtggggggaaatgatgcaatcctccctaggaagggaccaatcactagaaccatgagcaagaggctccaagaagattgggctagagctgctgaagaaggccctagggttctcatgaaccttagggtagatttctga

SEQ ID NO: 13940 - DNA, 300 bp, Glycine max
  Peptide Sequence Number=SeqID_105625
atgcatgtcatcacgctacatagacattggcatgctcatccgcatctgatagagcgtctgaaggtcctcgtcgcggccctgcatcggcagcaccgttcaaggctccactccaccactggtaactcgagtgctgagttgacgagttgggcgagtttctcgttgagggtaagtcccgagacaaggtcttgggttcgctgggcgatagggagcttggtgttaagcagaataggtaaggtgagttggaggacaagttgtaggaataaggagactgagttaactcgacgtggtggtggagaatga

SEQ ID NO: 13941 - DNA, 240 bp, Glycine max
  Peptide Sequence Number=SeqID_105626
atggcacaagtgcctatctgccaacatcgtattcaaattgtgtctccttcggtgggcccaccatggattgacactggtggagacatagagcatgcgggagtggttgaaggcgacaacaaggatgaggaggtggtcgctgaagacgagagagaaggagaggactttctctttaaaaagattgagatgtgtttcatttctttaaaaaaagaaatgagatctgttttgaaagatgaaggttaa

SEQ ID NO: 13942 - DNA, 165 bp, Glycine max
  Peptide Sequence Number=SeqID_105627
atgagtgaccttctgggaagtttcctagaaagcatgagtgaggagaaacacgctgaaaagtcttgcgttggtctcaggaagggctacatacggagggttttgaccaaaggagccacagttgcatatgccgctagggagaccttcgccactggttatgaggcataa

SEQ ID NO: 13943 - DNA, 464 bp, Glycine max
  Peptide Sequence Number=SeqID_105628
atggaagacctttctaagaggtggattgatcatcttgacaacacacgatcaagggtcagccaaccactactgataaattgtgatttttgtggaggagagcattacaatgacaattgtcatctctactccatgaataactttgggtggggacaggagttaagcccttacaagaaatatgaagaagaaagaactccaaatcttgaaagtgtgtttgaagaattcatggcataccatgctagctctaaagccaatcaaaactcagaaacaactgaatcgactcaacaagcatttaaaagtgtagaaattcaggttggtaagctggcagaagaagtgactaaatttgtggccaggagagaagaaaactttgtagaggttgaagctcaagaggaaagccctgtaaaagagcatgattcaaaagaaaaagttgaagaggaaattgaagaggaagcacaacaatgggagaa

SEQ ID NO: 13944 - DNA, 453 bp, Glycine max
  Peptide Sequence Number=SeqID_105629
atgtggaccactacgggggaggtggttgccgcccagctcgcccaggcgagccaggttgcttcctccagaagcaacagccttctggaggaatattctggagggcccaagtgggcctgggtgctatttgcacccccatttttactaattacggaaacttacgaatttcgtaacgatacttgttttctttccgtaatgttacggaaccttgcggattacataatcatccccttttttgacttacggaatgttacggaacctcacttaattacgcaacgatgcttccatttgatttccggtgtgtcacggaaacttacggattgtgcattaatattttttttggtttttcggcatgtcctggaattccacaaattgcctaatgatgggtaccaagcacctcacaaggaccaaagaaaggtcgcatgtcatcaagcaaaggtccccggacgaaattag

SEQ ID NO: 13945 - DNA, 114 bp, Glycine max
  Peptide Sequence Number=SeqID_105630
atgcaccaaccatatgggatcaacataggcttaaaggagtactcaaaccgaatgtctttacccccaaggcctagactccaaagaatccgttggggcctcacattcctaatccag

SEQ ID NO: 13946 - DNA, 276 bp, Glycine max
  Peptide Sequence Number=SeqID_105631
atgaggagaatgttccacaagcgcatttatgacacgtcccagggtgagggtgccgaggaagctggcttactggagctcgaggtcgttgagctgctgctcacggtccatcttgacaatgagaggaacaacgaggaagaggaaggtggtgtcggtgatccatgcgaccttgccggtgctgcggaggagcttcttggtgacgaatgcggcgtcgccggcggcttccttgccgcgggtgacgatggaggagcatcagatattcgtgaggatggagcttga

SEQ ID NO: 13947 - DNA, 490 bp, Glycine max
  Peptide Sequence Number=SeqID_105632
atggcccttgcagaagcaccttgtcctcaagttgataatcttgacataggtgggaccaatcttcctacgaagtttcatcaggagaaagtccttgccactaccccaacacttcccagcgtggttgtccgggtgataacgggttgcaccttgacaaacttctctgggaattgcacagtgtctgctgacggtggagggcctttaaatggtttcaacaaggaacagtggaagaatgggaggccagtaatgaagtccaacgacaagtcttcccaaggacggtggggtaccaatagtggacataacagtcaagctagtgttttcgcgattccgcaaggtagggatgatgggttatcctcgagggagccaaatttgccctttgtgcagaatcaagttatgaatgagcttgaggaagtctggagagagcatcaactgcttgattggtggcaccagagcaatattggatttgataatcaaatcccattaggcatgcaag

SEQ ID NO: 13948 - DNA, 849 bp, Glycine max
  Peptide Sequence Number=SeqID_105633
atggatttcacagcggagaagaaggaatcagagagcaaaaccgaaaatgctcatccaacaacgttagattcttcttctcaattggcatcggcacttgattccaacaacaaagaaatcgaagaacgacaagctcgtgaactcaaagccggtcttcaccccctcaagaacttcataattttatctgattatgataggggaggaaagggtaagggccagggtggctctggagcaaatgggactataactgggaaggcttgccccaaagggttgtacggtaccttttgtgagacctgtttctgttctatgttttgtgtgaatgtgatgaacgaggatgtcacatggttggctatttctccaagtattaactccgtaaagctagtggagcaattagagacatctaaagaagcaaaagctggaggagctaactcaagttacctttctaaatctaaatttctgttggttttcttgattgccaccgccagtttcacgactctaaggaggttttcctctcctgtcacttcaatcttcagagcgccgacacaattgaagccagatgtacgctccacagcttcaagagctacacgaagctcgatgctgtcgaaaatgacgatatctcttccaccggcgccttcaatcctgatagagttgtgcctaatatatatgttattaggatttttatttgtttgtgaagttgaagatagtggaaagcaggaatctctggaggcattgacctcacagataagtgacatggttgctattgcaaaaattatgaaagccactttggttttgcctacattggatcatgattccttttggacagattctaggtatggaatctcatctacttga

SEQ ID NO: 13949 - DNA, 333 bp, Glycine max
  Peptide Sequence Number=SeqID_105634
atggctggagcatatgtatatttttacagaccactcttctggtctttaaggagattacaaatttcaagggagtcaaaagaacaaaagattttctttgaagaccaagtcactcgggtctatctcaagatgatctttgtcctcggtgtggctgtggaagagaggttcttctgcatgcatgattggcgccagtttctcacaatggtcttaattaatgcttcttgtggaggtgttgctcatgatgagcattgtgctttcttgtgtgctttctctagattcttgagcttgtgctctgtgatttttgcggagttatggggaatctatatcatgggttga

SEQ ID NO: 13950 - DNA, 48 bp, Glycine max
  Peptide Sequence Number=SeqID_105635
atgatgttgggatttggtgtggatggggagagggaacacgatttatga

SEQ ID NO: 13951 - DNA, 852 bp, Glycine max
  Peptide Sequence Number=SeqID_105636
ctcaatgatgttgttgtcgtcaatggtgaaacggtgaaacgtctgtgtccttcacaaaaccctagagcggagaatatgggtgaggtggagcgtcgactgtttctctccctctcggacgtggcttctctctcccttgatctctcctttgagaggcttctccaatcagttccctccagcaacgactttgatctcatcgatcgcaccctcaaaatggcctctctcctcctcgacaccaccaaacattcctctcgcaaatgtgcttccaaccacaattccttctcctggccccttcctcccgatctcaccatcaagaaatggtttttattgaatataactggattcaagttttctaagtatctgaatacaaagatgctctacatagatgaagtgcttgtggaggaagatgcagagcacaagtctatggagaacagggatggcctttctgacgagttgcctcgcctaatatgcatatcaagaaagaagatgccacagtatccacataattacaaagctgaagctatgaatgggttgattcagtttagttctaatgaagctattacatgtcggttggcaactaatgaggtacaattttcttgtacttgggatttttcgaaaggagttgtttgtcagttaagagtttccggagttgctgatgctgagctttctagtttactaaggtcccatgtagctgcatttgttccagaatccaaggattgtgtccctcaacttaatgcttctcgtgcaagcttaattagaggccaggtgtgtttagcgcgtaagtgcgagattgctaccatactcgctaagcgtggcaagtgtgctcgctcagcgcagaagttgcgtgaaaactaa

SEQ ID NO: 13952 - DNA, 159 bp, Glycine max
  Peptide Sequence Number=SeqID_105637
atggctaaagatggagagtttctcctaagggataaactcaggatttggatatcttcaatagagagctctgagactcggcttagcgagggtcacacacttagagttgaatgtcgcgctaagcgcgtctttggacttcttcatgggtcttcttcacactaa

SEQ ID NO: 13953 - DNA, 867 bp, Glycine max
  Peptide Sequence Number=SeqID_105638
atgagttgcttacaatggctagatttaagtgttaacaactttgctacactgcccaacctcaagaagctttccaaactgttgtgtttaaagttacaacattgcaagcagttgaaatctttgcctgagctcccttcacggattgacttgcaaactggtgcagtaggagcaggattatacatatttaactgcccagaattagttgatagggaacgctgcactgacatgggtttttcatggatgatgcaattgtgtcaggtgttatactcacatcctttatacgttgttagaagtgttactccaggaagtgaaatacgaaggtggttcaataatgagcatgacggaaattgtgtaagcttagacgcatctcctgttatgcatgatgataattggattggcgttgcgttttgtgcaatatttgtcgtacctcaagaaacaatctcagcaatggggttttcaagtcaacattggagtcattttggttatattcgagtggatttttatggagatgtagatctagaacttgttttagacaaatcagatcacatgttgttattctttcggaatcgacaagactccattgaagaattacatctcaatcacaaatatcttggcagatcacatgtggctattttgaaatgtgatgataagtggaaagagtcatatgcggaggagaagaaatacggatatggctgggtatataaaggggatattgaacaaaggaagcgcaaatttggggaaattgaagaaaatgaaggaaaaagaaagaaaggaataatgtcagcagaagggagaaaagatgatgcaacctcctcccaggaaaagacaatcaagttgttgcaaaatgaatttgaaaatcttaggctgtag

SEQ ID NO: 13954 - DNA, 2913 bp, Glycine max
  Peptide Sequence Number=SeqID_105639
atggcttctacttctaatgccatcatccaatgcacctcttcttcttcttcttcgtttcagtatgacgtgtttgtgagcttccgcggtgaagacacacgcaacagcttcaccgcttttctttttgaagctctgaaaaaacaaggcatcgaggccttcaaagatgataaagatatcaggaaaggcgaatccatagcaccagagctaatacgagccattgaagggtctcacgttttcgttgttgtcttttccaaggactatgcttcctcaacttggtgcctgcgtgaactagcacatatctggaattgcattcaaacatcacgcagacctcttctgcccattttttatgatgttgatccatcacaagtgcgaaaacagagtggagactatcagaaagccttttcccaacaccaacaaagttccaagttccaagagaaggaaattacaacatggagaaaagttctggaacaagtagccggtctctgtggttgggatatcagaaataagcaacaacatgcagtgattgaagaaattgttcagcagataaaaaatatcgtgggttgcaaattttctattcttccatatgataatctagttgggatggaatctcattttgctaaattatcaaagctaatatgtctggggccggttaatgatgttcgagttgttggaattactggcatgggtggaataggaaaatctactcttggtcgagctttatatgaaagaatctctcatcaatttaattctcgttgttatattcatgatgtaagcaaactttatcaacgtgatggtatattaggtgtacaaaagcaattactttctcaatctttaaatgaaagaaatctagagatttggaatgtatctgatggaacacttctggcatggaagaggctatccaatgcaaaggcacttatagttcttgacaatgttgatcaagataaacaactagatatgtttactgggggtagagttgatctgttatgcaaatgccttggtagaggaagcatggaagttctagattttcgtgaatttaatcccgagtatggcctacaagttctcattgataaatcacttataaccatgaattttatttttggggagattcaaatgcatgacttgttgtgcgatttgggcaagtgtattgttagagaaaaatcacctaggaagccatggaagtggagcagattgtgggatgttaaagatttccacaaagttatgtcaaataataaggcagcagaaaatgttgaggccatagttcttacagaaaaatctgacattcttggaataattcgaacaatgagagtcgatgctctatcaacaatgagttgccttaagcttctcaaacttgaatatttgaactccgaaatcaatttttcaggaacacttactaagctttccaatgaattaggatatcttagttggaaaaagtatccttttgagtgtttgccaccaagttttgagccggacaaacttgttgagttgatactaagtgacagcaacatcaaacaactttgggaatgcacaaagcctctacccaatttgaggcgtttggatctctctggctccaaaaatctaataaaaatgccatatattggagatgccctatatcttgagagttttaatctcgaaggatgtatacaactcgaagagatcggtctgtccgttgttctttcacgaaagcttttttatctgaatttgagaaattgcaaaagtcttatcaagttgccacagtttggagatgacctaattcttgaaaatttagatctcgaaggatgtcaaaaactcagacgcattgatccatccatcggtcttctaaaaaagctcataagattgaatttgaacaactgcaaaaatctagtaagcttacccaatagcatactaggcctcaattctcttgtatggctgtatctctctggctgttcaaaactgtacaacaccgagttattatatgaactaagggatgcagagcaattgaagaagattgatatagatggagctcctattcatttccaatcaacatcttcctactccagacaacatcaaaaatcagttagttgctcaatgccttcctccccaatatttccatggatgcgtgaacttgatctaagtttctgtaatttagttgaaatccctgatgccattggaattatgagttgcttagaaaggctagatttaagtggtaacaattttgctacactgcccaacctcaagaagctttccaaactggtctgtttaaagttacaacattgcaagcagttgaaatctttgcctgagctcccttcaccaattcttcggcgccaacgaacaggattatacatttttaactgcccagaattagttgatagggaacactgcactgacatggctttttcatggatgatgcaattttgttcgcctaaggaaataacttcatacattgatgaaagtgttagtccaggaagtgaaataccaaggtggttcaataatgagcatgagggaaattgtgtaaacttagacgcatctcctgttatgcatgaccataattggattggcgttgcgttttgtgcaatattcgtcgtacctcatgaaacactctctgcaatgagtttttcagagacagaatggaactaccctgtttttggtgatattccagtggatttttatgaagatgtagatctagaacttgttttagacaaatcagatcacatgtgcctattctatgttgatcgacatgacttcattgcagatttccatctcgatgacaaatatcttggcagattgcttttgaaatgtgatgaagggatagggttcaaagagtcatatgctgaggtgaagaaatacggatatcgctgggtatataaaggggatctagaacaaaggaagcgcaaatttggggaaattgaagaaaaagtgagcagaagggagaaaagatga

SEQ ID NO: 13955 - DNA, 3300 bp, Glycine max
  Peptide Sequence Number=SeqID_105640
atggcttctacttctaatgccatcttccaatgcacctcttcttcttcttcttcgtttgagtatgacgtgtttgtgagcttccgcggtgaagacacacgcaacagcttcactgcttttctttttgaagctctgaaaaaacaaggcatcgaggccttcaaagatgataaagatatcaggaaaggcgaatccatagcaccagagctaatacgagccattgaagggtctcatgttttccttgttgtcttttccaaggactatgcttcctcaacttggtgcctgcgtgaactagcacatatctggaattgcattcaaacatctcccagacttcttctgcctattttttatgatgttgatccatcacaagtgcgaaaacagagtggagactatgagaaagcctttgcccaacaccaacaaagttccaggttccaagacaaggaaattaaaacatggagagaagttctgaaccatgtagccagtctctctggttgggatatcagaaataagcaacaacatgcagtgattgaagaaattgttcagcagataaaaaatatcttgggttgcaaattttctattcttccatatgataatctagttgggatggaatctcattttgctaaattatcaaagctaatatgtctggggccggttaatgatgttcgagttgttggaattactggcatgggtggaataggaaagtccactcttggtcgagctttatatgaaagaatctcttatcgatttaattcttcttgttatattgatgacataagcaaactttatggacttgaaggtccattaggtgtacaaaagcaattactttctcaatctctaaaggaaagaaatctagagatttgcaatgtatctgatggaacaattttggcatggaataggctagccaatgcaaatgcacttatagttcttgacaatgttgatcaagataaacaacttgatatgtttacagggagtagaaatgatctgttacgtaaacgcctaggtaaagggagcataattattataatttctagggatcaacaaatattgaaggcacatggagtagatgttatttaccaagtgaagccattgaatgacaatgatgctcttcgattgttttgcaaaaaagtattcaaaaataattatatcatgagtgattttgaaaagttgacttatgatgtactatcacattgtaaaggtcatcctttagcaattgaagtagtaggctcatctttatttgataaagatgttttacattggagaagtgcattaacttggttaagggaaaataaaagtaaaagtattatgaatgtgttgcgaataagttttgatcaattagaggatacacacaaggaaatatttctagatattgcatgtttcttcaacaatgatatggtggaatatgtgaaggaagttctagattttcgtggatttaatcccgaatctggcctactagttctcgttgataaatcactcataaccatggattcaagggtgattcgaatgcatgacttgttgtgcgatttgggcaagtatattgttagagaaaaatcgcctaggaagccatggaagtggagcaggttgtgggatgttaaagatttccttaaagttaagtcagataataaggcagcagaaaatgttgaggccatagttctttcaaaaaaatctgtcattcttcaaacaatgaggatcgatgctctatcaacaatgagtagccttaagcttctcaaatttggatataagaacgttggcttccaaattaatttttcaggaacacttgctaagctttccaatgaattaggatatcttagttggataaagtatccttttgagtgtttgccaccaagttttgaaccggacaaacttgttgagttgagactaccttacagcaacatcaaacaactttgggaaggtacaaagcctctacccaatttgaggcgtttggatctctttggctccaaaaatctaattaaaatgccatatattgaagatgccctatatcttgagagtcttaatctcgaaggatgtatacaactcgaagagatcggcctgtccattgttctttcaccaaagcttacttctctgaatttaagaaattgcaaaagtcttatcaagttgccacggtttggagaggacctaattcttggaaagctagttctcgaaggatgtcgaaaactcagacacattgatccatccatcggtcttctaaaaaagctcagagaattgaatttgaaaaactgcaaaaatctagtaagcttacccaatagcatactaggcctcaattctcttcaatatctgaatctctctggctgttcaaaagtgtacaacaccgagttattgtatgaactaagggatgcagagcaattgaagaagattgataaagatggagctcctattcatttccaatcaacatcttccgactccagacaacataaaaaatcagttagttgcttaatgccttcctccccaatatttcaatgtatgcgtgaacttgatctaagtttctgtaatttagttgaaatccctgatgctattggaattatgagttgcttagaaaggctagatttaagtggtaacaattttgctacactgcccaacctcaagaagctttccaaactggtctgtttaaagttacaacattgcaagcagttgaaatctttgcctgagctcccttcacggattgaaatcccaactcctgcaggctattttggaaacaaagcaggattatacatttttaactgcccaaaattagttgatagggaacgctgcactaacatggctttttcatggatgatgcaattgtgttctcaggtgagattgttctctttatggtattaccattttggaggtgttactccaggaagtgaaataccaaggtggttcaataatgagcatgagggaaattgtgtaagcttagacgcatctcctgttatgcatgaccgtaattggattggcgttgcgttttgtgcaatattcgtcgtacctcatgaaacactcttagcaatgggtttttcaaattcaaaagggccaaggcatttgtttggtgatattcgagtggatttttatggagatgtagatctagaacttgttttagacaaatcagatcacatgtgcctattctttcttaaacgacatgacatcattgcagatttccatctcaagcacagatatcttggcagatgggtttcgagatatgatggagtgttgaaagagtcatatgcggaggtgaagaaatacggatatcgctgggtatataaaggggatatagaacaaaggaagcgcaaatttggggaaattgaagaaaagtga

SEQ ID NO: 13956 - DNA, 189 bp, Glycine max
  Peptide Sequence Number=SeqID_105641
atgggggagatgttcggtttaggcaaaggttggaagttacatggaagttacactggtgatggctctaggcagccaactgagcttgagttgcagcaagcattccaccaagggaatcatatcgccaccatcataaagaagttcaaggaagatgctcacccaatttttactctacacaatagaggatattga

SEQ ID NO: 13957 - DNA, 1333 bp, Glycine max
  Peptide Sequence Number=SeqID_105642
atgaacgtgctaagcgcgcctgttgcgcttagtttgttcatcgtaactgttaaaattttggatatccagatgaacgcgctaagcggaccatgtcgcgctaagcgcgctaagcacgccctgtgcgttaagcctgagtgtcattctgatgaggctgagctaagcacgccatgctgcgctaagctcagactctcttctgccagatatgacagatctaggttcacatctcaagaagcctggaagagatatacagacattgtggtacctaggaagatttttcctgaaaggaatgtcattatccatcacactgagttcgatgaatttactgaagaactcgagcgtagaaactggcacaaggagttgacaaactttgtgaatggtagtattgatgtggccatcgtaaaggagttttatgcgaacctctatgaccccgaggataaaccacctaagaaggtaagggtgagaggtcatatgatcaaatttgatgcagacaccttgaacacattcctgaagaccctggtgatacttgaggagggggagaactttctagtatactccaggttctgtcgttcgaagccggagccacgggaattggtagctcgattatgcatccttggaaggggattcgagttaaacgctgatggactaccattaaagatcttatggaagaatttgaccatgcttgctcagacatggagcattttatcattctccaacctggtccctacctcccacacctctgatatcacattagacagggccaggttgatttatggcatcattcagaagatggatatgaacctgggctatattatttccgctcaaatttctatgatcgcccaacatgactcttctaggcttggttttccagccttaatcactgctctgtgcaaggccaggggagtcatttctgattcattgacattggagagccttgggctacacaaagccaaggggaagaggtctgaggctcccccatcttctgagacccccccttcctcagctctatcacagactccagctattcctccagcatatacacatatactacttccagctcccttatctgcaggatcttcagattttttatttacacaacagatgctgcactccatgctccagagcctacacagggggcagtccatcatcatgcagagccttaagggcttgggcttgccatccattatgagcatggatgattttgacgcgaagccttctccttctggaggaggtggggccttcgcagcccaagagcttgaaccaaaagagctagcagtagcagcagcagagggggaggatgagctcacccctcctgagcccttttattttgatgcag

SEQ ID NO: 13958 - DNA, 525 bp, Glycine max
  Peptide Sequence Number=SeqID_105643
atgacgaagatgtcttcttcaatctcttcacgagagagagcgatccagaatttcctcttctctttcttcacactgcacggcgtgtccaataacccgcggagccgcagtgacttcggtgcggggttgttgttgtcgtcgccgccgccgtcgtggaattctctgttgatggtggcgtggtggtggtttcgggaaggtttggtgccgatctcgagtgggccttggggagaagcacgggcttgcgagggtgcaggttccatggcttctgcacgatatcgtctgtgtcgccatgtgtggcttcgaaacggcgtcgtagagaatgagagagagagagtgaagaagctgtgcagcttaaggtggaggaaggagtgtggtatgagttatgtgaacaaaattgactttgactataaggagtatggaaggaaaaggtttcagcaatactggataaggaagcctactttattggactcaccaagcattgtttccctagatgaaactgtgaatggattgttgccatccttcacatga

SEQ ID NO: 13959 - DNA, 1884 bp, Glycine max
  Peptide Sequence Number=SeqID_105644
atgagtcgaggaagtggaggtggatacgatcgtcacatcactattttctcccctgaaggacgtctctttcaagtgggctgtcgtgttctgagtggtggaatttttatgcatgatgaaacagagtatgctttcaaggctgtgaaggctgcaggaatcacctcgattggtgtccgaggaaaggattcaatttgtgtcgttactcagaagaaggttccggataagcttttggacaacacaagtgttacacacctctttccaatcaccaagtaccttggattattggctactggcatgacagctgatgctaggacactggtccaacaagcaagaaatgaagcagctgagtttcgctttacatatggatatgagatgcctgtagatgtattagctaaatggattgcagataaatcacaagtctatactcaacatgcttatatgagaccactcggagtagttgctatggttttgggtattgatgatgaatatggacctcagctatacaaatgtgatccagctggtcattactttggtcacaaggcaacaagtgctggattgaaggaccaagaggcaattaatttcttggaaaagaagatgaagaatgacccttcatttacatatgaggagacggttcagactgccatttctgccctgcaatcagttcttcaggaggattttaaggccactgagattgaggttggagtggtgcggaaggataatccagaattcagagttttaaccaccgacgaaattgatgagcacttgactgcaataagtgagctgctcgagtttgagccctgggtatgcactagcattaaattctcagggagagttttgccgtctctggtggtcctacctgtctcgagcaggattgtccctggcaggcatattgttcccatcaatacgcaccaaaaaccttccaaacctgaaaagtgtcttcggtccaaatggaagattaatggcaataacattgggacatgcattggagtcatgacagtggcacacttggttgctccagtcgctgcaaaagctgaagtggctgcttctatttatgctttggctgatggaagcctcggtgactggtttggaggctttctattttcagctggacagcaggccaatgaagctgttcagggccaattaacctctctcagtttcactagtttggctgtaatttatggggctgggcttgttaccagcctttctccctgtacacttagtgtcttaccactgacccttggttacattggggcatttggctctggcaaaagcagagcacaggttgtaggagattccattgcattctccttaggccttgcaaccacgttagcactgttgggtgtaggagcttcatttgcaggaaaggcttatggacagattggccaaggattacctttggcagcttctggtttggctataattatgggtctgaatcttcttgaggtactgaaacagtttctcttcccccttctttgtgttctaaaggttacagactttcagatcattgaattacggctcccctcattctttgacagttttgatccacgtgcagcagctgccaatttcccatccagtgtgcaagcatacctcgccgggcttacatttgccttagctgcctcaccttgtagtacacctgtcttggccacccttctgggatatgttgctgcatccaaggacccggtgattggaggcagcttacttttaacatacacaactggctatgtttctcctttactcttggctgcttcttttgctggagcactacagagcttgctctcattccgcaagttctcggcatggatcaatcctataagcggagcaatgctgttaggtggtggtgtatatacgttcttagataggctgttcccagtcacaatggtgatgtag

SEQ ID NO: 13960 - DNA, 57 bp, Glycine max
  Peptide Sequence Number=SeqID_105645
atggctactttgggaaggcacgttaagttgagggtgtttggtatgcccttggcctag

SEQ ID NO: 13961 - DNA, 207 bp, Glycine max
  Peptide Sequence Number=SeqID_105646
atggatgccaccgtcactcagctcagtccctcctacaatgtcactactgaaccaccacaccatagtgtttgcctgcgactggtccagttgacgctcttttgtcacaagccactggagctcgtcgaaaagaactacaaagaggatgaacacaatagggattgctccgattttgagaatcacaagcccaaggctaaagccactacttga

SEQ ID NO: 13962 - DNA, 525 bp, Glycine max
  Peptide Sequence Number=SeqID_105647
atgtatgcccagtgtggtgatcttaatacaagtaactatatttttgacgtattagctaataagaattctagtacttggaatgccattcttcctgcaaatgctcattatggacctggtgaggaggcactaaagcttataataaagatgaagaatgatggggttcatttggatcagtttagcttctctgtagctcttgccattgtcggtaacttaactctactagatgaaggtcaacagctacatagcttgattattaaacatggttttgagtcaaatgattatgttttaaatacaacaatggatatgtatggaaaatgtggggaaattgatgatggttttagaatccttccccaaccaagaagcagctcactaaacctgtctcagaaaaatgacgttctcggactcattcaccgttggatcgtcgtgaaatttaaacaccaggttcacaacccaattccaaacattctcaccgttgggagtttcaaaatcatgtctgagcttataggaaaaccattcgcattgtag

SEQ ID NO: 13963 - DNA, 351 bp, Glycine max
  Peptide Sequence Number=SeqID_105648
atgacccctactcatgatgtcctgctatattacaatggaaggtggaacaagtcatgccaaaatgagtttgttggttacttgttcacaggaaaaaatcccaaaaactttgacattcccaccggatgtaccatggatgaactgaaggatttgatcaaacaaaaactaagtcaccatgagtattcagaaaaagttataaaatttgaaataattgaactcaaaaccaacgaggacgtgatgaaggtgctcattgagtctaactactggaaaaagattgggccaatagaaattttagctgttttcagtaaatctgtaccgcaaatggaagacgagttgttcttgtcgcaaaattag

SEQ ID NO: 13964 - DNA, 504 bp, Glycine max
  Peptide Sequence Number=SeqID_105649
atggtggtgagagattgcaagggtttaggttttcgttttctcgttaggagttgggaaacagcaatgggagatggtaattatgatatgagggagttctgtattcctgattacatattagtgccgggatctgaggtgaaaagtgtttcgcatgtacctgcttgtccagtgattgctttcataaacaccaaaagtggtggccagcttggaggggagcttcttgtttcctatagtacacttcttaacaaaaaccaggtttttgatttggggaagaatgctccggataaggttctgcagaagctttatgctacattggaaacgctcaagcacaatggagataattttgcagctgaaattcagaatagattgaggataattgttgcgggtggagatggtactgccagctggcttcttggagttgtatctgaccttaaattacctcagccgccaccaattgcaacggtgccattggggacgggaaataatcttccctttgcatttggatgg

SEQ ID NO: 13965 - DNA, 309 bp, Glycine max
  Peptide Sequence Number=SeqID_105650
atggaagaacgacacgaagctgaaaaacatcaccggagagtcgaaggaaatgcagcattcgtgcttgtagatgcgattggtgggttcggggatccgaacccgggagagataggagcggagcaaatccatgggttcgattgtcatcgtcgttcgctgaaaccccaaaaacccttggcggaagaacaagcaagagctgcgatttcgagaagtaatagaaagagaagaaacgcaagaatttataaagaaagagaaagaaatgagtctttttcaagtcttggcacaatgcaaacagagtctcactttcactag

SEQ ID NO: 13966 - DNA, 216 bp, Glycine max
  Peptide Sequence Number=SeqID_105651
atggtatcagagccagctctaaccctgggacctctcattcgcttccgctgcgacaaacacccaccatttgtggttcacgcaccaagcccaataagtgctgggcgtgaaggggggtgtattgggaaaatactcaagtcccacatcggctgcctcaatccttggagtgcagcttatatacctgttgggcaacttcacttaatgccaattttaagatga

SEQ ID NO: 13967 - DNA, 216 bp, Glycine max
  Peptide Sequence Number=SeqID_105652
atgaagggtgcccaagcctatgaggccatgatgcagaggattctgttcgaaccgtgtggacggagggtgaggtggcgggccagagatagaatccatccacacatgagcctttatgggttgtgtgacccgtttgcaagtccttcacataaaaagagtttggcaggaaaacaacagcagagttggtttgttggtgagtcaggaccagtgtacggatga

SEQ ID NO: 13968 - DNA, 408 bp, Glycine max
  Peptide Sequence Number=SeqID_105653
atgcaaggtgcttttttgcaggccatatttcctcgcatatttggccacgaagcatcagggattgttgagagtgtgggacagggagtgactgaattcaaagaggaggaccatgtgctaatagtattcattggagaatctatgtcatgcaggcagtgcacatctggaaaaagcaacacttgtgaaattttgggattggaaaggaggggtttaatgcatagtgatcagaagacacgcttctcattaaaagggaagcttgtttacaattattgtgcagtttcaagtttcagtgaatatacagtagtccattctggatgtgttgtgaaagtcagcccccttgcacctcttgagaaaatatgtcttctgagctgtggggttgttgcagggaatagatcaatggagtttcagtaa

SEQ ID NO: 13969 - DNA, 183 bp, Glycine max
  Peptide Sequence Number=SeqID_105654
atggatgattgtgaagtgaacaatttgttgggcgaaggggagggagaggagggtgccgtagaggcgaaggaaggcagaggagacgaaggggttacgaaggaaggaggacttggaggtgtggggttggagggaggtggtgaggagggggaggttgagggcggtgttgaacttgagggcgagtga

SEQ ID NO: 13970 - DNA, 210 bp, Glycine max
  Peptide Sequence Number=SeqID_105655
atgggagttattgtggcacttggatgtccaagcttagataggaaagtgatcaactcaggaaaatgtctaagagcatatactggtattgatgagggaaatgtaagtgatacacatgcttcacaagtggaaatcaaggaccaaactattgctcttgaggatgacgctggcttctttacgaatcaggacacattgagcacaatagaagcttag

SEQ ID NO: 13971 - DNA, 1158 bp, Glycine max
  Peptide Sequence Number=SeqID_105656
atggcggcattcccagaacaatttaaagtctcaaggtgccctctgactctctcagatgagctctttgatgggatcaagagtgcatgtggtggtgccaaaagtggtgctgacatggagctccaccacaccaggtggtgtccagtgcttacagcatggttgtattctacatattctgccactacactaggcagcatgagatgccatagccatagccatagccatctagttgagcaaaacgtccatatggagctacgttgttgtcatcatcttcatttcttcatggtgattacaggtggtttagttacaaaagtcctaaatgttgctcgtggacaaccaaaacttaaatttaaaaagctcactgacatttatgatggcttattgtctcataatgatgatggaatggttgaaagatcatgcttgggtgaaattgaggaaagccttgtgaaaaccaagcctgatacttccatatgtaatgtcaatggtgatgatgatgatcagagaatcattaacttggatgatgacaactttgacaattttaccctaagccaaattaaagcaagttgcaaaacaaggaagcgaaaacaatcacaaggtcttgactcctctaaaataaacatgaaagttgaagattcatcattcctggaggactacagaaagaagcatagggaaacaaatgattatgatttcctggagactttcgatagcttgaaatctaaactatcaaagaatatgaaggcgaaaaagaaaaaattctttgaagaaccaagccctactgatacccaagagattatgttagtcatcaaatttgaacctcaagagatcctaaacaaccaagagctcccaccctctagcaaagaaatcctagactatcatgagttctcagcttctagccaagagatccaagactatcaagagttctcaccctcctgtgaagagatccaagacggtcaagagttcccacccattagtgaagagataaaaattgatcaagagatctcattctttagtggagattcaatttcccttgttgaagtgaaatctgaggttcctaaagctgattgctatggcgagaataatctgggcgcgctaagtgcatttccaacccgagagggaattgcgctaagcaagaattggcctgctgagcgagccttagtgtag

SEQ ID NO: 13972 - DNA, 1011 bp, Glycine max
  Peptide Sequence Number=SeqID_105657
atgtctaggaatactagacaatccacacggctaaggaggttgactttaagaaccttgggtcagtccaaaccaattgtaaacatcaatgccgcaattggccgaggatcgggcccacataaagagaaattccacagctatctaggggtcttagctagagaaaaaattccaattgtacataacaattggaaagatgtaccgaaatcgctaaaggacctagtatgggatgacattttggcgaaatttgatatcccagaagcgccgaatgcaaagaaaaaggggcaacataaacatgattctttggtaaaatatggcctagatccagaaacttgggaggaatttgccgcaagccgcaaaacccctaactggcaggactcattggaagaacagacgacacagggtacttttgtcccccatggtcgtgatgacatacttaacactgccattaggcgatcggatcatggaggtcgtgtttgtgcagcggggtctggggtcacaataactcaatattatggaaggacatcacgtgcctccagtagctcatccacatccatcacccaacaacatttggctaaaatcataggaagccttaaggaagagtggaggaatgagattaaggaagaagtcaggaatgagattggagaagaaaacaaacaaagtctaaagatattgaaacaggagttgaaggaggccatcataattgagatgtcgcaaaagggatcgcagttctcaccaactattaaggcagatatacatgtgttaggtgcaagcatgagcacaaaggggagcaatgctgaaactgctgtgaaccgatctagggaagaacatgttgctcatgtgataccaaatatggggttgcatgtccaacgtcaagattctacacagttggtggccttgggaaaaatatatgagggaggccctaccatacacagcatggcatatgcagatgatgtcataagggttagtgttgaaaaagttattgacagtgatgctgaagtcccgttgccgacataa

SEQ ID NO: 13973 - DNA, 591 bp, Glycine max
  Peptide Sequence Number=SeqID_105658
atggtgatgaagctaagttgtaacaaagttcttgaacctagaaagtggtccaacattgcgtttgggcctaagaggatgaatgtggctcgttgggctatcaatgttctctggattaaaaagggcattgtcctcaatgaccaaggaagagtcttgaatttgacgtgcacatccatgtttgttgcaaacggtgtagattcgcttggagcagagggtggagaagagtctctggcctgtgttgagttccactttccaagtacgatttacttgaacatcagaacagtgtctacttcagccatgagagaatccacgggcaaggtttggaacaaggtgggtacaacgaagagaatgtcaacaagagtagttcactttcaatgttccttcgagaaagaacatctgccacccggttttggtgacctggttgttgctcaggagtcaacaagctttgttggtctgtatatataccttgaaataatttccaatcaaggattgcctatgaagcacggatactccattcccttgccgtgtccggtgtgtccacgtgtccatgtccgtgtcgtgtccggtgtccgtatcgatgtcggtgcttcatag

SEQ ID NO: 13974 - DNA, 420 bp, Glycine max
  Peptide Sequence Number=SeqID_105659
atgtcgcaaaaagaaagagagaacaacaagagcatagcccgacttaaagttcaagctgccaacatcagttatccacattccctcatccaactagttcaaggcaatctctttcatgggctatcgaatgaagatctatatgcccagaaggctcttatccatggagttatgctcttgaccgcctccacacaacttctcgatgcctttgctggtggaaagatcaaattgaagacacctgataaagctatggagttgattgaaaacatggcagccagtgatgacaccattcttcatgatcaagcttacacacccacaaagaagagtcttcttgagatcacttctcaagatgcattactagctcaaaacaagctcctatccaagaaaatcaagaccttaacagagaccttgaacaagcttccttaa

SEQ ID NO: 13975 - DNA, 378 bp, Glycine max
  Peptide Sequence Number=SeqID_105660
atgtgtgattgcaaatgctacttcatattgagggccacagggctcaacaatccagctgacactattgttagagctgccaggggagttgctacgtgcacccaacattattgttggggcacccagcaaacagtgaagtggcgaaattgcccttcagcaaattcattttcggaagacgtttttttcggaaacatttcggaagataatttttctggaaatattccggaagaaccttcttccggaagaagaatttgtgattccggaagtactctgcaactctttccggaagaacgtcatccggagtgtttccggaagaagcttattccggaggatatccttttacttccggaagaagggtcttccggaagtttttttttttaa

SEQ ID NO: 13976 - DNA, 1038 bp, Glycine max
  Peptide Sequence Number=SeqID_105661
atgctacaatgtgagggttttgagtcggataaacttgttgagttgaatatgagccacagcaacatcaaacaactttgggaagacacaaagcctctacccaatttgaggcgtttgaatctctcatccaaaattctaattaaactgccatatattggagatgccctatatcttgagagtcttgatctcgaaggatgtattcaactcgaagagatcggtctgtccattgttcttttacgaatgcttacttttctgaatttgaaagattgcaaaagtcttattaagttgccacaatttggagaggacttaattcttgaacttctagttctcaaaagatgtaaacaactcaggcagattgatccatccattggtcttctaaaagagcttacttatttgaatttgaaatactgcaaaaatctattattatatgaacaaagggacccagagcatttaaagaagattgatatagatgccactcctactcatttccaaccaatatcttcctactccagagaatataaaaaatcagttaatggcttaatgccttcctcgccaatttttccatgtatgggcaaacttgatctaagtttctgtaatttagttgaaatccctgatgctattggaattatatgttgcttagaaaggctagatttaagtggtgacaatttagttacactgcccaacctcaagaagctttccaaactgttctgtttaaagttacaacattgcaagcagttgaagtctttgcctgagctgccttcacgaattgacttctcaggggtgtggtatgttggaagagatacaggattatacatgtttaactgcccagaattagttgatagggaaggctgcactaacattggtttttcatggatgatacaaatttctcaggttttgcaagttccagtcaattgtattggaagtgttactcctgaaagtgaaataccaaggtggttcaataatcagcatgagggaaactgtgtaagtttagatgcatctactgttatgcatgacgatagttggattggcgttgcgttttga

SEQ ID NO: 13977 - DNA, 477 bp, Glycine max
  Peptide Sequence Number=SeqID_105662
atgaggacatacgatgtttttgtctgcttccgcgtcgaaacacgcaacgacttcaatggttttcttttcaaagctctgcgaaggaaaggcattgatgccttcaaagatgataaagatatcaggaaagttgcacacctctgcaactgcattcaaacatcaccaagacgtgttgtacctattttttatgatgttgatacatcacatgtgcgaaaccagagtggatgttatgagatagcctttgccaaatatgcagaaaggctcaaagaagataaagagaatacggatgaaatgcagagatggagagaagctcttacacgagtggccagtgtctctggtaatctactacgtgtatactatattttatcatttgttactgatgtggttttcatcaatttattaccccttttaaacttaagagaggttgaagaggaacaatggcaagattttccttatgagtggtcgttcattcaactctag

SEQ ID NO: 13978 - DNA, 279 bp, Glycine max
  Peptide Sequence Number=SeqID_105663
atgaatgaagtacctcatatgaacctacgattcactctcaactctcaagtcaaagttctttggcagcttgtcatcatctatttgagtaataatattatttggagacttattcatcaattgactacaactctaatatacacaattgagcaaaagactcaagcaattgaccagaggaacaaaagcagcaaagtaggtagccttacgggagttattgctatcctagcaattacatcaaaacattcaaacattgcagcaacaccagcaatcaatgcattgtag

SEQ ID NO: 13979 - DNA, 282 bp, Glycine max
  Peptide Sequence Number=SeqID_105664
atgaaagacatcttaggggggattgttgggttccatataacagaacaccaactaacagtaggcttgacacctctaatatttgacagtgactggaaaaagattgaagcatttgttgtatcaaagacagtcatccaggattttggcactttccaaataaagaattggttattggacatgaaatgccaaaaaaaagaagatttcaggacacgaagtgcttccatttgtcaattcacctattttggtatccctaggtggcttggtgaattcaattctataatatag

SEQ ID NO: 13980 - DNA, 240 bp, Glycine max
  Peptide Sequence Number=SeqID_105665
atggtgattgagttgcaaaataatgctatatatcttcaaagtaatgatgaggacatgaccaagagcaagggcaaggatccacttgaaggacttggaggacctatgacaagggctagagcaaggaaagccaaggaagctcttcaacaagtgttgtccatactatttgaatacaagtccaagtttcaaggagaaaagtccaaggttgagagttgtatcatggcccaaatggaggaggactaa

SEQ ID NO: 13981 - DNA, 222 bp, Glycine max
  Peptide Sequence Number=SeqID_105666
atgactttattatatgatgtagaagaaagtgaatgtgaaccttttatccctttgaaaggcttgtatttaaaaattatatatgtgaggggtagagggtgtcacaagtgctacgctggaagcaaaaccctattcgagaagcacgctggaagcccaaggcaatggggtccatgctctccaggccaccaaagcccccaaacccaaaatcaatcgacaccgccataa

SEQ ID NO: 13982 - DNA, 336 bp, Glycine max
  Peptide Sequence Number=SeqID_105667
atggatgaaatcaagtttctattttctgtccaactaatgcaggtccaagcatccttgattgtaatcatgtgtcaggatgctctatcaaacattagtgtagattgttgggcttggatgctacatagagaagaaagttcagcgcttttcctaagttctctaaaaccagtagaggcagaagcaatggcttttcttgaagctattaattggctgactaaaatggggtatgacaaagctattttagaggctgattgtcaagatatgatagaaggaatcctagcaaattgtatagcaaacattgaattaggggccattaacaggtcgtgcaaacacaggtga

SEQ ID NO: 13983 - DNA, 198 bp, Glycine max
  Peptide Sequence Number=SeqID_105668
atgaaagtcaaacacacgcgttatgcaacaaatactctagactcaagcctcatgcaatgtgggagaccagtcagagtcacattgttttgcgagaatgctccaaccatgtgggatcggcacatgcttaaaggagcactcaaaccggatgacccccaaggcctacactccgaagagtccgtcagagcctctccctcctga

SEQ ID NO: 13984 - DNA, 264 bp, Glycine max
  Peptide Sequence Number=SeqID_105669
atggtactcgaaaaattgatttatcttgaaaatccagccaagcggttcaggattggtgaagaaggtgatggagatggagaagaggatggcgagaggatgggagtgactttgttgagaagctcatcaattttctgggttaagaaccctaacagagcaatcggaggaggagctctagagagcaccagagatgccacaattgctaacggagaacgtttgagtgactacatcgaggtaagggatgagttactcacgcttggggattag

SEQ ID NO: 13985 - DNA, 498 bp, Glycine max
  Peptide Sequence Number=SeqID_105670
atgatctcctccgacgacaggcgcttcaatgttggagggcgccgtggcggaggcgaacacggtattggcgaaggaaggagtacgggggcaggagcagggcgtgggggtggtatcagtagcactggagggaggttgaaacgcctgtacctcgtgatagatttcgggcatgagccccgaaatgaagcaactcaagaggaattgaggagggagcctgaggattctgttgacgaggtcctcaaattccggaagatactgcgcgacggtgcccttctgagtcagcttgaagagagtgccagtggggtcatcgtagtgggacgaagcgaaacgagtttggagggcctggatgaacgccgatcaagaagaacaagggaaagggtggaagtgggttgtggtgtggatgaaggggagaaagtgagtttgagaatggtggcttcgagtggggtagacggtcttgaggtggggaagggttcagacatggtgacgagagcaccaaaatga

SEQ ID NO: 13986 - DNA, 734 bp, Glycine max
  Peptide Sequence Number=SeqID_105671
atggggaagaacaagggtcgtcaatcgcactcaactgcaaagcaaattatggtgaagggtactacctcagaatgtagtgctaaatctgaatcttcctcagaggtttcttgcaccttaggggacaatgattcaaccactgatgatgattcatctcactcctgtggctctaagtcatcaccgcagctagacgacaataaggctcccactccttgggtcaatctgttcaaagataacagaaacccttccaaaggcttgggacatagccttattggctatgtggctagccgattcctaggaaagaaagctctgctggattgttgccaaaaatggggagtcaagttttcatactcagctcatgaaagtggttggctggtgtttaaatttgagtctgaggacgatctgaaccaagtcctctctgcaggcccttacttcatatttcaaagacccctgctattgaaggttatgccagcattctttgactttggcaatgaggagctcagcaagatccctgtctgggttaaactcagaaatctacctctggagctttggaatcctcaagccttagggaaaatcctgtccaagattggtttgcccattcgatctaaccatcttactgcttctaagaggtctatttcttttgctagagctttagttgaggttgatgcttctttggagctcatcgatgaagttcgatttagacttcctatagggaagaattttgtgcaaaagattga

SEQ ID NO: 13987 - DNA, 231 bp, Glycine max
  Peptide Sequence Number=SeqID_105672
atggcatcatcaaccctccatccccggattcctttgagtagcaggcgacacagggatccttcgtcccccatggacgttaggatgttctcaccgctgctattggacgtccagagcaccctagacgtgtctgtgctgctggagccggtgtcaccatcaagcaataatttggatcggctccacggatgtcccgaagctcttcctccctgcctcttgaagaattacaacagctga

SEQ ID NO: 13988 - DNA, 756 bp, Glycine max
  Peptide Sequence Number=SeqID_105673
atgaaaccaaatacatctcttgagaataactcaggagttctgaaactcaatgagaaggggattcttgagcttctcaatgctacaaacaacaccatttggtcatctaatacatcaagcaaatcgataaatataaatatagtaggaatcacagttggcgtgactacttttggattaatcatcacatgtgtgtgcattataatgattaaaaaaccagggacagcaacaaaattgaacaagaagcgttacaaaaataaacaccgaacagaagacattgacttgccaacagtcttagctaatgtgactaaaaacttctcaacaaaaaataagctcggagaaggtggatttgggccggtatacaaggtgactaagaaaacttcccaaacttctgttttccttaaaatctttctaactatggcagaagataactttcagggcacacttatagatgggaaagcgttagctgtgaaaaggctttcaaagaagtctggacaaggtttagatgagttcaaaaatgaagtggcactaattgccaaacttcagcactgtaatcttctgaaaccaaaaggaagttgcattgcgaggggacttctttatcttcaccaagacttcaggctgaggattattcacagggatctaaaaactagcaatattttgctggatgcaaatttggatccaaaaatatcagactttcgcttggctcgatcatttttgggagatcaagttgaggaaaacacaaatagggtgacaggaacatag

SEQ ID NO: 13989 - DNA, 372 bp, Glycine max
  Peptide Sequence Number=SeqID_105674
atgcctcctgagtatgctgtgcgtggcaatttcccagtaaaatcggatgtctttagttacggagtaattgtactagagattgtaagtgataagagaaacagagaatttgcagaccccgaaaactacaataatcttcttggacatgtaaggcaacaggaatggagattatggactgaagagagggcggtggaactattggatgatgtggtaggagaacaatgtgcaccctctgaattcataaaatgcatacaagtaggcctattatgtgtgcaacaaagaccaaaagacaggtcagacatgtcattagtggttttaatgttcaatggtgataaatggttgccaaagccaaaggttcctggcttttacacttaa

SEQ ID NO: 13990 - DNA, 1509 bp, Glycine max
  Peptide Sequence Number=SeqID_105675
atgactacaacttccacttcagtagaccgtttagcggtgactcaatccatccgagatggtgagactttggcttctgcgggtggaattattgaagcgggtttcttcagtcccggaaattccataagacgatatttgggtatatggtacagaaatgtatctccttttatagtagtgtgggtggctaacaggaatacacctcttgagaataaatcaggagtccttaaactcaatgaaaaaggggttcttgagcttctcaacgccacaaacaacactatttggtcatccaatattgtatcaagcaatgcagtgaataacccaattgcttgcctttttgattcgggaaattttgtggtgaaaaatagcgaggacggcgtcttgtggcagagttttgattatccgggtgataccttgatgccaggaataaaacttggatggaacttagagactggactagaaagatctatttcttcttggaaaagtgatgatgatcctgctgagggagaatatgctataaaaattgatcttcgagggttacctcaaatgattgaattcaagggatctgatataagaatgagaacagggtcgtggaatggcttgacaacagttggatatccatctccaactcctctattgatacgcaaatttgtggtcaatgaaaaagaggtgtattatgagtacgagattattaaaaaatcgatgttcattgtatccaagcttaccccatcaggcataacgcagagtttctcttggacaaaccaaacaagcacaccgcaagttgtccaaaatggggagaaagatcaatgcgagaactatgccttttgtggtgcaaattctatatgcatttatgatgataactatctaacttgtgaatgtctgagaggttatgttcccaagtcacctgatgaatggaatatacgaatttggtttgatggttgtattcggaggaacaaatctgattgcaaaatcagttatacagatggcttcttgaagtactcacacttgaaattgcccgacacgtcttcgtcatggtttagtaacactatgaaccttgatgaatgtcaaaagtcatgtcttgaaaactgttcttgtaaagcatatgcaaatttagatatccgcaatggaggaagtggctgtctactttggtttaacactctgttagcccatattttcgacgggctaaaatatgctctaagtatgcattggatgtcgtctcgaggttcgaagcgtattacagagcaagagtctggtcaggacctgttcgaatcgaaaagagagaagagtcttttgaaagggattcccaggttcaaggaggtatttgcgaagtacaaggctaggataagaaagagagctttcgaatcattgggtgattcgaattggagttctagacttagcacaatttctgacaacttcacaaaattagcttcaacttcgagcaagatggataaccgttctaaggagcagttatgtgcatgtaagatgtacgtggcaggacacttggcattcggataa

SEQ ID NO: 13991 - DNA, 315 bp, Glycine max
  Peptide Sequence Number=SeqID_105676
atgcattggatgtcgtctcgaggttcgaagcgtattacagagcaagagtctggtcaggacctgttcgaatcgaaaagagagaagagtcttttgaaagggattcccaggttcaaggaggtatttgcgaagtacaaggctaggataagaaagagagctttcgaatcattgggtgattcgaattggagttctagacttagcacaatttctgacaacttcacaaaattagcttcaacttcgagcaagatggataaccgttctaaggagcagttatgtgcatgtaagatgtacgtggcaggacacttggcattcggataa

SEQ ID NO: 13992 - DNA, 192 bp, Glycine max
  Peptide Sequence Number=SeqID_105677
atgaatgaagacatgaagcttaccttgagtggtagccagaggcaacatagagtgggactaagaaagaagagtcatgagcagttggtttcagcggcagtcgtagcttcagtagggcaatttgcggtagtcggtgctcaggcagaaggagaaataagaaacaatagggttttagcccgtggggggatgaagtaa

SEQ ID NO: 13993 - DNA, 854 bp, Glycine max
  Peptide Sequence Number=SeqID_105678
gattctttggaggagcaggcgtcacagggatcgttcaccccccatggacatctggatgtcctgactgctgccattgggcgaccagaacactctggccatgtttgtgctactggagccggtgtcaccataaagaaatactttggatcggctccacaaaactcccgcagttcttcctccttccctccagaagacctacaacagctgacccaacaaatcagggaccagttggaggagtcgatcacagaaaaaggacttgcactacctacggagcctgacgttggtccctcagggcctcgtgtcagtataaagagttgtgttgatccctcagggaacgatccagagacgggtgactcagacaagtatgagctgtacattgaagcaaatacgccccacctggttgccctaggaagactttatgagggatcaatagttcacaacattcctttattgcctgcccaagtgaaggttggtgttgaggaggttaaatatgcacaggctccccttcctgtacccactgatgagacaactgtttcttcagcaaaacctccacaaaggccagatcctgaggtcaatgatctgctatatttgatgacattgaccattctagagcttttcttgaagcctttccaggttaactggcatgctaccgtgttcagagtgtttaatccaaacttcccgctatacataaagcacgaagatcccttcaaaatcgcacacagtggtcaatgtctcaacctatctatcatacagttgtggattctatctgggcaatcgcagtttgaatcagaaagctacatgaagagttggatgcagagttcacaatgcgatgtctaccttggagcctatctgaatgg

SEQ ID NO: 13994 - DNA, 519 bp, Glycine max
  Peptide Sequence Number=SeqID_105679
atgcctaattacaattcgctcaagcgttcttcgttagcaattgtgacgtttctggtgctttctagagctcctcctccgattgctctgttaaggttcttgtgcgttagaaaaagaaaaaggaacagaagcgttcaacgaattggacgaggccatcgtgactatttgctgctacttttcatcacaacatcaccaaaggaaaaccatttcgtcatttgtggtttaggcagaaaaaagaagaagagggaagaggaaaacagaaaaccatctagatttgtagagaagaagagaagaccaaacaacttagggatagaggaaccaaatacggatacgataaaaaagagtgggaagaagagaagagaagagaagagaagcagatggtgtctgccttacacacagtgtcgcatcgttcaaagggtgttgttgctgtctcttccttctattcccgttcctagcgttgctggtgctagcggtggtgctggtaataatcgtagcggtgaagccaaagaagctgcagtttga

SEQ ID NO: 13995 - DNA, 405 bp, Glycine max
  Peptide Sequence Number=SeqID_105680
atgaatcttataaggcgccaggtgttggtaaatgataggttgtgtccattctgtggacttaaagacgaggaggcagagcatctatttttcaactgcagctgtaccctacctctgtggtgggagtctctatcttggactaatataacaatagcattgccaattaacccaagagaccatttcctgcagcacacacttggggcagctggagtaaggaaccttacaagatggaaatgttggtgggtttctttgacttggttaatttggaaccacaaaaataaaatagtgttccaaaaccacacgtttaatgggagtagattgctggacgatgtagtactggccggacctagaacttgtatagctcctatggcaaaatgggcaagtagtgaggcacaaccaaacacatag

SEQ ID NO: 13996 - DNA, 114 bp, Glycine max
  Peptide Sequence Number=SeqID_105681
ggtgagcctcacagcaacgacgacaacctaagggtggctatgcgagactcagcatcgagggtcaaggacaatgacagtgatgacgacggcctgagggtgcctttgcgagagtga

SEQ ID NO: 13997 - DNA, 642 bp, Glycine max
  Peptide Sequence Number=SeqID_105682
atgtcaatgtgctcacaagcattgatcttgtactacaaacacaatttggtttgtagcttagttatttgtgtgctcaaccttgtgttgtgcttactaagttacttttacttctataacaattatggttcagaggagctcatcacacttattgatttagctctgaaaaccattgtttggggtgctgtttgtgcttatttacattctaccaactccgaggcattggatccgagtttaccacgctcctctattatgagtttatttctatgttatgttggatcacttggatgttctattaacagtatggttaagcttgccccacttgaagagccccttttgaatggtgactctaatgtaagcaacaattatgttcccattaaggctagaggaaatgaaactttaacccggtattcaaatgctggattttccagcattcttactttctcatggatgagtcctttagtaactctaaggaatgagaagactttagagcgtgaggatctcccacatcttgctactaatgacagtgtggatgggattttgccaactcttacaaacaaacttgagtcagagtgtggtagtgtgataacaaccctacgaaaatatgaggttactgcacagatgaacaacactatgctagtgtga

SEQ ID NO: 13998 - DNA, 381 bp, Glycine max
  Peptide Sequence Number=SeqID_105683
atgaatgtatatacctgtagccggaggagcaggtctccaccaaaggtcgctagggtctccgtgtctttcaaccctgccgctgcctctggaactcgatgccatacctttctaaacaccataattcaggttccacgaaaatgccattgccgttggtctcgattgcctccgttcagaggagcactaggcctcgatcactgccattcaggttgcagaaccacatccgactcggttccggttgggtgtcgtcattctggtcacagattcagtccctcaatgcaacgtgtggttgtgtgttccttagtaggcacagcagagacgaggattggggctggactggatgcggagcctctgcttctgatccttcatgggattggggcttag

SEQ ID NO: 13999 - DNA, 297 bp, Glycine max
  Peptide Sequence Number=SeqID_105684
atgacgatctcggactcattcaccgttggatcgttgtcaaatttgagcatcacgtttgcaacccaattccgagcattctcaccattgagaatttctatatttagcacgctctcaccgttgggatttgtgagatattatttgcggagggagaaatataaatcgcatggtgacagtataagtggaggcttcaatcccttctctgtctctttgacgtttgagaactctatcggagcagttagaggaaaaaaattggagaaatctcagggaaccgctagagatgttgctatcgctggctga

SEQ ID NO: 14000 - DNA, 2145 bp, Glycine max
  Peptide Sequence Number=SeqID_105685
atggcgcatagcatcataatgttacatatttggttcttcttattctttgatatgttgggaacttgcacttcactagacagtttggcagtgagtcaatctatccaagatggtgagactttggtttcaacaggtggaattactgaactgggtttctttagccctggaaattcaacaaggagatacttgggtatatggttcagaaatgcatcccctttaacaatagtgtgggtggctaaccgaaatatacctcttaagaataactcaggagttctcaaactcagtgaaaaagggattcttcagcttctcagtgctacaaacagcaccatttggtcatccaatatattgagcaaagcagcgaataacccaattgcttatcttttggattcaggaaattttgtagtgaaatatggacagggaactaatgaggacgccatcttgtggcagagttttgattatccatgtgatacattaatggcaggaatgaaacttggatggaacttaaagactggtctagaaagatctttgtcatcttggagaggggttgatgatcctgctgagggggaatataccatcaaaattgatcttagaggatatcctcaaattattaaattcaagggacctgatacaatatcgcgatatgggtcatggaatggcttgactacagttggaaacccagatcaaactcgttcacaaaactttgtgctcaatgaaaaagaggtgttttatgagttcgaccttcctgatatatctaccttcggcgtattaaaattgaccccttcaggcatgccacagactatgttttggacaactcaaagaagcaccctgcaagtggtcttgttaaacgcagacgatcaatgtgagaattatgccttttgtggtgcaaattctgtatgcacttatgatggctacttacttccaacttgtgaatgcctgagaggatatatccccaagaatcctgatcaatggaatatagcaatttggtccgatggttgtgttccaaggaataaatctgattgtgaaaacagttatacagatggcttcttgaaatacacacgcatgaaattgccagacacgtcttcatcatggtttagtaagatcatgaaccttcatgaatgccagaattcatgtcttaaaaactgttcttgttcagcatatgcaaatttagacatccgtgatggaggaagtggctgtcttctttggtttaataccctggttgacttgagaaaattcactgaatcgggacaagacttatatatcagactccctgcctcagaattagatgatggtggccaaaaaaaaatcaacaaaaagattgtagcgatagctgttggtgtgactatctttggattaattatcacatgtgtatgtatattggtaattaaaaatccaggcacaaaaacaaaaatgtttatactacgtgtccaggtttatatactgttattttccaaccattcagggtctctaagaaaattttacaataagcgttacaaaaatataccaaggaaggaagacattgatttgccaactttcagcttttcagtcttagctaatgccactgaaaatttttcaaccaaaaacaagcttggagaaggtggctatggtcccgtatacaagggcaaactgttagatgggaaagagttagctgtgaaaaggctttcaaagaagtctggacaagggggttacatatcacctgagtatgctgcacgtgggcatttctcattgaaatctgatgtctttagttatggtgtgattgtactagagattgtaagtggaaagaaaaacagtgaattttcagacccagagcactacaataatcttattggacatgcatggagattatgggctgaagagatggcactgaaactattggatgaagtgctaaaagaacaatgcacacccagtgaagtcatacgatgcatacaggtaggcctattatgtgtgcaacaaagaccagaagataggccagacatgtcgtcagtggtaataatgttgaatggtgataaattattgtcaaagccaaaggttcctggattttacactgaaacaaatgttccgactgaagcaaataattcgttgggaaatccatcaaataacaaattgtgctcagttaacgaactttccatcacaatgttagatgcaagatag

SEQ ID NO: 14001 - DNA, 213 bp, Glycine max
  Peptide Sequence Number=SeqID_105686
atgactaaagcacgtcaaaagggggtacggaaagaaaatgagggagcagcttgccacccagctcacccaagcgagctcagctcgcccaggcaagctaggttgcttcctctagaaggcaccgccttccggagaacttcctggaaggcccaagtgggcctggttgctatttgcacccccctgtttactaaatacaccccttgccttttttgctga

SEQ ID NO: 14002 - DNA, 857 bp, Glycine max
  Peptide Sequence Number=SeqID_105687
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcttgatggataggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14003 - DNA, 467 bp, Glycine max
  Peptide Sequence Number=SeqID_105688
atggtgaaagttggaacctcttacgtgccgatcaacgtctcattttcgccaaaagttggcccagggcttcccggtatcaacagggacaccaggattatttattccgaaggtgtcttttcgtcacaggtttatgtctatatcaaggcttatcgcaaactgttccctcctgttcagctactgacggggaattggtatccgcgtcaattcggcacacaagcactacagccggaagcatcagcgcggcaagctgcccattcgccattcaggtgcgcaactgtcgggaagggacctgatcgggtcccagtcacggacgttgtaaagtactggcttactagtgaattgatattcaacgcttcctcgctcactgactcgctacaagctcggtcgttcgactgcggcgagcggaaatggcttacgaacggggcggagatttcctggaagatgccaggaagatacttaacagggaa

SEQ ID NO: 14004 - DNA, 375 bp, Glycine max
  Peptide Sequence Number=SeqID_105689
atgaccatgattacgccaagctcgaaattaaccctcactaaagggaacaaaagctggtaccgggccccccctcgaggaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 14005 - DNA, 495 bp, Glycine max
  Peptide Sequence Number=SeqID_105690
atgaagcacttcactgacaccctcatcagtgccaacataactaacgaatattctttattcgtatacgcaaaatctttaggctatatcttaatttgtattgtgatgcccttaccgaaatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14006 - DNA, 312 bp, Glycine max
  Peptide Sequence Number=SeqID_105691
atgcggcctatacggcgtaatagcaaaggcccgcccgatcgcccttcccaacagttggcgattcaccttaatgcagcgaatggcgacggtttcccgactggaaagcgggcagtgaagcgcaacgcattaagtggtgagttagcgtcactcattagcaccccaggctttacacttgtatgtccggctcgtatgcttttgcgaattacgctaaccaattccccgtcagtagctgaacaggaggaacagctgatagaaaccatgatagccactggagcacctcaaattaacccatcatacactagaatcaagtaa

SEQ ID NO: 14007 - DNA, 310 bp, Glycine max
  Peptide Sequence Number=SeqID_105692
ggattgtgcccgtaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgctgcgtctccaggcaggcgcagggcgaaacaccacagcagcctggggatggccggcagcgggcaacagacgcaccgccatcacctctagagttcacctcagctcatccacaaaaaggttagagcgttgcttacgacccatggccgaccaataa

SEQ ID NO: 14008 - DNA, 629 bp, Glycine max
  Peptide Sequence Number=SeqID_105693
gatcacgccagagcgctgtatctggtggcgacccgcggcgagccgggcgaaacttacaatatcggcggtcataacgagcgtaaaaacatcgaggtggtggaaaccatttgcgaactgctcgaagagctggcgccgcataagccgcagggcgtggcgcattatcgcgatctgattaccttcgtcgctgatcggccaggccacgatctgcgttatgcgattgacgcggcgaagattgcacgcgagctgggctggacgccggatgagacctttacttccggtatgcgcaaaactgtccagtggtatctggcaaatgaggcatggtggcgacaggttcaggacggcggttccggtacgcgcctgcatcccatcacgcgcggcgtgtcgaaacagctgctgccaatttacgacaagccgatgatttactacccgctgtcggtgttaatgctggccgggatccgtgaaatccttatcatcaccacgccggaagatcagcgcgatttccaacgcctgctcggcgatggttccgagtttggtatccaattgcactatgccgttcagccgacgccggatggtttagcccagcgtttatcatcggggaagcgtttctcaacggcgaaccggcgtgcctg

SEQ ID NO: 14009 - DNA, 491 bp, Glycine max
  Peptide Sequence Number=SeqID_105694
atggctgaatctggcagagagatacatgagaagcaaagcaagcaaacattcctgacatggtggggacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14010 - DNA, 696 bp, Glycine max
  Peptide Sequence Number=SeqID_105695
atgaccatgattacgccaagctcgaaattaaccctcactaaagggaacaaaagctggcacgccggtcaattcagcttatggtgccatcgtccggggctgacgggaaacggcgcgtgcggctacggccagtcgcagttcacgtcgctgcccggaatcgagcacatccggccagaacagcaggcgctggcggcgccgatcctcacgccacagcaacaacagccatgggccacgcaccaccagccgtggcgtatcaacgtcctgcccggccacctgcagtggctcgggaagcggcggcagaagcacctgcacgcgcggcctgcgctggcgccaggccacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14011 - DNA, 161 bp, Glycine max
  Peptide Sequence Number=SeqID_105696
gacctcattgaagctcaaagatccaacctccatagaagccccacaagcaagcttccatcaagtggtatcatctcaaggaggtgagcttagttatgagagggggttctttaggaatcttcttaaggaagcttctccaggaggtgagcttagttatgagaggg

SEQ ID NO: 14012 - DNA, 63 bp, Glycine max
  Peptide Sequence Number=SeqID_105697
tggtgtgtgactgaaaaactgggggaccccgtgactggacctgtccacagtgcagttctgtga

SEQ ID NO: 14013 - DNA, 333 bp, Glycine max
  Peptide Sequence Number=SeqID_105698
atggtgaacgcaatggaagaatggaagtctcaagagctgaagcagataggggatgtgtcaacttctagtataattgaccttgacattgacaaaggatatccgtgcttgatgtatccaggggtgtcacacgatgtggaatcatgcccaatagctgaggagctgctacagggaatgataagcagggggcaaattgaaatctgtagtgcaacaaaggaggaaggggagggacattaccactcaggtaccccgaggtttccatccccttatagcaaagacgccgacaccttcccttacaagagtgataaggcagtaccatggaaatatggtgtatag

SEQ ID NO: 14014 - DNA, 330 bp, Glycine max
  Peptide Sequence Number=SeqID_105699
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcaactgatttcacctatgaaagcttgtgcatccaataccctgatgaggatgtcccatat

SEQ ID NO: 14015 - DNA, 259 bp, Glycine max
  Peptide Sequence Number=SeqID_105700
ctggacgcttgatggcttgtcggtcacggacctagtactttgcttacctttggctttggacttggtcgcttattggtcggccatgggtcgtaagcaacgctctaacctttttgtggatgagctgaggctgttgtggtatttcgccctatgcctgcttggggacgcagtacttcttgatgaaagctcgattagtagggggcctgatgcccttgctggaggtgacaggcactccgtagaactgacagagacccgtaattag

SEQ ID NO: 14016 - DNA, 272 bp, Glycine max
  Peptide Sequence Number=SeqID_105701
atggaaaaatacagtttgtttacggtagtaaaagatggtcaagaaaggtttactgaaagtgtatcaaaagtcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 14017 - DNA, 351 bp, Glycine max
  Peptide Sequence Number=SeqID_105702
atggctctcgaagaacttgaccagctgactcaacaaatcagagaccagctggaggagtcgatcacagaaaaaggacttgcactacctctggagcctgaggttggtccctcaactgcttgtgtcagcataaaggggagttgtgttgatccctcagcgaccgatccagacacgggtgactcggacaaatgcgggttgtacatcaaagaaaacccttgccgcctggttgccctaggaagagtttatgagggatccacagcggttcacaacatccctttgttgcatggccaagtgaaggttggtgttgaggaggttaaagatgcagatgctcccgttcttgtacccactaacgag

SEQ ID NO: 14018 - DNA, 471 bp, Glycine max
  Peptide Sequence Number=SeqID_105703
atgcagacacctgtggtactagcggagggtgaaaccttacccacatattccagatactgcaggttgcccactgatattagagaaattgaggttgccttatatatcccaggtcgggggtttgttgtgaatgttgaaggccaccctgggaagattctcaggaaagatttaacaactcttgcacaggtgttgagtgttctctcatactccaacctcgctcctacttcccacacctcggacctgacagtagatcgagataggctgatctttggcctagtctctcaggtggacatgaatgtgggagctctcatctctggtcagattacatctatggcccagtctaactcttctagacttgggttccctgctcttatcaccgctttatgtcagtccagaggggttgcttctgatagcctagtgttcgaacgcctgagtctggtcattaacttggcctacatcaagaaaaactattga

SEQ ID NO: 14019 - DNA, 300 bp, Glycine max
  Peptide Sequence Number=SeqID_105704
atatcctgagaattctgctcatggtcaactcccaagaacagtggatgtaattgcagaagacgaccttgttgattcttgcaagcctggagatcgagtggcaattgtggggatatataaggctcttgcaaggaaaaggactgttctcatagccaacaatgtttctcttctcaacaaagaggataatgcaccaatctacagtgttgaagatgtcaaaaacattaaagagatagctacaagagatgatgcatttgatctgctaagtgattcacttgcaccttctatatatgggcattcttggat

SEQ ID NO: 14020 - DNA, 510 bp, Glycine max
  Peptide Sequence Number=SeqID_105705
atgttctatgggataacgcgacagcaccgcgttgccgtgatgcccttcaggatagactgcattgcggccgtaagcgtaatcactccacatggtgtcggccagaaattcgtagtgcggcgtgtcgggccagttttcaaagtggagcggatgcacttcgtgggcgcccatcacttcctgcaggcagacaatatccgcgctgacggtgcgcacagcgtcgcgcagctccgtgtagtcgtcgtcacaaaaagatgcggcgttacggaattttccgtaaagtgcggtagtctgattaagcagagaaaaatccttcaggagagaagccatgaagtggcaacaacgtgttcgtgtcgcaactggcctgagttgctggcagataatgttgcatttactggtcgtggccgtactggtgatgggctggatgagcggcacgctggtgcgtgttggcctgggactatgcgtcctttatggcgtcaccgtactgtcgatgctgtttttacagcgccaccatga

SEQ ID NO: 14021 - DNA, 281 bp, Glycine max
  Peptide Sequence Number=SeqID_105706
cttgggaggattgatggggacccggcgttgagaggaacgaggataagggctacgtgggagtacgtgagctcagttggaggtgagcaacaggagatggagaccttggggatgccaggtggggtgctattgcccaaaaccaagcttgaccaatcccgacccaacccgggcatagtcaataaaaagaacaaagaccacaaagcaagggggcttgtgtggtggctggccagcaatgaatcaggagtgagatttgggatatggcctctggtaatcgattaccaagg

SEQ ID NO: 14022 - DNA, 360 bp, Glycine max
  Peptide Sequence Number=SeqID_105707
atgggggcctttgtgatgaactcagctgcccatgctaatgttcttgattttcctcctcagcatctttcagatgtctcacctctccaagaggaaaacattgatgcagctgaagttcctcctgttgttgtagctaatgctaaacttataatgagatcctcaaagaagaacataaaatatgaaggatttcagcaatattttcttgtccaagtttctactatctatgtgattggagaagttataggggttttagagcaagtcgggagcttcagaattgtgtatggagactcatctgatggagcagtttatgtttacaagaatgatggtgatgatccaggcttgtcttctgcagttcatcaatga

SEQ ID NO: 14023 - DNA, 990 bp, Glycine max
  Peptide Sequence Number=SeqID_105708
atggcatttaagaaaaggaaagctccttctacacctacccaggccatatttgaaagatctaggttcacatcccaagaggcttgggagagatacactgacattgtgtttgatgagttcaaggaggaactcgagaggagacattgggatgagaagctaactgatttttctgacagtagcatagacattgctattgtaaaggaattttatgcccacctctatggccccaaggataaatcacctaagcaggtgagggtgagaggtcactttgtgaagtttgatgaagataacttgaacacattcttaaaggcacctgtagtgttggaagagggggagaatttgtgtacttattctcgatttgcactcttgaggcctgatcctcaagagttggttgctaagctttgtatcctagggaggggattcaagcttaatgttgatgggcagcctttgaagattctgaggaagaacatgaccactctagctcaaacatggagtgttctctccttttctaacctcattccttcctcccacacatttgatgtgaccttggacagagccaagttgatttatggtattattatgaagatggatatgaacttggggtacctcatctcctaccagatctctctaatttcacagcatgatacatccagacttggattccctgccttgatcgcagctttatgcaaggccagaggagaccagtcagattctagatccctggagaacttgagctctgccattaacttggcaaatattaagaagaactattggaatcttgatgatccaatagtgacatttagagggccaaggaaggcccggggtaagagatcagaggtccccactacttcagcaccaccagagacaccagctccttcttcttccatagctccagtaccttccttagctccagttattcctcctacatctacacagctaccagttccagctcctatatatgcaggaccatcagactttatatttacaccttag

SEQ ID NO: 14024 - DNA, 324 bp, Glycine max
  Peptide Sequence Number=SeqID_105709
atgcttcttcctcttcccaagaaagatttgacagatctaggtttcattcccaagaagcttgggagaggaggaactcagagaaggaaatgggatgaagaattgacaagcttcactgaaggtagtattgatgtagctattgtcagggaattctacgcaaacctctatgagccaaaagacaagtttcgcaacccacccttcggcgggagggcgacgcgggggctcacgggtgcgtcttccaagaaaagaaaatgcgcaaagtcgccaccaacgtttattcgaggaaaacgtcggaaaaactgggaaggtgtggtctacgaactttaa

SEQ ID NO: 14025 - DNA, 407 bp, Glycine max
  Peptide Sequence Number=SeqID_105710
atggctccaaagaagctatccatgaagaggtctagaaaagatgccacaggagagggatccagtgccgccccagagtttgatagtcatcgtttccagagtgctgagcaccaacggcgctttgaggccatcagaggatggtcgttccatagggagaggcatgtccatctcagggaggatgagtatacggactttcaggaggagatagctcgcagacattggacaccgctagtgactcccatggccaagtttgaccctgagatagtcctagagttctatgctaatgcttggcccacgaaggagggagttcggaacatgcgctcgtgggtgaggggtcagtggattcccttcaatgcagatgccctcggccagttcttgggtgacccgctagttttggaggaaggccagca

SEQ ID NO: 14026 - DNA, 791 bp, Glycine max
  Peptide Sequence Number=SeqID_105711
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggaactgaagtacttgaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14027 - DNA, 258 bp, Glycine max
  Peptide Sequence Number=SeqID_105712
atggagaaaaatgtggccgccgctgccgctgttagttcggctgccaaagcagacccaactctcctagctaccacgcaccatcctcccccaaatacgataggacgaggaaggagcacactagggcacaacaacaacacccatttgggatacaaccgggtggcttacccttatggattgccgcctaattacacgccgccagtcatgcaagatgatgcaggtcatgtctcttcccccatccttgaaggggagcctccttga

SEQ ID NO: 14028 - DNA, 381 bp, Glycine max
  Peptide Sequence Number=SeqID_105713
atggcgatgccagttatgcctgatacaacacaaatttctgccgagccagcttgtgctccagtgaaacctatgtgtactgcagatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14029 - DNA, 231 bp, Glycine max
  Peptide Sequence Number=SeqID_105714
atggagggtgctaataccttcctcaaacgtaaatacaactcccgaatatggaatattcctcatgaccgatttcctttggttttttcgacgttttccacaaataaacgttggtggcgactccgtgcattttccacctttggaagatgcacccgtgagcctcacctcgctcgcccgccaaagggtaggttgcgacagttggtgactccaccggggactatttttgtgagttag

SEQ ID NO: 14030 - DNA, 204 bp, Glycine max
  Peptide Sequence Number=SeqID_105715
atgtgtttgatcatggataagggcataaggttgatgcttgcacctaaatcaagaagtgctctacccaccgataatctcccaataatcacaggaattgtgaaactaccgaaatctcatgatttttctagaatggctttttggatgattgcactgcatcctgcttctagctctattgtttcatcatctgtgattctccttttattt

SEQ ID NO: 14031 - DNA, 273 bp, Glycine max
  Peptide Sequence Number=SeqID_105716
atgtataatggtataataacctatattgatctccactgcagtgcacattggcaaatggtcgtcattttgtctaaggaaaatattgtcatttggttttgttcgttgcataataggccatacaactacctcaaaggcataattaacagtgctttgaaaggactagacgatactcaacaaagtaaatccaagcctcctgctaggtggattgttgttaaaacaaaaaaggaagcactgagtgtgggtattacgccatgcactggatgtcaactataa

SEQ ID NO: 14032 - DNA, 417 bp, Glycine max
  Peptide Sequence Number=SeqID_105717
atgcaacacctaatgaagcttcttgaacaggatcaatatattcattggcataaattaaaggatgaagacgtggtacagactcccactgctcgattttgttgggtgacaccaactgggatcacattctctgccggttttgcatatctggagggtgaacatcttaataatgtggtttgggctttagaatgcttccgaggtataattttaagacgtgatgttctccctggagttatggtctgcacccatctgcttatagaacttgccaaattcgcagaagactatatcaagctctttggtggcacaaacagatttgaggatttaaggatgtcactacatgttgatgggttaaccacagtcactatggataagtggatggatataaccgacatggggatatgtgattgcatcatggtataa

SEQ ID NO: 14033 - DNA, 1035 bp, Glycine max
  Peptide Sequence Number=SeqID_105718
atgcaagctttaccgatttttttcaatattgcgcaacgcctatgtattgtcattggtggtggcgatgtagcgacgcgtaaagtgctcatgctgcgcaaggcgcaggggaaagtgactgtcatttcgcccgagttgtgcattgagctgaaagacatgtatgcgcagggcgaaattgaatatatgcctgctgagtttcatgcggaacaactgaccagtgcctgtctggtgattgcggcgaccgatgatgaagcagtaaacgaagcagtgtctgtcgctgccaagcgcctgaatatcccggtgaatgtggtggatgcaccagcattatgcacgtttaccatgggttctatcatagaccggagtccagtggtgatcgcagtctccagtgaaggcaatgcgccggtattggcgcggcatatccgcagcaaaatcgaaaccatgttacctgctgcctatggccgcattgcggcgattgcaggtgagtttcgtgaacaggtgaaagtcaggtttaccaatgtgcccgcgcgtcgccgcttttgggaagaggtgttgaacgggcctttggtggagcgcgtattgtctgggcaggagcaggcagcacgagagttactgggtgagttattaagtcagcgtgaggatacgcccgtgcgcggtgaagtgtatttggttgggggcggtcctggcgacccagacttactgacattccgagcgctgcggctgatgcagcaatgtgatgtctgtgtctacgataagttggtcagtaaagaagtcatggagttggtcaggcgcgatgccgagctgatttacgtgggtaaatcacgagaccagcatactttgccgcaagaggagattaatcagttactggccaagctggcgttggagggtaagcgggtgttgcggctcaaaggcggcgatccgtttattttcggacgtggtggtgaagagattgaaaccctgatgcagcatggtgtgccgtttcaggtggtgcctggaatcactgcggccaatggtgtctcagctatgccgggattccgctga

SEQ ID NO: 14034 - DNA, 273 bp, Glycine max
  Peptide Sequence Number=SeqID_105719
atggtccatttattgatgggcgaacgacggggattgaacccgcgcgtggtggattcacaatccactgccttgatccacttggctacatccgcccctacccccgcacaggggaagcaaagcttcaaacaaagaggttgggctgttcacttcattgatttgacttcactttacttaagattaaagataggggccgggcgggcagtgaaggctcgtttagtagaaaagcaagctccgctttttgaagcgagcccccagaaagcctttgcacgctag

SEQ ID NO: 14035 - DNA, 747 bp, Glycine max
  Peptide Sequence Number=SeqID_105720
atgcttccttttgactttcggcatgccacagaacttcacggattgcctaaagatgggtatcaagtacctcgaagtggtcaagcgagggtcgcatcccaacaaacagatggtccccagacgaaattagggtatgacaataacattgctatagttattaatgaaagtattgctactgagatggacccaattcacccgaccaatttcaatcaagtgaatcgtccagtctcagatgtaataggtcaaggaggcgaggccgtgaaaaatgcatgtgggcctcatcatgttcaggttcagagcaagcattccttcccaccatatgggttgcctcctaattatacactgcccattgttgtatatgcttttggtgacaatatcagtaattttgcacccgtactcattgagaatcaacaaccccaatctgatcatgcacatgtctctcaacccatgggggaaacacatgaagttccccaagaaaacactctggtcgggtttggggtttatcgaggatataccactgaagggcagtcattttctggcatccctgtgctgagcgctcttagaatatctcaatgtcacccgttatcacaaccattgcattttgtaaggagagaggggccttccacagtacttgagaaggaaaagattaagcatatggaggagttcctatgcaccattgaaaggggaggaaattatgcctttgctaacatggaagagttgtgcttggtacctggcatggttatcctctaa

SEQ ID NO: 14036 - DNA, 507 bp, Glycine max
  Peptide Sequence Number=SeqID_105721
atgcgagttcctaacaactgttcttttgatacactcaagcgtagaatgcacaacacccttcaactaactaacgatcaattactggatgaaatctactaccgaaagccattcatagatgcagaattattatgtaccattattagaacactggatgctatactcaacctgcttcaatcaaccatcgctcctactcatgatgcaattatgtattacgggaagtggaacataccacgtcaaggtgagtttttgggttactcctttactggaactaatccaataagatttggcattccttcgggatgtggcatggagaaactcaaggatctaatcaaacaagttgcacctacaggggttccccctaatggaattcacggatcacaattggttaaacgattattctttcgacaaccaggtcattctaagtattccgaaaatttgattgaacatgacataacagaattgaaaaatgatgaagacgtgctaaaagtgttagcacaatctaaataa

SEQ ID NO: 14037 - DNA, 417 bp, Glycine max
  Peptide Sequence Number=SeqID_105722
atgaagcacttcactgacaccctcatcagtgccaacatagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14038 - DNA, 480 bp, Glycine max
  Peptide Sequence Number=SeqID_105723
cggaatgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctgcgccgcagtcgaacgaccgagagggcctgccaccgcggtgaagcattcagacaccctcatcagtgctcaacatagtaagccacaaggccctggcaccgatcaggccttcccgaacagttggacgaatggcgaatggcgcagccctgagcgagcgcaattaagcgcggcgggtgtgagtggtatcactcgcgcacgtgacccggctttacacttgcccgctgatgtccg

SEQ ID NO: 14039 - DNA, 240 bp, Glycine max
  Peptide Sequence Number=SeqID_105724
atgattggcaagcgggccaggcactgttcggttgagtggcccggggttttcccatggtatgcgcaggttgcgttagggttataccactttgggaaaggaggatggcaagaggtctcgtacgtcattgggaacggggtgaattttgaagttggcctcgggggaaagttccttatcgcgttggaactggcgccaaagtgggcattgctggctgggcgagtcagggttggagccggagcctag

SEQ ID NO: 14040 - DNA, 827 bp, Glycine max
  Peptide Sequence Number=SeqID_105725
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtgggttagtgggattgcaatctgtttcatctacagccagcccttgctgaataatgacaatattttcccgttggatttctcattgcccttaactgaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14041 - DNA, 435 bp, Glycine max
  Peptide Sequence Number=SeqID_105726
atggatggaaagcagccatgtaatagcccaggaggaaaaggcccctaccttgccagctgtttaggcatctggatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14042 - DNA, 408 bp, Glycine max
  Peptide Sequence Number=SeqID_105727
atgcaggaagctgcacagtcaggaagcgttgatggcgtcatcaaccctccatccccagtcagacgccacgtgaagtggaagatggcccgcacgaagaagacaggggagatgacgactgaggccgcaaaggaaatcgctgagaagattgattcgtttgaggagcaggccacacagggatcgttcgtcccccatagacgtcaggatgttctggccgctgctattggacgtccagagcaccctggacgtgtccgtgctgctggagactttgtcaccatcaagcaatactttggatcgcctccacagacgtcccgcagcgcttcctccctacctcctgacgaattacagcagctgacccagcagattagggaccagctagaggagtccatcacagagaaagtgatgaggcag

SEQ ID NO: 14043 - DNA, 429 bp, Glycine max
  Peptide Sequence Number=SeqID_105728
atgtggaaagggtcagtgttgaaaaagttgttgacggtgaagctcaagtccccttttcgacttcagaaatctagtatgtcaggcaggcccttcacacattcattgcatggccaacaaatcttgtcaaaattgtatcacatgaggaccctgtatgacatttacaagaagcctgttgagttattgtgggatgggaagaaatttggtcttccaaatacaaatgcatccttcttcttaacatattctgatgtaaatgaaataatattaggtgacaaatgtctgaacatagctatactacaattatggatgatttcaagcttaggtcatgcttcagtgtatggattccttgagcctcagtccatacacaatgcaaaggataggcgtgctgaatgtcagcattacattgaaacatgggtgaaggaatcccaatga

SEQ ID NO: 14044 - DNA, 788 bp, Glycine max
  Peptide Sequence Number=SeqID_105729
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcttgaaaaagagagaggggacgtgaggagagggaagctaagctgctgtaagaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14045 - DNA, 486 bp, Glycine max
  Peptide Sequence Number=SeqID_105730
atgaccatgattacgccaagctcgaaattaaccctcactaaagggaacaaaagctggttcaacaggattttgattgaaaccccctcatctggaagcatacttttctacactaatgacatatcaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14046 - DNA, 276 bp, Glycine max
  Peptide Sequence Number=SeqID_105731
atgtccaaatcttgtggatttgggatgaccggccctctcgatgagtcgatctcttgctttctcataagggtggacccttgggtacttgtacctatcacctttagaggactacacgtcctcgccaacagagggctgcacgccctcaccatcagaggactacacgtcctcaccatcagagggatgcacgccctcacctccagaggactacacgtcctcgccttgggtactagttaccctcacctccagaggactacacgtcctcgccttgggtactag

SEQ ID NO: 14047 - DNA, 410 bp, Glycine max
  Peptide Sequence Number=SeqID_105732
ggacaccaggatttatagcgttctgccgagttccgtcaaccggctatcaagcttattcgggcaaagctccagtggcgtatctggttctatcagctgtccttcctgttcagctactgacggaattggttatccgcgtaatcggcaaaagctaccgaccggacatcagcgctggcaaggctgcgtcattcgccattcaggtgcgcaactgttcgggaaacgggctgatcggtgcgggcctcttcgctattaatacgccagctggcgaaagggggatgtgctgcaagttgcgattaagttgggaattcgatactccgctcttcggtagggcgcgctgcggcgagacggaaaggcttacgaacggggcggagatttcctggaagatgccaggaagatacttaacagggaagtga

SEQ ID NO: 14048 - DNA, 635 bp, Glycine max
  Peptide Sequence Number=SeqID_105733
atggtgaaagttggaacctcttacgtgccgatcaacgtctcattttcgccaaaagttggcccagggcttcccggtatcaacagggacaccaggatttatttattctgcgagagtgatgttccgtcacagcttttgttcttagtgagggttaattgctccagcttggctatcatgtttctatcagctgttcctcctgttcagctactgaaagggctgcgctttcccattcgaaaccatgtcggtgcgcaactgttaatgacggaacgcgcgggcgatgaggtgttccagtcgaagtgcttctgtggcagaaaaaaaggctgcaccggtgcgtcagcagaatatgtgaatacaggactcactatattcccgcttcccgctctagaactgactcctacctcgggctcaggaattcgatgcggcagcgaggcaggaaatggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgg

SEQ ID NO: 14049 - DNA, 171 bp, Glycine max
  Peptide Sequence Number=SeqID_105734
atggccccgagaaagcttcccgcgaagaggtccaagaaggacaccaccggagatggctacagcgctgcctcgcaagctgacatggacttcgaccgacaccggttccagagtgcagaacatcagcagcattttgagaccatcaagggatggtcattccttagagaaagacag

SEQ ID NO: 14050 - DNA, 471 bp, Glycine max
  Peptide Sequence Number=SeqID_105735
atgcatctggagtttccagatggagacatcatggccttgttcggggagaaggtgaaggatgaggacagggataagtggatcgtgtggttcgacggcgcgtccaacgccttaggccatggggttggggtggctttggtctctcctgacaaccaatttgctaaagttgatgtctcgctaagcgagctctatgcgcttagcgagtttcatccgctaagtgaggcatcaacacgcttagcggataggaggaatctagaagggaatcagtcacgcaggcatgcgctcaatgcatcatcagcttgctcaccgagtcatttgtcaccttccaggcttagcgcgagtttggcgttgagcgaaaattcacttactctcgctaagcgcgagaatggcactaagcgcgatgtaaagatttgtgattttttgagtgattgtgagattcctagaggtggaggagacatccccaatcctttgtaa

SEQ ID NO: 14051 - DNA, 189 bp, Glycine max
  Peptide Sequence Number=SeqID_105736
atgactgtgagctgttgggctaagctcagcagttgggctaagcgcttattcaccgctaagcgcagcttcagagcgcttagcgcaaaggagaatttggcagagcatcagcatcaaagatgcgcgctaagcgtagcaggttacagagtttggatgacgccacttccaaagagggaagataagtcagggtag

SEQ ID NO: 14052 - DNA, 657 bp, Glycine max
  Peptide Sequence Number=SeqID_105737
atgccttttagaggtttaaaaagtgcgagaaaacaagttgtgttttatgcattttttggaaaatgcgatgaactcgctaagcgagcatgctacgctaagcgagttcatcaatactcattgtatatgtcttctaggaaaagaaatagtggcggttcaaggcccaccactcaatatgatacaagaagattccactcttttgaggcttggactagatatactgataatgtcctgggaagacatatattagctgagaggaaagtggaaatatatcatacagagctggatgaatttaaggctgaattggagaggcgtaactttcataagtgcctcaccaatttagctgacagtagcattgacctggcattggtgaaggagttctacgccaacctctacagtcctgaggggccttcaccaaaacaagtcagaatacggggccacttgataaggattgatgtagatagcctcaatgcctttttagaaacacctgtggtgcttgctgagggtgaatctttaccctcttactcaagatactgcaagatgcctactgacatcagggaaattgaggctgctatgtgcatacccggcagagggtttattttaaatgctaaaggtcaccctgggaagatcatcagaaaagatctaaccactcttgcctag

SEQ ID NO: 14053 - DNA, 360 bp, Glycine max
  Peptide Sequence Number=SeqID_105738
atgaattttgcagcgagaaagcctgtagaattcaccccaattccagtgtcctatgctgacttgctcccatatctacttgataattcaatggtagccataaccctagccaaggttcatcaacctccatttctccgagaatacgactcgaacgcaacgtgtgcttgtcacggaaaagccccggggcgttccattgagcattgtagggctctgaatgattttcaagtttatgccatcatgaaatggataaagttgatatctttctccctcatcctctcacaaacgcatgtttgcttattcaaacttcattggaatgtgggtgcaagccattggtctgtttgctcaagcgacctgcgctcctga

SEQ ID NO: 14054 - DNA, 740 bp, Glycine max
  Peptide Sequence Number=SeqID_105739
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaaatttaccctagacatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14055 - DNA, 698 bp, Glycine max
  Peptide Sequence Number=SeqID_105740
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctgactgcttatgtaactcccccaaaccaccaacacctggaaggagttgaaaatgattttaatgaagaagaaaagctgatgtttaatttcaaaactgacgcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 14056 - DNA, 489 bp, Glycine max
  Peptide Sequence Number=SeqID_105741
atgaccatgattacgccaagctcgaaattaaccctcactaaagggaacaaaagctggtaccgggccccccctcgaggtgttggtggtttgggggagttacataagcagtcaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14057 - DNA, 335 bp, Glycine max
  Peptide Sequence Number=SeqID_105742
atgggtgtcaaccaacagcagaagatgcagtttttgttaggactgtggaggattcagattcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 14058 - DNA, 378 bp, Glycine max
  Peptide Sequence Number=SeqID_105743
atgagatcctggttaaggggtcactggatcccgttcgatgccgacgctatcggccaactcctaggatatccgttgcttttggaagagggccaggaatgtgagtatggccagaggaggaaccggtctgacgggttcgatgaggaggccatcgcccagctactatgtataccggggcaggattttgcccggactgctgcagggaggcgagtgcgaatcatgcgcaccaacatgaccaccctgacccagatatggatgacgttgctcctcagctcgcccaggcgagccaggttgcttcctccagaagcaacagccttctggaggaatattctggagggcccaagtgggcctgggttctatttgcacccccatttttactaa

SEQ ID NO: 14059 - DNA, 465 bp, Glycine max
  Peptide Sequence Number=SeqID_105744
atggcgcctaccaggcaccctctggacccggataagtccaacagggccttgggatttcccgccttgatcacaggactctgccagtcattcggcgtccccgtcgcacctagcaaggtgattcggccacccatcacccgagcttttattgagaagtattgcacgcagagacaggtccagggtgatgcaccacaggccgcggacgcgccgccacctcatcaggctggtccagccggatcgtttgatacggagcaatatttgcggcatttggttcgccagcagggctttacttcttttccgtgccctactccggaccagttccgggcagaggtcgcatggcctggagattggcctgaggcccaggcgggagaggcaccagcagaggctcccgacgaggcagatgaggcccacgaggacgaggagatgaccgatttacttgatttcttaggaggaagcggggccacatga

SEQ ID NO: 14060 - DNA, 794 bp, Glycine max
  Peptide Sequence Number=SeqID_105745
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcttgttctgtgttctgcgtgcgaccgtcgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14061 - DNA, 726 bp, Glycine max
  Peptide Sequence Number=SeqID_105746
atgcctcaccttgagggctcacacgccctcaccttcagaggactacaatcctcccacttcagaggactccatacgtcgtctccttcagagcgcatgcacccttcgccttcagaggacaacacgtcctctttcttcagagggctacactgtcctccattcagagaactacacgccctcgccttcagagagactacacgtcctcaccttcagaggattacacgtcctaaccttcagagggctgacactaccctcgctttcagaggactacatgtcctaaactttagagggctacacggtctcaccttcagaggactacacatccccactttcagaggactacacgtccccactttcagaggtctacacgtcctcattttcagaggactacacgtcctcgccttcagaggactacatgacctcaccttcagagggctacacgccctcaccttcaacagactacacatcctccccttcagaggactatacgtcgtctccttcagaaagccgcatgccctcgccttcagagggctacatgtcctcggcttgagagggctacacgccctcgccttcagaggactacacgtcctccctttcagaggactacacgtcctccctttcagaggactagacgtcctatccttcagaggactacacgtcctcacctttagaggactacacctcgtccctttcagaggactacaggtcctctccttcagagggctacac

SEQ ID NO: 14062 - DNA, 484 bp, Glycine max
  Peptide Sequence Number=SeqID_105747
gcaggaacaggagagcgcacgaggagccgccagggggaaacgctggtatctttatagtcctgtcgggtttcgccaccactgatttgagcgtcagatttcgtgatgcttgtcaggggggcggagcctatggaaaaactggcgtcgttgccggggagttgtgggccaaagcggccgccaccgcggtggagctccaattcgcgcctatacacatccgccctttagcgccagctggcgtaatagcgcaaaggcccgcaccgatcgcccttcgcgcaacagttggccgcagcctgaatgcagcgaatggcagacagcgttccgactggaaagcggcgcagttagagcgcaaggcaagggaggaacagctgatagaaaccagatacgccactggagcactcgaaaaaccctcatacactagaatcagtaagctggtggcacatcacccgaggtcgcacggtattgcgccaataagcctgattgattcgga

SEQ ID NO: 14063 - DNA, 845 bp, Glycine max
  Peptide Sequence Number=SeqID_105748
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagaatccaaaagcaaacccagaaaatgtagctgctatcatattgggtggaggggctggaactcgactctttcctcttactagcacaagagctaagcaagcgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14064 - DNA, 222 bp, Glycine max
  Peptide Sequence Number=SeqID_105749
atgccgaaaaaccaaaaagatattgatgcacaatcccgtccacttgggccctctggaatattcctccagaaggcggttgcttttggaggaagcaaccctgctcgcctggccgaggcgcttccgaaacgtttccgtaacgttttccgtgaggaatttcgcaaagatttcaaccgttcttcgacgttcttcattcgttcttcatcgttcttcgatcttcaacgg

SEQ ID NO: 14065 - DNA, 198 bp, Glycine max
  Peptide Sequence Number=SeqID_105750
atgccaaaaccatgggcgactatgcgtcattgttgcaatcttgtgcatggaatgcccttcattgcagcaagagttaatcaaataccatcattttcgttggttacgagatggagtggtagtggattaggctttactggtacaccacatggagatgtcatcgattatagaatgaggttagaccacgtgacaattgaacaa

SEQ ID NO: 14066 - DNA, 261 bp, Glycine max
  Peptide Sequence Number=SeqID_105751
atggcaagcagaaacgaaaacgtccatgtcgtagtctactacgacgcctatgtagctgactgtgacaatgtcgcagagtttatgggtggaaacaatatacttgtttcaatgaggagaggcatgaccttcaatgccttgaaaacaaaaatccaactcatttatcgatacctcatttctgttgggtttgacatattcaattaccaggttgttaccatcaatgacgatggggatattgatggcatgtttgatgtctataactga

SEQ ID NO: 14067 - DNA, 471 bp, Glycine max
  Peptide Sequence Number=SeqID_105752
tgttggatctacgagcttttccctactattgctttgtgtgtttctgatgaggattatcatgagaggaaaccaagtgtttgtcaatggaagtttgggaaggcattaccggtgttgatgtatcagagggttgtacgacagcttggttatgcgcagcccattcctccacaccctattgccccatctttatctatagaggagattgataatagatggatgcagttctctgaataccttgcactggtaggtcagatttgtgttgctcctggacagtgtgcagcagactacatggagtggttttacatgatatctcaccccttcataagtccaacacggcctggggatcctcatagacatccacctgtggtgcacgatgatacatttattgaaccagatcctcctcatcagcttgttgccgcagcggctatgctagaaccacctgaaccttcacctgctgatgtagacatgccttga

SEQ ID NO: 14068 - DNA, 435 bp, Glycine max
  Peptide Sequence Number=SeqID_105753
atgtctcaaattaaaaaacaaaacgaacatgcatttattgggggtaatcaaaatagaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14069 - DNA, 720 bp, Glycine max
  Peptide Sequence Number=SeqID_105754
atggtgaaagttggaacctcttacgtgccgatcaacgtctcattttcgccaaaagttggcccagggcttcccgctgttctcctgttcagtctgagaattggttatcgcgtaattcggcaacaagcaccgccggacatcagcgggcaagcgcgtccgctttcgccattcgggaacctgtcgtgccaactgcttaagaggcaacccgggcgatcgagtgcgggtcttcgcgtattacgccagcggcgcaaagggcggatgtgtgcatacggcgttactatgttggcctgtgcagggtgttcccagtcgaagtgcgttcatgtggaaaaagcgcacgtgctcagtcgaatatgtgatacgactcatataggccgcttgcttgactcgctaccgctcggtgtcatgcggcacggaagcttagaactagtggggattcccccggaagctgcaggaattcgatcaatactgctcctaattcaacaagccttgagagggccgcggcacaagccgtttttcataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtag

SEQ ID NO: 14070 - DNA, 468 bp, Glycine max
  Peptide Sequence Number=SeqID_105755
atgcccaagtggttatctgcacgaacgatttctgttaaccctgacccgggaagtcaggtggcaggcgggggtaccgtatggttatccgcacctttcatcaaccagggggcaaacgagccagttgacgcacagagactaacgtcgtcttctgcaccttttgtcatccagggacaacgagtcatgtggcaggcggagataccttatggtcgtctgcaccttttatcaatcgaggcgaatgagttcgacggtatcaggatgatgttgtttttactctcgtcgtccggagacattcaagcccggcgacgcacgagattcttctttgctgggcgggggcgatcaagttcaatagcgtggggaaatgtcgtggttatcccactttatcactttactctcgtcgtccgaggaccattgtttggtggcattcaaccttcgcttgaccgcctcaaggtacttaacacccatcgttag

SEQ ID NO: 14071 - DNA, 419 bp, Glycine max
  Peptide Sequence Number=SeqID_105756
gctactacttcaccttcctctagtaaaagtgaagaagcaaaaggggaagaatctagtgaagagatctacccccaagaggaaggacaacctttaatggttaaggaggagtgtaaggagacacttgttagcattgccacaccttttaggcttgagtttattcctcaagtaaaggagttgttggatgagggggttcccatgaaccctaagagaataaaggtcattcctgagtggcccgctccaccaacaccactcattgagttggtgaggtaccatgttccttcatgggaagatgcccaggaaatgagttttcagaccttaccttacttcaacatacaaaacaccactaatacatatgtttttgttctttttacaggtgttgaggaaaaaagcccagagtttcaagaacctcgggatttgag

SEQ ID NO: 14072 - DNA, 519 bp, Glycine max
  Peptide Sequence Number=SeqID_105757
atgagtgaaatagaggaggtgcaagagcagatgaaggccgacatggaggccatgaaagaacagatgaccacaatgatggaagccatgatgagtatgagaaaaatgatggaggtcaacacgactatagtcatttccgcaaacactgccactgaggtggacccgactcacccatttggcctcaatcaagtaaatcgtccagtttcgaatatggtaggtcaaggaggcgaagcattgggaagtataaatggcccccattttgtgcaggtccagagtaagcattccttcccaccatatggcttgcctcccaactatacaccgcccaatgttgcacacgctccagatgagaatgtcgataactctactcccatacccattgagagccaacatccccaatctggtcatgcacaggtccctcaacccataggggagacacatgaagtacgtcgggaccacactttagttgacttcgaacctcacctcagatatgccactgaggggcaagcatttggtggattttga

SEQ ID NO: 14073 - DNA, 760 bp, Glycine max
  Peptide Sequence Number=SeqID_105758
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtctaccagggtgtccgtgggctgctgtctcaccggtggcttcgtagtctcggagagcagaacccggcagcttcaggggcagcctggggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14074 - DNA, 606 bp, Glycine max
  Peptide Sequence Number=SeqID_105759
atgattttgctttttgagaggataagactttttgttctgaaaaactctaagcaaattcgtgttccaagcatcaaaacatcacgatcatatggcatcatcaaaacatcaaaggcaaagtctttgcttctacagacgctaaagatttcaagtggggaagaagctgatgtccctgaggagagcgaagaagtgcaagccttgaaagcagaatttgaaagaacgcgagtggttaaggaaaagttcaagataaaagccaccaaggttaggaaagagtatgatgagctgagggatgtcaacatggccactgccgaagctttggagcgagaaactaagagagcccgaaaagaagacaacaacgaactcaagctgcgaagggccgaaagggacgagtcaagagtgaaaagtatgatattagaggacgagttgaaggcttgtcaaaggtcaaagaggagcttgaccgaacagctgagtaggacagaagagaatatgtggacaatcattgatcactataaagtgaagctaaacctagcagctggccttgagcaaaagctaaaggacgagcatgcaaaagtatcggctctgcaagtggaaagggaagcaagaaagaga

SEQ ID NO: 14075 - DNA, 262 bp, Glycine max
  Peptide Sequence Number=SeqID_105760
aataggcctaactcacaagaagatccccagtggagtcaccaactgttgcaacatgcccttttgcgggcgagcgaggcgaggctcacaggtgcactttccaaagaaggaaagatgcgcggagtcgccaccaatgaaggtattagcacctctcacgtcgacaaaagcggggcttttgctcctacgtaccctccatcgaagaggaaatcagacctacgtagttctttctttaagcgtgaatcaagcgattctttttacttgaaag

SEQ ID NO: 14076 - DNA, 875 bp, Glycine max
  Peptide Sequence Number=SeqID_105761
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcatctttccaaagagtaaatctatctttatctgtattgaagctgatgcgccaagttgcttcttcaccctttgattcaagcgctacttttgcaattgctgaaaaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14077 - DNA, 267 bp, Glycine max
  Peptide Sequence Number=SeqID_105762
atgtctctcattttgataagtaaagaggggcaactgtcagaccctaattttgtctggggactaccattcatggatgttttgattctcgctagccgaaatgagttgttcgacactagttatcgcgcgagacgaaagatcattcgacgttttggtcaaggatgtggaaaatacccaaagggaggggcaaaagggtcattccaggcaattttctggaccttggctcgcccaggccagcctttagctctcctgggtccccaaatggcttag

SEQ ID NO: 14078 - DNA, 1137 bp, Glycine max
  Peptide Sequence Number=SeqID_105763
atggcagaaccatcgaagaagagaaagggatcatcctccaccgccgctgctactgcccatcgccgccacggaccatccaaagcacccacaacacctattcatccttctttgacatctccaagatcatcaacattgttttcatccgatgatcagcgtctacggtacctttctcagttttcttctagaataatcttagaccctaagtacctagacatagaattctttaatgatgaaacgtttgattgctatcaagtgtttcaaaattctggtcttgttgatttcatgtcattaaaattgccatattatcctgaacttgtaaaggtcttctactgcaatttaaaaattcaggatggcattattatttctgaggtgcatggtatttctatggtcattgatcagtcactattcttttctttgactcatttacccagtcaaggtgcaccttttgagggcaccattgttgatgactggaaattcgattattcgagtcatgatgctcgtcgcatggtctgcaatgatcaagctgaaatgaccggtagattgctggccgggtcattaatatttgataatcgcatcatgcactatatcattgttaggattttgcttcctcggtcttcaaatttagcacaagcctctgaggaggatttgatttttatgtgggcttttcttaccggtcgtcagatcgactgggcccattttgttcggtaccgaatgcataaggcattacgggccaatgcacctctcccttatccacatttgattactctgtttctgcgtcattttcaaattccgcttgatgatgaaccatttgttcaagtcaagcattcctttgcaattggtgctggggcagtaacttcctttgggtaccgtaaagatcggaatgatcaatggctgaagaaggatgcgctccttcctcaagatgaacgtactccttcacctcctcctcagcgcgatgtttcagcactcatgaatgaagtcctctccgaattacggggtcttcgttcttatgttggtgaccgtttcgactcattagatacacgctttgccagcatggacattcgcctcacacagcttgaagaggatgtaggttacattcgtcagagtttcgatcttccaccaccacctccaccttcttag

SEQ ID NO: 14079 - DNA, 348 bp, Glycine max
  Peptide Sequence Number=SeqID_105764
atgggtgaagtagaggaggtgcaagagcagatggaggccgacatggaggccatgaaagagcaaatggccacaatgatggaggccatgatgagcgtggagaagataatggaagccaatgcggttgtagttgccgccaccagggctgttgctaaggcaaagatttgggaagtacggacggcccccatgatgtacaaaattcaaaacgagcacgccttcccgccatatggcttgcctctcaactatacgccacccaatgtggcgtacactcccaataagaatgtcaataactccactcctatacccattgagagccaacaaccccaaactgatcatgcacatgtctcttaa

SEQ ID NO: 14080 - DNA, 618 bp, Glycine max
  Peptide Sequence Number=SeqID_105765
atgatgacactcgctcagacatggagtgtcctctcttactatgatcttgcgcccacttctcacacatctgatgttaatcttgacagggcacgcttgatctacggcttgggggtgatttctgataccctaatctttgagtcactcatccctgcgatcaacttggcttatgtgaagaagaactgttggaaccccgtcgatccattgatcacctttccagggactcgccgcacacgcaccagagcctcggcatcggcatcagaggcccctcttcctacccagcctccgtctcagccttcttctcagagaccgcgacctccacctgcttccacctcagcatccatggacatgcatggtcagatgctgaggttcattcacgtcggacaacatctcatcatggagaacatgcacatgctgtccttacacctgcaaatggacccctcgctcatcactccagaggcttatcgtcagcaggttgcctggccaggagaccagccctccactaacaggggggaagagccttctggagccgctgaggatcctgcagtcgatgaagacctcattgctgacttagccagcgctgactggggcccatgggcagacttgggcggaggcagttga

SEQ ID NO: 14081 - DNA, 67 bp, Glycine max
  Peptide Sequence Number=SeqID_105766
gaagaagaagaaggaaagaaagctcctgatcaaggatcgaaagaaaccagaagaaatgtgcagagag

SEQ ID NO: 14082 - DNA, 49 bp, Glycine max
  Peptide Sequence Number=SeqID_105767
atggataagatatcccgacacagtgcccgtgttgataccaccaagaacg

SEQ ID NO: 14083 - DNA, 135 bp, Glycine max
  Peptide Sequence Number=SeqID_105768
atgccattcattacacattttcaagcaagcaacaccagtgcatggacttctgttcgacaaggcttagtgatgatgggtcacaaacttctcgtcgtgggtgaagagtgggtgaagagtggaaagggatgctggtaa

SEQ ID NO: 14084 - DNA, 327 bp, Glycine max
  Peptide Sequence Number=SeqID_105769
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcgaggagtgttgcgctcagcggatggttcgctaa

SEQ ID NO: 14085 - DNA, 759 bp, Glycine max
  Peptide Sequence Number=SeqID_105770
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacgacaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14086 - DNA, 705 bp, Glycine max
  Peptide Sequence Number=SeqID_105771
atgacaccggtaaaccgaaaggcaggaacaggagagcgcacgagggagccgccagggggaaacgcctggtatcttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacataaggttagacagaaagtcttcaaagcggggagagacatttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14087 - DNA, 513 bp, Glycine max
  Peptide Sequence Number=SeqID_105772
gcgcttgggcttggccggcaggccgatgccgtggccgccgtgttcaaggcatgggcggggcaccccgacgcgccgttggaaaacgcggccgacttcgccgcgctgttcctgctggaggggcgggcggcgcccattccctacgcctcgcattacctggaggaaggtgggcagctgtacggcgagccggcgcggctgatgcgcgcgttcctggagtccagccagttgcggctggacgcgcagttcaaggagcccgaagaccacattgccgtcatcctggcggcgctggcgcgctggagccgggagggcgggcgggcgaatgacgtcgccgcctgcgcgggggagcaggcggcctatctggacgccgcgctgatgccctgggtcgcgcactggcaggccctggtggacggcgtggacaccctggccttccgcttctatccggcggtcgcggggctgctggtcgcgtttcttcacctggatcgggactacctgcggtctttcgaggcaggggggtaa

SEQ ID NO: 14088 - DNA, 1086 bp, Glycine max
  Peptide Sequence Number=SeqID_105773
atggccctgcgccgtggcgacgccgcccaggcgctggaatactggcaacgcctgcaggcgctgctgccgccggactccgaagccgcgcgccagatcgaatccaatatcgcgcaggcgcgcgcggtcgcatcggcaagcggcgcgccgcctgcgacgccaggccggatgcccggccagatgccagcccaaacccaggcagcggcaatggcagccgcgcagtcctcgcctcctcaaacgtccgccgtcaagccgcccgcgagcctggccgccgccccgggcagcgtcagcggccaggcgcgcatcgcgcccgccttgatggcccaggtgcaagcgaccgacaccgtcttcatcctggcgcgccccgcctcggggtcgcgcatgccactggccgtgttgcggctgcgcgccgccgatctgccgcgcgccttcacgctcgacgacagcaatgccatgtcgccgcaggcgctgctgtccagcgccggccgcgtgcgcgtcgagatccgcgtcagccgctcgggcacggcgatgccgcagcccggcgacctgggcggcacgccggtggcaaccgacgtgcctggccggcgggctggaactggtggccgacaccgtgctgcgctagcgcgccggggccgctcgccgccgccagcggcggcgtcgtcccggcatcaccgcgcggcctcaggcccgctcgatgcgcgccggcaacccttgccgcaccgccgcgcccgagacccagtcgatccagacgttggcatgatcgccgcgcgtcgcgtcgccgaagcccaggtcgttcaggttcacgcccgccgccagcgccggatcgtgcggcatcggcttgccatcgaccaggtgggcgcgcgcgcccagttcggtgtggccatagccgtgctcgatgccgaccgcgcccggctggatgccgtcgcgcagcagcgccaggccggtcaccgcgccgcccggcgtgacgatgcgcacccgatcgccgttgcgcaggcccagccgctcgccgtcctgccgattgatcgacaccggattgtgcggatgcacctggcgcagccggtccacgccgatcgacatcgaactcatcag

SEQ ID NO: 14089 - DNA, 755 bp, Glycine max
  Peptide Sequence Number=SeqID_105774
tggcgtctcctctctctctccctttctccattccgctgccattcatcttccaagaagcaaaggaatccattgatgaagaagatcctaggcctacaagctccaatggagcttgcatcacaatcaaggagattgggtccccaatcgacgctttccttgcatactaccatggcaaggaaagtccggtggtagctgttctggcagatttatttgacacatttgaccgaaggcatccatgtccgctcctgaaccatcgctcgtgtactgaaaagaggagaatagattgggaccagcttttggccgagataggaaggggttgtattaactacaatctcgcgctcgctataagacaactagggtaccccatgaggggagcaccgacggaagaaagcatgtctcctttccttgtgagggatttcggcgcacaaaattccaagactatacaaagaatccataaggcatgggaaaccccgttaaggaaagatcaagaacttagaggcattcgtaatggcatcattggtggctaccatgaatggttgaaagttcatatacgaggtttagattggctcgccaagttaaaagtcgtcagcgaagagagttttgaagcaccggaagaggacgaagaagtccaagctctcaaaagtgagttaggaaaggcgaaacttgccaaagagaagttcaagttggccgctacacacatccggaaggagtatgcccggattacgggaagagaatgcaattaccaccagagcccttga

SEQ ID NO: 14090 - DNA, 420 bp, Glycine max
  Peptide Sequence Number=SeqID_105775
atgcatgctttgttagggtcattcaacagtggaaactggtctgactctaaagtccttgatagtgcagggctgagttgtcatgctttcacgaggaatcgggagtgttcgatactcggttcttaccgttttatactgcttgtgcgatccagtgcacttgccggaagccgaacactcgctaagccaattctgcataaaaaattggatctgtgttcactcgctaagcgcgtggctatcatggctccccgtaagagaaaagccatagctacattgtcccaagccagttatgactcatccagatttgtatcaagggatgcctgggaccgttacgcagataacatcctcggccagaacattcttcaggagaggaatgtgaagctatacattaatgagtttgatgacttcagaagagaagtcgagtag

SEQ ID NO: 14091 - DNA, 462 bp, Glycine max
  Peptide Sequence Number=SeqID_105776
atggcatccgattgtttagccaccatcagattcactgcaccatttcgtgttcaaaagaatcttctgcaagtcccattctcttttcataggcaatggctgtacagatacccaaagtatgttttattccactatgatggcaataaaaatttcattcgagtgaggaagcacggtggcaaatatttttttgctgatggcttaaaggaattcagaagggcacacgatctaaatgagaatgtcattctgcattgtgttgtttctgacaaaaatactactttctcggttcatgtcatcggacctacacagaggcaattgtgtgtaaagcctcttatatcaaaaaggagatatatttttacaactgatgtcacaaagagttttgatgataacaaagatgatgacaaaaagctcaaaagtcaagaacacttcatgataacaaagatgatgatctcaagaatcaaagaatga

SEQ ID NO: 14092 - DNA, 474 bp, Glycine max
  Peptide Sequence Number=SeqID_105777
atgttttccaagaaggagggaatgatgagaatcatgaaactggacaaatacaggctaaaggcccaagtggagaaggacgaaggcctaagtggagaaggacaaagcccccgagtggagaaggatgaaggcccaagtaatccttgtggcgtctaccctgacttatcttccttcaccggaagtggcgtctaccctgacttatcttccttcaccgaaagtggcgtcatccaaaaaccctacagcctgtatcaaacgatccgccccagtgtgaacaagctagggatgctgtgggccgttggtgctttggattgggtcctggtgaccacatcctggctcatctgtgtttggctatcaagttcgggttacaattttgctgggactgtggacctcgctaatattctgaacgagtggagggatgaggattatcgcctgcaccaggatagagagttagagacaacctctaggatgctagaatga

SEQ ID NO: 14093 - DNA, 402 bp, Glycine max
  Peptide Sequence Number=SeqID_105778
atggctcacaaattctattttgaagcacttgatcgaagtctaagagatgttattaaggcgaaatcaagttctgataaaatctttggtggcaaagttatcctatttggtggagatttccagcagattctgccagtcattcctaggggtagccgctctgatattgttaattcaactattaattcatcttatctatggaatcattgccatgttttgacactgtcgaagaacatgcgtttagaagccaatacagatgcaacagacaaagaagaaactgcagcttttgcgaaatggatccttattattggtgatggaactgctggccagccaaatgatggctatggttcaattgaaattccaaaagatcttttaatcacagaatatgatgacccgctctatgcaata

SEQ ID NO: 14094 - DNA, 498 bp, Glycine max
  Peptide Sequence Number=SeqID_105779
atggcatcaaagaagagaaaggcacctgccacaccttcccaggcctgggaaaggtacactaacattgttgtacctaggaagctgcttcctgagcggaatgtggtaatctaccacattgagtttggtgagttcaaggaagaattggagagaagaaaatgggatgaggaactgaccaattttgatgagggaaacattgatgttgccattgtgaaagagttttatgctaacctctatgacccgaaagataggtcacctaagcaggtgcgggtcagaggtcacttgattaagtttgatgaggacacgctgaatacattcttgaagactcctgtaatcatcaaggagggggagacattactagcttactctagatttgttctctcgaggcttgatcctcaagagttagctgctaagctctacatcccagggaggggatttgagcttaatgctaatggtcagcctctaaagatcctcaggaagaacatgaccacactcgcttag

SEQ ID NO: 14095 - DNA, 709 bp, Glycine max
  Peptide Sequence Number=SeqID_105780
gagagcaggttcatcaactggaactgggcttccggttgttcttcggccagtagtagatcagcgtatcgcagtcggcgatatcgttctgctctgccaccaggctaaagcgcgcgcgctcgcccatctggcggctcagcacctgccagtgatggtaatattgggtatgggcacggctttcagcacagtcgaaacgcgcaggcaggtcatcctgcatatctccggcaaacagaatacggctttcttcgaaatcatcactgtgacgcagcaagacttcacttgccggggagttttccctatgacatcccgacgagactggcagttgcagcagctgggcatcacccagtgggctttgcgtcgcccgacggcgttgcagggcgaaatcgccatctccatcccggcgcacgttcgcctggtgatggtggcggaagaactgcctgccctgaatgaacccctgatcggtgatgtccttcgcagcctgaagctgacggccgaccaggttttacagctgacgccagagcgggtcgctatgctgcctcctgacagccgctgtaacagctggcgtattggagaggcaaatgcgatcccgctccagggaagccagatctgcacgccagcgctggacgaactgaaagccaacccaaaagcgcgaagcgcgctatggcaacaaatctgcgaatatgaacacgatttcttccctcacgacgcctga

SEQ ID NO: 14096 - DNA, 131 bp, Glycine max
  Peptide Sequence Number=SeqID_105781
atgaagctgctgaccctccttattcaccacctgaagaaacagctaactcccctgcttccccagttggaggaattgctgacctttctgattcgtcatctggagaggttgttgctctcactgaatacgactaa

SEQ ID NO: 14097 - DNA, 69 bp, Glycine max
  Peptide Sequence Number=SeqID_105782
atggctggacttggtggagtgcccaaaggttcaagatcaacaaatggaaaccttgagatggacttgatg

SEQ ID NO: 14098 - DNA, 654 bp, Glycine max
  misc_feature (612)..(612): n is a, c, g, or t
  Peptide Sequence Number=SeqID_105783
atgggaattttacggaagcattacgggtgtcccggaagccccggaatcccatttttcaacaaaacgggggctttcgaagaagttacgaaaactcacggattgcgaaaaacacctcctttcgatttccgtcagattacggaattttcacggatcgcgggcattgcacaggccgaaaggcatcctcctataggcaaaagtgccgaaggggcaggtgaatgtggtcttttcctgatcctcaggagcaatagtgatttgcatataaccagaaaaaccatcaaggaaacagtagtgagatttacctgccaggcgttcaagcatctagtcaatgaatggcaagggaaaatggtcctttttggtaacctggttcagcctcctatagtcgatgcagactctccaactgttctgcacccgagtaggaatcaactcctccttctcatttttgatcacgatgaggccgattttcttcggaactacctggacgggactcacccattggctgtcggagataggataaatgattccagcttgcaaaagcttggttacctccttcttcactacatcaggaatcaccgggttgagtcttctttgtggctgtcttactggattgtccgncagggtccagcttatagccttcttatgcttcttgagaactga

SEQ ID NO: 14099 - DNA, 231 bp, Glycine max
  Peptide Sequence Number=SeqID_105784
cgtttcatttctaaacgaccatttagagaaaacactgggtgtcacaacctacccttcggcgggagggcgacgcgagggctcacaggtgcgtcttccaagggaggaaggcgcacggagtcaccaccaacgtttattcaaggaaaacgtcagaaaaaccggaaaaggtttggtctacgaacttttaagtgtgaaaggttcaggagttgtatttatgcacagggaaggtattag

SEQ ID NO: 14100 - DNA, 323 bp, Glycine max
  Peptide Sequence Number=SeqID_105785
cggatgccgggagcagacaagcccgtcagggcgcgtcagcggttgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtccattggagatgagagcctttgcaaggaagtatttgaggagtacattgcacaactaaaagaagaggcaaaagagagcgagcggaaacgaaaagaggaaagg

SEQ ID NO: 14101 - DNA, 204 bp, Glycine max
  Peptide Sequence Number=SeqID_105786
atgaagaggaatgaagatggacgaaaatggaagtttggagaaacaaagacacaaagaaaacagaatatgaaggaagatgaatggagaggaacgaaaaaggaagatggagaaacacagaaacaaagaaaacgaacatcttcagtgtcttcttccaccttctctgcatacaatagcaattcattaaaaacaatgaacaggcagtga

SEQ ID NO: 14102 - DNA, 342 bp, Glycine max
  Peptide Sequence Number=SeqID_105787
atggattttggcacagtgactgcagtacaccattgtggtggatacagatctgcagagtcacaaaaagtcgtgagaatcacaaattcaagaatgggaagggtacagcctcatcataaaattggcaaagattccagtgtgtattccgagaaaccaatcacgaaaaacaacactacgctcaattacttcaatcctcaattcaacacgatctccatcactgtggagggattgcgtcattccacagagcacataaacggaagcatagtgaaagtcgaacaaccaattccaaggagagagacttgccaccaaactgaacctccttcccttgaaatttttagcggttaa

SEQ ID NO: 14103 - DNA, 91 bp, Glycine max
  Peptide Sequence Number=SeqID_105788
atggatagagcaccaacagcatgtccattcgatgaagaacacaaaaacggtaccgagctcgaattcgtaatcatggtcatagctgtttcct

SEQ ID NO: 14104 - DNA, 198 bp, Glycine max
  Peptide Sequence Number=SeqID_105789
atgcagaatctgaaaaatgtgagtgtcatcaccttgaggtctggcaagcaaattgaagtgcctctactagtagcagcacctgcacctgaacctgtcaagcttcattctacacctgaaaaagaggatgagatagttgcacgaaagagaaaacatcctgatcatgagggagctaacaaaaattttcatgggtgttcatag

SEQ ID NO: 14105 - DNA, 162 bp, Glycine max
  Peptide Sequence Number=SeqID_105790
atggcatgtcttatgcttcctgtgaaaaaccttagaggaagagactttgtaaacgttatcctttcacgaaatgaattagaggcttgcgtggaatcgacgagcaaggatgaaaaggaatcttcaagtgacgcgatgaggaatccgcagggtagctcacgatag

SEQ ID NO: 14106 - DNA, 801 bp, Glycine max
  Peptide Sequence Number=SeqID_105791
atgaaagggcaaatcgcccgcatgcaccgcgcgctgtcccagttcatgctggatctgcacaccgagcagcacggctacctggaggcctacgtgccttatctggttaaccacgccacgctgtacggtaccggccagctgccgaagttcggcgaagacctgttccatacccgtccgctggaagaagaagccgacagcagcaactacgcgctgatcccaacggcggaagtgccgctgaccaacctggtgcgcgacgagatcgtggaagaggaaactctgccgctgaaaatgaccgcacacacgccatgcttccgcgcggaagccggttcttacggccgcgacacccgcggtttgatccgcatgcaccagttcgacaaggtcgagatggtgcagatcgttcgtccggaagattcgatggatgccctggaagagctgaccggccacgcggaaaaagtgctgcagctgctgaacctgccttaccgcaaggtgctgctgtgcaccggcgacatgggcttcggcgcgtgcaaaacttacgatctggaagtgtggctgccggcgcaggatacctaccgcgagatctcgtcctgctccaacatgtgggacttccaggcgcgtcgcatgcaggcgcgctgccgcagcaaagccgacaagaaaccgcgcctggttcacaccctgaacggctccggcctggcggttggccgtacgctggtggcggtgctggaaaactaccagcaggccgacggccgcattcaggtgcctgaagtgctgcgtccttatatgggcggcctggaatatatcggctaa

SEQ ID NO: 14107 - DNA, 336 bp, Glycine max
  Peptide Sequence Number=SeqID_105792
atgtacgaccacctcaacgatgcttctatcagcaccaaccgacagcttggcggttacatcacgctgctgcaggtggattgctacgaagaagaccgtaaagagcatacgtacaccaacgtacagggagcgcctagaccgactctagattccggatgtctgttggatcccacatggggagcaccgaccggtccaagacttccatatgatttcatgttattccagtctcctgcgcttagggctccttgctgtgtattacctaccagagagggtcatgcggcagtttggatacacccagaccattctagctctgcctgtcgattcatgggtgtcgtatga

SEQ ID NO: 14108 - DNA, 447 bp, Glycine max
  Peptide Sequence Number=SeqID_105793
gaggaaggcccaaatgttaaaaccaacccgctagctagtcatggaggggctagcgtgaacgccgtcaaagaggatgggccatcgcgggcaaagagattaagagaggtggctacttctagacgcttcatctatcaatcactgcaagcggcgtgcatggtctcccgtggtggagacgaaagggatgaatgtttgtttcacctcggggagttgcatgacatggaaacctgtcccgtggtggaagaattgcttcagtggctcatggattgcgggcagcttgaagtgtccataggagggaaggaagaaccacaaatttgcatgcagtcagaagagaagaaggttcctctaacccccaaggccctagtgatatgttttactaggaaagggaccggctccacacccatatacccccggacgacacccaagccaaagagttgcaaccgaagttga

SEQ ID NO: 14109 - DNA, 753 bp, Glycine max
  Peptide Sequence Number=SeqID_105794
atgaccgaaaaaggagatgaagatgcacaaagaataaaggggacccctaagggcaaggactttgagccctctaaaggcgaggactttgagtcctctgaaggcaaggaatttgagtcctcaaaggcgaggactttacgtcctataaaggcaaggactttgagccctctgaaggcgagaactttgagtcctcagatggcgaggactttcagccctctaaaggcgaggactttgagtcctctgaaggactttgagtcatatgaaggcgaggactttgagtcctgtgaaggcgagaactttgagtcctctaatggtgaggactttaagccctctaaaggcgaggactttgagccctgtaaaggcgagaactttgagtcctttgatggagaggactttgagtcctctgaaggtgacaactttgagtcctctaatggcgagggatttaagccctctaaaggtgaggactttgagccctttgaaggcatgaaatttgagtcctctgatggcgaggactttgagccctctaaaggcgaggactttgagtcctctgaaggcaaggaatttaagtcctctaaggcgaggactttgcgtcctatgaaggcgaggactttgagccctctgaaggtgagaactttgagtcctcaaatggcgaggactttgagccctctaaaggcgaggactttgagtcctctgaaggtgagaactttgagtcctttgatggtgagaactttgagtcctctaaggcaaggactttga

SEQ ID NO: 14110 - DNA, 366 bp, Glycine max
  Peptide Sequence Number=SeqID_105795
atggcgaggacttttgagccctctaaaggcgagaactttgagtcctctgatggcgaggactttgagtcctctaaggcaaggactttgagtcctattaaggcgaggactttgagtcctctgaaggcgagaactttgagtcctctaatggcgaggactttgcctcctatgaaggcgaggattttgagcccttcgaaggactttgagccctctaaaggcgaggactttgagtcctctaaaggtgaaaactttgagtcctctgatggcgagaactttgagtcctatgaaggcgaggactttgagccctatgaggactttcagtcctatgaaagaataaaggtgaggactttgagtcctatgaaagaatag

SEQ ID NO: 14111 - DNA, 261 bp, Glycine max
  Peptide Sequence Number=SeqID_105796
atggagccacatatccctcaggtcccagagccaccagcagcagcactgacacacgcatgttctcatgtggaccagcctagacatgtagtggatgcttgccatgcgatcattgaaaggttggagcgtctgatcaaccttaggatagtcacggcaggcacagagacacacgaggtcatggaagaatgcatcaggaatgccaggggtgtcacagaagatggtaatgtgtatgtgaggtctcgacgtagacagcgcacggattag

SEQ ID NO: 14112 - DNA, 498 bp, Glycine max
  Peptide Sequence Number=SeqID_105797
atgacattgaccatcccagagcttttctcgaggccttaccaggttacatgggatgccaccgtgttcggggtctttaatccagacttgttgctctacataaagcaagaagacctctccgaaatctcacacggtggtcaatgtctcagcatattagtgttacagttgtggatttttatgcgagcggggaatttcgatatctatggcttcctcgagccacagtccattcagagttctgggcaatcgcagtttgagactgaaagttacataaagagttggatgcatagttcaaaacgcgatgtctaccttggagcctacctgaatggtggacactggcagatggtggtcattgtgcccaaggaacacctagttgtttggttttgttcattgcacaataggccagacaactaccttaaagggataattaacagtgctttaaaaggtcttgatgatgcttcacagcctaaatcaaaggctcctgctaggtggattatcgtcaag

SEQ ID NO: 14113 - DNA, 471 bp, Glycine max
  Peptide Sequence Number=SeqID_105798
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagggatcctctagagtcgacctgcaggcatgcaagcttggcactggccgtcgtttacaacgtcgtgaactgggaaaaccctggcgttacccaacttaatcgccttgcagcacatccccctttcgcagctggcgtaatagcgaagaggcccgcaccgatcgcccttcccaacagttgcgcagcctga

SEQ ID NO: 14114 - DNA, 195 bp, Glycine max
  Peptide Sequence Number=SeqID_105799
atggagaaagaaatttctgggcaacatgaaagaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14115 - DNA, 261 bp, Glycine max
  Peptide Sequence Number=SeqID_105800
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggtggagtcgccaactgtcgcaacccacccttcggcaggagggcgacgcgagactctcgagtgcgtcttccaagaaaggaaaatgcgcggagtcgccaccaacgtttatttga

SEQ ID NO: 14116 - DNA, 265 bp, Glycine max
  Peptide Sequence Number=SeqID_105801
aggatcccctcaatggctgaagaaagacgcactccctcttcaagatgagcgtactccttcacctcctcctcagcgtgaagattcagcactcctgaatgaagtccttaccgaattacgaggtcttcgttcttatgttggtgaacgtttcgactcattggatacacgctttgccggcatggatattcgcctcacacaagttgaaaaagatgtctccttcatccgtacttgctttgatccaccaccaccgcctccatcatcctcttag

SEQ ID NO: 14117 - DNA, 348 bp, Glycine max
  Peptide Sequence Number=SeqID_105802
atgaccatgattacgaattcgagctcggtacccagggtacaaagagagggagtgcagagggaaatggtggtgggtgttgttgttgagatagaaattttgccatgtttggggaataatgttcttgttcttgctctgactcatgctggtttctccattgcttcaactgcaaatcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14118 - DNA, 171 bp, Glycine max
  Peptide Sequence Number=SeqID_105803
atgagagatcgcttagaggatatgattcgtgatcttggacaagagtcttttcaacaagcacatgcccctatgtatgatacgttgcaaattgatttaaagaagcctttgtattcgaggtgtaacaattccttgacattgttgtcagcggtgttaagtctggttaatgtcaag

SEQ ID NO: 14119 - DNA, 482 bp, Glycine max
  misc_feature (5)..(5): n is a, c, g, or t
  Peptide Sequence Number=SeqID_105804
ggggncggagcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctcgtgcgagatatactgctgctcaggctctttgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14120 - DNA, 216 bp, Glycine max
  Peptide Sequence Number=SeqID_105805
atggatcaagctggcgaggaaaggaagttgcaactgagtgagttagatgaaatccgcctagaagcctacgagaatgccaaatcaaaagcgactccaccaaacaagagcttcaaggtcaacggacatcgacttaagtcattcctcacaaacccttctttagtggacgtagtggtggaagagacttccttactccaccctactcttcctccaccatga

SEQ ID NO: 14121 - DNA, 554 bp, Glycine max
  Peptide Sequence Number=SeqID_105806
atcaggtagacgcgcttttcgccgctgccgctggtgacgaacttgttgcggaacaggaacaggcgcgggcccttgaccgtgttgatcaggcgctcgacctcataggactgcccgcgcttgtagaactcggcgatgttgcggcgcgaggcggcggcctcctcgcgcgtcatgaacatgtcgaacacgctgcgcccgacgatgtcctgctcgcgcttgccggtgtattcctcgctgaccttgttgaagcgctgcacgcgcccgtgctggtcgacgatgacgatgaccgagttggcctcggacaccaccgtctcggcgaacgacaggccttcgaccaggtcgcgcgccaccgagtcggtgtcgctgtgcgacgaggccgtgccggcccattcgttgggattgatcttgcggccgaccagccgcagctgtatcggatcgccgtacaggacgatgtcgatgcgcaggctggcggtgatgccggtcagggcgcggatggcctgcgcctgctcgggcttgagcgccatcgcgatgttggtggcgcccttgaccgcggatag

SEQ ID NO: 14122 - DNA, 240 bp, Glycine max
  Peptide Sequence Number=SeqID_105807
atggtgacaaggttatcgaatgtggtgttggattgcgtgatgttgtacatacacgactccaaggaccgcgacatcgtgtcgcaggtgtgccgtcggttgtacgagcttgactcgctcacacgacaggttaaggcgacggttcctgcacctcgagttgctaaagctgaagggaaagccacaggtagcgatgttcaacctaatactggagggttggggaggtttcatcacaccttgggttag

SEQ ID NO: 14123 - DNA, 678 bp, Glycine max
  Peptide Sequence Number=SeqID_105808
atggcttccctggtcgtggagcaaagggggatcttgccctcttactccaagtttgctagattaaggcttgatcctcaagagcttgcagcccggttgtgtctccctgggagaggatttgtacttaatgtcgagggtctgtcatggaagctcttgaggaaagatcttactactctagcccaaacctggagtgttctatcttattctaacttggccccgacatcccatacttctaatcttaatctggatagggacaagttagtctacgggcttgtaataaagatgaacatgaacttaggatcacttatttttggtcagatttcactcattgctcaatccaactcctcgcggcttggatttccagccctgattactgccttgtgcatggcccgaggagtcacctcagattctcttaccttcgagtcactcggcctagccattcatttggcctatattaagaagaattgttggaaccttgatgaccttttgttcacttttccagggacccagaaatctagggctagaagatctgaggccccatctccttcagctgcccctgctccccctacttcggctccctctacttctgctcttccttcaccaccagcaactccagttcttctaggtccctctgctcagaccttagagcctttgatctctttgttgcaaagcctgcattag

SEQ ID NO: 14124 - DNA, 213 bp, Glycine max
  Peptide Sequence Number=SeqID_105809
atggcacgtagcgtgtccgctccgtgcccctattcaagggacctatatgggagggagctaacaaggcttttagtgataattcccaaggtggtcatatctctcttgaaggtctctagaggtatcatccccttcgaagaacatattgcagcagtagggactactagcaacgatatattttcaaagcggaaaactctagatgggggttcaccgtaa

SEQ ID NO: 14125 - DNA, 378 bp, Glycine max
  Peptide Sequence Number=SeqID_105810
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatcttcttcatcaatggattcctttgcttcttggaagattaatggcagcggaatggaaaaaggaagagcgagaggagacgccacttcaagaagaagatgagtctaaaagaagctcaccaccatag

SEQ ID NO: 14126 - DNA, 792 bp, Glycine max
  Peptide Sequence Number=SeqID_105811
atggatttgggtgtagatctaggcaatgttgatgtcttggttcattttgtgggagtgaaaggtgaaccatgtgaaatccgcaatgtggctcctgacaagtttggtgtttactatgtgatagacgacatcaactcttttgcaaaagatttagataaggatgtggtgtcaatgtttgctaagaatgaaaattgtcgttatattcatttatatgtgataagaaacaaagatgagttttggcatgaacctcgactggttgcacctgttgtcaatgaaactatcaatgagggtataaatgaacatgttcctatagttgaggatgatgtgggtagtaatgaaaattgcccaatgcagattgatgaagcgtgtgtaagtgataaagatgtggcttatgaggggttcagtgaaggatcttcatctgacaatgagtatagtccctttgatgagcatgcagaatcaacaaatggggatgccttaagtgattttgatgaatcagtggatgtcattggagttgcagttgtgcattcaaattcagacatggaagaaatttatgaggagaacagattgcatggaaaacaatttgagttggacaatgatggcaagatctgttttgagattgggcatttgtttttaaatgtaacacattttagggaagtgctgaagggatttggaatacaagaaggatttggatggtgggttaaaaatgaaaaatgtagggtgactattgagtgtaaggatgatgactgcatatggaggatccatgcatctctagttgtagacaaagaaacttattag

SEQ ID NO: 14127 - DNA, 354 bp, Glycine max
  Peptide Sequence Number=SeqID_105812
atggatcagctgaaaaagcctaggactagtggtggtgtgggtttgccttgtcctgattcagttgcaaggtgtttaatttctataagggtgtttgacaaaatgtctcagtcaaggactacttcttctggcaatggtagtggtagtgcgagtgtagtgcgagtgacacatcaaataaagtattctccatgtggagcttgtaggccttggatcttcttcatcaatggagtcctttgcttcttgaagtttgatggcagcggaatggagaaggagaaagatgattggagatgccacttcaaggaaaagatgagtctagaagaagctcaccaccatagaaagccatggataagagcttga

SEQ ID NO: 14128 - DNA, 747 bp, Glycine max
  Peptide Sequence Number=SeqID_105813
gagcttcccggtatcaacagggacaccaggatttattattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcttggaggttgagcatcaaagacttgccaatactaccataaactggcacatcaataaatattttaatctcgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14129 - DNA, 174 bp, Glycine max
  Peptide Sequence Number=SeqID_105814
atgagcgaacatgaaaataaaagacatgagggcccgaaaaatcatctctccttacttgcgcatttgggggcgcagtgccccatgtgtgcagttaagaagacgatatggatcttccgacttccatcgacaaaagacgagacccacatacaacgcatgtgtgacgacatgatgtag

SEQ ID NO: 14130 - DNA, 444 bp, Glycine max
  Peptide Sequence Number=SeqID_105815
atgggagtcgtcctcggagggacttcccgaatgaccgtaccggggaattctaccgtactccgtgcagctattgttgttgatcctgcagagcctacccaaaggttcaggccggattgtaggaagtgggcgatacgtttttgtatttctatgagaagctctacggcacccacgattcccagtagcggcgcaaaggaggctcgagggcttgttaaggaaggcggcaagggccgacgaaggggggaaaacgaaaggcgttttctggtccccccttcgccggggggtgcttgtggggggggtgtgccacgacgaaacaagggaatgaaaggccgctttgcgttgaatgctcttgaccctgcccacaatgatggctctgttgtcttggggagcgttgaagcttgcttcttctccagagttttcttggtcatcaatacgacctgtccttaa

SEQ ID NO: 14131 - DNA, 138 bp, Glycine max
  Peptide Sequence Number=SeqID_105816
atggccaagaaaggggttttcagtccttatcgtgttgaggaaagaatccatgagtttcaagaacctctggatttgaggtcaaatccttttcaagggggagggaatgatgcaatcctaccccccaagggcattggatag

SEQ ID NO: 14132 - DNA, 633 bp, Glycine max
  Peptide Sequence Number=SeqID_105817
atgtcatttttgggagaaacaagcagtcagaccattactaactccagattagctttcatttttccaaatggatcaatcagttacaaccaaactggtgtttattttcaaagtctcattccaacaccaatgcgagttcctaacaactgttcttttgatacactcaagcgtagaatgcacaacacccttcaactaactaacgatcaattactggatgaaatctactaccgaaagccattcatagatgcagaattattatgtaccattattagaacactggatgctatactcaacctgcttcaatcaaccatcgctcctactcatgatgcaattatgtattacgggaagtggaacataccacgtcaaggtgagtttttgggttactcctttactggaactaatccaataagatttggcattccttcgggatgtggcatggagaaactcaaggatctaatcaaacaagttgcacctacaggggttccccctaatggaattcacggatcacaattggttaaacgattattctttcgacaaccaggtcattctaagtattccgaaaatttgattgaacatgacataacagaattgaaaaatgatgaagacgtgctaaaagtgttagcacaatctaaataa

SEQ ID NO: 14133 - DNA, 225 bp, Glycine max
  Peptide Sequence Number=SeqID_105818
atggccgaaagggatgagtcaagggtggaaagcatgggcaagcatgtgaaggtatcggctctacaaatggaaagggaagcaagagagagggtgatagaatcattgcatgggaaagctgtgaaatggatgggtagattcgctctcactctgaatgggagtcaagagcttccaaggttgttagccagagccaaggcaatggtggatgtatactcggctcccgatgaa

SEQ ID NO: 14134 - DNA, 300 bp, Glycine max
  Peptide Sequence Number=SeqID_105819
atgaaagataaatggaatgtgcatgaattgtacagtatcttagttcaggaagaaacgaggcttaagaatcgagaaagtcactcagttcattatgtaagccgccaagggaatcaaggagctagaaaaaaatttgtgaaaaagcatgataaaggcaaagggtcattaaagatcaatgacggtcctgtgcaaatccagaagaaggcatcaaagagcaataattgtcatttctatgggaaatctggacatttccagaaggattgcccaaagcataagtcttggttgaaaagaaagtttatttaa

SEQ ID NO: 14135 - DNA, 389 bp, Glycine max
  Peptide Sequence Number=SeqID_105820
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccagaggattcttgaacacaagggaacggttgtccctgtgtggttcagactttgtaaaaggagttttacaaagagagtggaaaatctcaagtgggtttcttgaggactggac

SEQ ID NO: 14136 - DNA, 201 bp, Glycine max
  Peptide Sequence Number=SeqID_105821
atgttggaagcttttgaagctggtggagatttccattcaaggactgcaatgaatatgtacccacatattcgtgaagcacttgaaaaagaggaagtgcttcttgagtggcatcctcagcctggtgaagataaacccccagttcctcttttgaagctgatgacgtcaaatatagtgaccaccagagtgctggcaggtgcatga

SEQ ID NO: 14137 - DNA, 114 bp, Glycine max
  Peptide Sequence Number=SeqID_105822
atgccaaaatcctttgtgcctttgacatatcttaggattctcttggctgctgcaaaagtgtgctttgcttgggttactcatgaatctagacacaatgctaactgcatttacgat

SEQ ID NO: 14138 - DNA, 501 bp, Glycine max
  Peptide Sequence Number=SeqID_105823
atgagccctgacctgattgctgcgcaccaccagcaaaaactcatcgccgctgcattcccccgtttggtgagcggcgtaagccagaatgtcccgattcaggctggcgttgaccgacgccgaggcggcaggcaaggacatgaaaaccttacaattgccggactttcccaggtagctctcctgccgggcctccgagccgctgaaataggcggtgacagcaatggccatgaggatgccccccaggaccaatgcacagatcatcagccagcagccgcgggaatcaccaaaaaaagaggtggcccggttgatgacggttgcggatggcgggtttatcgccgcttcgggcgcaggctccggcaaagaggcggcgggttctgcatcgtgtctatcttccgcttcctcataagactcgatggtaatctcatcacgcagcataaaacccactttagggacggtgacaataacctcttcttcgacgcccagatttttaatcacccggcgtaa

SEQ ID NO: 14139 - DNA, 270 bp, Glycine max
  Peptide Sequence Number=SeqID_105824
atgtccaaatcttgtggatttgggatgaccggccctctcgatgagtcgatctcttgctttctcataaggaggactacatgtcctcaccatcagagggcttcacgccctcacctccagaggactacatttaccctcaccgttgagaggactacacgtcctcgccttgagaggactacacgtcctcaccatcagagggctgcatgccctcacctccagaggactacatgtcctcgccttgagagggctacacgccctcaccttgggtactag

SEQ ID NO: 14140 - DNA, 531 bp, Glycine max
  Peptide Sequence Number=SeqID_105825
atgcccaccaccttgcccccgagttcctcctctagcatgcctcccttgtcgcctccttctcccatcaatttgttcacaaaatcacaaaacatactaatcatgccactaccatctttaagcttgttgcctaaagtagatgacgaagcaaatcttaagacagacatggatggattaacgggggtaaatgaagtgaatgttttcataccaagtgacaaaattgtatttgttaccattggattcaatgttcaaaagtgtcattcaaataaaccaaagcaaaactgccaattcatgcacaatgggatgatggcagccgaaatgaagaacgtaagttttgaatggacatttgctatcacagtgggtgtggttggtgatgtatgtagaggcttcgaggagaaagtactggtttattgtgatgggattattacccaattgcatgtggaattgtccagcaatcaactccataggtctgttaagcctcctattttttcaagttttggagacatagccttggcaattggagaaaagtcttag

SEQ ID NO: 14141 - DNA, 378 bp, Glycine max
  Peptide Sequence Number=SeqID_105826
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccctcagtgacacgtaccctagatctcttttcttaccctcccattgacctagtcaacttcaatcttaacctattgaaacccgtcatcgctactaccgcctctgtcatcagcaaaaccatcctccacctcgaccccaactccttctacaaaaaccactttgcttctctctccctcaacgagctcacttcctag

SEQ ID NO: 14142 - DNA, 477 bp, Glycine max
  Peptide Sequence Number=SeqID_105827
atggtgcaaagaaaggataatgagcttaggggaagcagcaatgagatcgtcggtggctatcacaagtggctgaaggctcggatgcaagagttagattggctcccaaagctaaaggtttcaagtgaggaagaggctgaaacccctaaggagagtgaagagccgaagcattggaacaggaaacaaagagggcctgaaaggaagcatggggccgaaacaagttccgaggggctttgtaggggcagcaacagtgagctcaagcttcgaagggtcgagagagaccagtcaagagtcgagggcatgatattaaaggacaagttgaaggcttgtcaaaggtcaaagaggagtttgtccgaacaattcagtaggacgaaaggaaacatgtgggccatcattgaccaatacaaagagaagctaaatctagcttcaacccatgaacaaaggctagaggatgagtgtgcaaaggtatcggtcctgtaa

SEQ ID NO: 14143 - DNA, 231 bp, Glycine max
  Peptide Sequence Number=SeqID_105828
atgcttccttttgacttccgacatgttacggaacttcacggattgtgcaacaatgtttcctttcgacttccggcatgtcacgaaacttcacggattgtgcaacaatgcttcctttcgacttccggcatgtcacggaacttcatggattgcctaacgatgggtgccaagtacctcgaagtggtcaaacaagggtcgcatcccaacaaacggatggtccccagacgaaattag

SEQ ID NO: 14144 - DNA, 213 bp, Glycine max
  Peptide Sequence Number=SeqID_105829
atgtattctaacctaccacttttggctttacaagtggatgagacgaatagtcgtccaaacacattggtggtggtagctaatggtggccactttgttgctagtggtggtgagggagatggtggtggtagcgacattgatggtggtggtggttgttgttctaatatgttggcgttattggtcttgacaatgacaatggtggggtggtggtgctga

SEQ ID NO: 14145 - DNA, 435 bp, Glycine max
  Peptide Sequence Number=SeqID_105830
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctctttgttgaagaaattgatgatagatggatgcagtttggtgagtacattgcacttgtagggcaattatgtgcagtgcctggccactgttcgccggggatcctctag

SEQ ID NO: 14146 - DNA, 144 bp, Glycine max
  Peptide Sequence Number=SeqID_105831
atgtctggtcaaagaaaatttttcaatcatccactcgctaagcgcgccctgtgcgctaagcgaatcattatgcatgcgctgagcgagtcacctctcgcgctaagcgtatcaacccctactcattgcgtgaaagggcctagctga

SEQ ID NO: 14147 - DNA, 549 bp, Glycine max
  Peptide Sequence Number=SeqID_105832
atggacaagaaaatccgcagtattgtgagtagcattttgaaagacgcctctgttcctgatgctgagaaagatgttccaacatcctccaccccagatgttgctgtccctgaagctgataaagatgtcccgacatcttccaccccgaatgtttctgtgcctgatgttgagaaagatgttccaacatcttccggcccaaatgctgaagtactctcttcccccagtaaagagagatcaacagaggaagatgatcaagccacagaggagacccctgcaccacgggcaccagaacctgctccaggtgatctcattgaccttgaagaggtagaatctgatgaggaacccattgccaacaagttggcacctggcattgcagaaagactacaaagcagaaagggaaaaacccccatcaagaggtctggacgaatcaaaactatggcccagaagaagagcactccaatcactgtgtgtccctcatccagacgaagcaaagtcgcaatcccttccaagaagaggaaagaaatttcctcatctgatgaagatctgaagtga

SEQ ID NO: 14148 - DNA, 708 bp, Glycine max
  misc_feature (4)..(4): n is a, c, g, or t
  Peptide Sequence Number=SeqID_105833
atgncggaggatgttcctcaggtgactgaggatgtccctcatatggctgacgatgttgctcagatgagtgaagatgcgcctcagatgaccgcggacatagatgcaactgttgcagaggacttaggtcatgatggtgctgaagggtcacatgcagatgagggattccctggttggccccgtgacccatcagttctgacttcatttgcggagcatgtcgcacatgccatttggactggacaggagcgtcctgagctgaagttagtgtcgcatgggaggaagatggcgttaattgggaggccagtgcctgcgattgaagggctggttatcgccacaggattaagtccattgatcgagtgttcatttgtaactggcgatcctggacttatatccgcatttgtcgagaggtggcacaaggagaccagcaccttccaccttccagtaggagagttaacgatcacactaaatgatgtgtcgtcactcctctatctccctatcaatggcgccttccacagcttcgaggctctttccatggacgaggcagtatttttgtggatggagttgctcgaggtgtctggtgaggaggctagagccgtgacagtacgagcgcacggggcatatgtacgcctttcatgggttcgggcgatctatgagatgagatgccaggcacaaagatggattgtagcaactcgtgcttatctcctgcacctg

SEQ ID NO: 14149 - DNA, 741 bp, Glycine max
  Peptide Sequence Number=SeqID_105834
atggatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcagacctttgtctctacccggacctga

SEQ ID NO: 14150 - DNA, 249 bp, Glycine max
  Peptide Sequence Number=SeqID_105835
atgactgttgcagacagtattaggacaactctccctaaaatcgaaagtgctaaaaggtttatgggattagtgggagagtgctctcaaacagcttataagtttgttgttgggacattaatgagtacattgaccaccatgaagtttgatggttcacgtactattatgttagttcaggaagaaatgaggcttaagaatcaaggaagttactcagttcattatgtaagccaccaaggaaatcaaggagcttga

SEQ ID NO: 14151 - DNA, 723 bp, Glycine max
  Peptide Sequence Number=SeqID_105836
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaagggcggtaatttacggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccg

SEQ ID NO: 14152 - DNA, 162 bp, Glycine max
  Peptide Sequence Number=SeqID_105837
ggtagcaaaggatcattaaattgtaaacatcatgagccacatgatgagggaagcagtatcaaatcaatgctttacaagcttttggtcaatctgaggagtggtgtcttcatgctacaaactacctcaattgtgctttgctccaatttcctttctgctatttag

SEQ ID NO: 14153 - DNA, 336 bp, Glycine max
  Peptide Sequence Number=SeqID_105838
atggacgaagatcagtggatgtatgacaacatcatgtctaaagaagttaatatgaatgaagaaaatagggaggaacctggtgtgaatgaagaaaatagagaggaacctggtgtgcttcatcatattgattgttttgatgccttcaatacttctcagatgtttgttacccgtgatgatgttttgcattgggctcactctattgcgtatgatattggttttgtgaagatgattatgaggtcagacacatatattggaattaaaggaaggacctcatttgttttaattggttgtgaaatgagtgaaaaatatagggtcacgaagaaagatttagtatga

SEQ ID NO: 14154 - DNA, 550 bp, Glycine max
  Peptide Sequence Number=SeqID_105839
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaacagttggagcatttaatgcttgcgttaaatgcgcgtcccttcttcatgcagagttcatgctgataggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14155 - DNA, 396 bp, Glycine max
  Peptide Sequence Number=SeqID_105840
atgaagggattgaagcattcatttgtactgtctcccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14156 - DNA, 246 bp, Glycine max
  Peptide Sequence Number=SeqID_105841
atgtgtgcttgtcatggagaagccccggggcattccattgagcattgtagggctctgaagcgtaaggtgcaaggtctaattgatatggaccggctgaaatttgaagagaatcgtgtgattttcaactttcaccggaagtgggtgcaagccattggtctgtttgctcaagcgacctgtgctcctgagtttggacttccaagaccgttcaatcagagattactcgtcttgcgcgttggtggggctgcc

SEQ ID NO: 14157 - DNA, 462 bp, Glycine max
  Peptide Sequence Number=SeqID_105842
atggacagaagtatgatagatgcagccagtggtggagcccttggagacatgacccctgctgaagccagaaatttaattgagaagatggcttccaactcccaacagtttagtgccagaaatgatgccatagtcattagaggagtgcatgaagtagccacgaattcatcttcagcagttgaaaccaagaagcttgaaggtaaactagatgccttagttaacctcgtaacccagctagccttgaatcagaagtctatatctgtcacaagagtctgtggtttatgctcctctgtcgaccaccacacagacctttgcccttctgtgcaacaatctgaagcaatcaaacagcctgaagcttatgctgcgaacatctacaatagacctcctcctcctcaacctcaacaacaaaatcagccacaacagaataactatgacctctccagcaacaggtacaatccagggtga

SEQ ID NO: 14158 - DNA, 123 bp, Glycine max
  Peptide Sequence Number=SeqID_105843
atgggggaactacttcaagctcaggagaagaaggtgtgggctcaagaggagcagcctcgttggatctcaccaatggaagttaagcttcaggccaggctacttgctcaagaaaatgctccatag

SEQ ID NO: 14159 - DNA, 864 bp, Glycine max
  Peptide Sequence Number=SeqID_105844
atggccatgtttgatccagatatagttcttgagttttacgccaatgcttggcctacagaggagggcgtacgggacctccggtcatgggtaaagggccagtggattcctttcgatgcagatgccctcagtcagttcctgggatacccgctagtattgaaggagggccaggagtgcgaatacggtcagagaaggaatcgggctgatggatttgatgaggaggccattgctcagttgctatgcatcccaggtcaggattttgctcggaccgctgccgggaggcgggtgcggatcatgcgcaccaacatgactaccttgacccagacatggatgacgttgctgctcagcaacatctgcccagcggccataattccgacctccttctgccgaagtgtcagctggtgtatgccgcctaccaggcaccctctagaaccagataagtctaacagggccctgggttttccggcgctgatcacgggtctctgccagtcgttcggggttcctgtcacacctagtaaggtgattcgactgccgatcacccgagctttcatagagaagtattgcacgcatagacaggcacagggtggcgacccgcaggccccagacgcaccgccgccacctcatcaggctgatccaactgggtcatttgacacagagcggtatttacggcatttgagccagggttttgcttcttgtccatgccctactccgaatcagttcagggcagaggtcgcatggcccgaagattggcctgaggcccaagtaggggaggcgtccgcagaggctcccggcgatgcagatgaggcccgcatggacgaggagatgacagatttactcgatttcttgggagggagtggagccacatga

SEQ ID NO: 14160 - DNA, 309 bp, Glycine max
  Peptide Sequence Number=SeqID_105845
atgaaaaatggaagggatggtattattgtgagaaagttgatggaggaatcaattttcatgtgtagtctgaaggaaggaacacttaactgggaaatgttgcaattcaagccaaaatttccacgtcaagtattgctttgcagagttggggaattttatgaagcttggggaataaatgtatgtattcttgttgaatatgagggtttaaatccttttggcggtctgcaatcagatagtatcccgagagatggttgtcctgttgtgaatcttcgacaaactttagatgatcggacacaaagcggttattcagtg

SEQ ID NO: 14161 - DNA, 597 bp, Glycine max
  Peptide Sequence Number=SeqID_105846
atggcgtggatatatggcagaattttggctttccactctgttccaccgtccaccattgataacactatgaggttgcagatgtgcagaaagctttcaactgtccaactaactgaaagacttgactattctaatttgcctggcctgaatcccaacatgaaaaatggaagtctgaaggaaggaacacttaactgggaaatgttgcaattcaagccaaaatttccacgtcaagtattgctttgcagagttggggaattttatgaagcttggggaataaatgtatgtattcttgtggcatatgagggtttaaatccttttggcggtctgcaatcagatagtatcccgagagctggttgtcctgttgtgaatcttcaacaaactttagatgatcggacacaaggcgtgcctgccatcttaccagtctatgagtacatgctgctaataaattttggtctcaacactgcattgtggaggaggcaggctcagggccgctctcaagctcgatccaggaaacgtctctttatatctggattaaaagaaggaaggggcatatggacagaggttaaggtatcatccataacagatagagagcaaccttga

SEQ ID NO: 14162 - DNA, 477 bp, Glycine max
  Peptide Sequence Number=SeqID_105847
atgcagatgacagacagaggtagaggtagtggtcgtagaacatttaatcgtggtacaagacatgatacccacagtttgagagctccaattaccgccaatccttccccctcatccattcacatatcaacctcagagtcaatgattcatgttgttgcacagactccaaacacacttcctacagctcaagaccaaccaaatcctacctttgtaagggagtcaattcctactacccctattagagatgcttcaccttcagcaccagatgattctgttacacctgagtacccaacaaatccaaattatgaacatattgttaatgaaaggcctttcattcgtgcatataaaggagagtttcaaccaacatatgggtgttgtaatatcatatcaaatattattagggcaaaatttgatgaactagctccaagttggttgagtgtgtcagttgaccttcgcgataggtggtttggagagtttaag

SEQ ID NO: 14163 - DNA, 113 bp, Glycine max
  Peptide Sequence Number=SeqID_105848
gttctacgagctataaagttgttgctgaatgtgctaatgtaatgaatgaaatggtttcagatgatgaaggtgaaatgatgggtgctgctggtgtcactaatttggaggaatga

SEQ ID NO: 14164 - DNA, 868 bp, Glycine max
  Peptide Sequence Number=SeqID_105849
atgctgaatactgagaaatccggtggcggcagtgatgtaggcagcaacgtagaggtgattgatgccaacgtgcagtttcaattgacacctgaagtagcgatctgggcaggtcgtttcctgtcaccaagtgaccgtgcaaacctggctggtccttactactctatgggtggcggctactgggcaaatattgcttcacgctatggctggaacggtggtgtgattggccgtgacgaaggtgtggcagtggtgaccaactttttggaagaccatttggccgtttccttcggtgcatttgaaggtgacaagattttccgctttagcggcgtgggtgcgcaatcacaagcagctaactctaaagataatctgatgtatgccggacgtgtgcagtacgacttctgggatgcagagccaggttactacggtaccggtaattactttggtgcaaaagacatcttggcgattggcgttgctggccgttacaaaaaagacggttcagtgagcccgacaggcactgtgggtgattacaaatcctacagcgttgatttcctgttggagaagaaagatgtcggtcctggcactttctcacttgaagcagcttactaccactacgatacagacaatgtctttagaggcgagcaaggtaaagcttactctgctggcttgggctacttgttccaggaacaaattggctggggcaagtttatgccgattattcgttatcagaaatttgatgctgatggtactaccagctacaacagcacaacaaccgtatttactaatacggcaggaagtggcagcagcaagcgtttcgaggttggtactaactacgtcatcgcgccttacaacgcgacattaacagccactgttg

SEQ ID NO: 14165 - DNA, 956 bp, Glycine max
  Peptide Sequence Number=SeqID_105850
atgcggcagcgtcagcaacgtgctgccgagcagcttgcggtaggaggccatttcgctgatccgcgccttcagcaggtaatcgaagtcgcccgataccaggtggcactccagcacgttgggcagcttcagcgccgcgcgccggaactcctcgaagatgtcgccggacttgtaggccaggctgatctccacgaacaccagcaggctggccttcaccgcggccgggtcgaggtgggcgtggtagccggtgatcaccccttcgcgctcgagcctgcgtacacgctcggtgcatggcgtggtcgacaggccgacccgctcgcccagttcggtgaaggagatgcggccctcggcctgcaggatgcgcaggatcttgcggtcgatcttgtccagttcgcgggtacgggtggccatggccgtcaaccttggggaatgaattgcaggagaacatcctgccggttgatttcaaaacaggcaaatcaactgggaatggctgtctatacttccccaattatggtcccggcacgctccagtgtagggaatgatcgggccgggtttgaagtcacggtcatcgatcgtcagcccggcccggcgctggaaaccagcttcgccaatgctggccagctgtcgttcggctacacctcgccgtgggcggccccgggcgtgccgaagaaggccatcggctggctgttcgagaagcacgcgccgctggcgatcaagccgggcatggacctggcccagtaccgttggctgtggcagatgctgcgcaactgcacccacgagcgctacgcgatcaacaaggcgcgcatggtgcgcatgtccgagtacagccgtgactgcctgaacgagcttcgcgcgcagatcggcatcgaattcgaaggccgcgacctgggcaccacccagctgttccgcacccagcatcagctggatgcctcagcgcatgacatcgagatcctggccca

SEQ ID NO: 14166 - DNA, 534 bp, Glycine max
  misc_feature (100)..(100): n is a, c, g, or t
  Peptide Sequence Number=SeqID_105851
gaatacgccgcagaacggcgcctcggtgccgtgctgcagcagtacgcggcgttcttcgccgctgaggccggcgaccagcgcctcggtctggcggtcatgncggcgctccgtggggtcgatggcctggggatgccggaaaacgtgggggtgccggcgcgcgcttgcaagtgtgatggccgttcatgggcggcacacaggtgcaggcgcaaggcccaggtaccgacgtcgtcgagcccgaccgccacccgcagtgccaccaccgtggcaccgcaaccggtggcacctccgccacaggctgcccgcccgcagccgcaggtgctgccgtcgccgcagccggcacagccgatcaagtccaccggtcccgcccggatcgcgccggcgccggtaccgaagccggccgacaaggtctatgaccgcaatggccgcatcgtgcctggcgtgcgcccggccggcccgaaccgcgtgttcgactcgcgtacaggccgttattacgacagcgtgcctgccggtgatggccagcagatcaggcgctga

SEQ ID NO: 14167 - DNA, 578 bp, Glycine max
  Peptide Sequence Number=SeqID_105852
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaacccccccgttcagcccgaccgctgcgccttatccggtaactatcgtcttgagtccaacccggtaagacacgacttatcgccactggcagcagccactggtaacaggattagcagagcgag

SEQ ID NO: 14168 - DNA, 601 bp, Glycine max
  misc_feature (45)..(45): n is a, c, g, or t
  Peptide Sequence Number=SeqID_105853
cgccacgcttcccgaagggagaaaggcggacaggtatccggtaancggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgatgtcaaaacaacctttttgcatggaaagctgaatgagaccatttatatgaagcaacctactggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14169 - DNA, 369 bp, Glycine max
  Peptide Sequence Number=SeqID_105854
atgaaaggcctttttgttacaaaatttgaaagcaaagcaaattgccaattacaaaattacaaaaaagaaaatcctcaattgcggtggctattctctctttggtgtttcactcaatttggagtgcttcttagtccaatagctcttcaggtggttggccccttgcttcttgactcaaattcttcaagtcctttcgctaagcgcaagccttgcactaagcacatctttgttcacacgctaagctgcaagtctcaagcgcttagcaatcaacccttgcatctgaggcttatttggtccgctaaggtggccaaggctgagctaagccaacttcaattcgatctgaattcggctaagctgcagcctgatcgctaa

SEQ ID NO: 14170 - DNA, 201 bp, Glycine max
  misc_feature (46)..(46): n is a, c, g, or t
  Peptide Sequence Number=SeqID_105855
atgcgtaaggagaaaataccgcatcaggcgccattcgccattcagnctgcgcaactgttgggaagggcgatcggtgcgggcctcttcgctattacgccagctggcgaaagggggatgtgctgcaaggcgattaagttgggtaacgccaggggcaaggttcgagaccagcccaaggcgtttccatttatgcgttccttttaa

SEQ ID NO: 14171 - DNA, 391 bp, Glycine max
  Peptide Sequence Number=SeqID_105856
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacagcggataacaatttcacacaggaaacagctatgaccatgattacgaattcgagctcggtacccggaactgctggacttaacttctcaatgtag

SEQ ID NO: 14172 - DNA, 204 bp, Glycine max
  Peptide Sequence Number=SeqID_105857
atgttgaatttcagtacaagccaggccaaccggttaaaccggaacccgggcatagcaccggctcgggtcacatatcaaatcggatatgcatctaacccggtgccatgtaatcaacccaacactgaaccagtaagaactgggaaactcggtctagtcggatacactcaatttcctagttgtactctctcactttgcaaattataa

SEQ ID NO: 14173 - DNA, 618 bp, Glycine max
  Peptide Sequence Number=SeqID_105858
atgtgggcgctggcgtggtggctgctcttcttaccgtgtttgtggtacggactggtgcgcctgcgccgtatcgtgcaggaggatagccaccagaaagtcctgctggcgctgtgcggggcatttattttcgtgctgtcggcactgaagatcccatcggtaaccggcagctgctcgcatcccaccggcgtgggactcgccgtgattctgttcgggcctggggtcgtcgccatcctcggcgccatcgtgctgttgtttcaggcgctgctgctggcacacggcggtttgaccacgcttggcgcgaacggcatgtcgatggcggtgattgggccggttgttgggtatatggtgtggaagatggcctgccgtgccgggctccgtcgtgatgtcggggtatttttgtgcgcgatgctggcggatctggtgacttattttgtgacttcggttcagcttggcgcggcgttcccggacccggtgacgggtaccacgggctcgatggtgaaattcatgggcattttctgcctgacgcagatccccatcgccatcgcagagggattgttaaccgtcatgatttatgaccagttgaccaaacgtcagctgattcccgcacaaggatactga

SEQ ID NO: 14174 - DNA, 111 bp, Glycine max
  Peptide Sequence Number=SeqID_105859
atggaggtcatcaccggtgtgcagaccgatgatgtaggatttacgttggtagatctaaagaaactagcttaccagaatgaccctttcattatggcagaacaagctaaacag

SEQ ID NO: 14175 - DNA, 90 bp, Glycine max
  Peptide Sequence Number=SeqID_105860
atgcgtagtgattgcttagtgcaattctccattctgtatcctgtttcggagccccatgaattgcatttttcgttcatgctccacccacgg

SEQ ID NO: 14176 - DNA, 628 bp, Glycine max
  misc_feature (26)..(26): n is a, c, g, or t
  Peptide Sequence Number=SeqID_105861
cgccacgcttcccgaagggagaaagncggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatttctgccaacaataccattacatcaggccaatacatcacagaccctcacactctcatctcccctaatagtgtcttcaagttaggattcttcagccctcaaaactcatcaaatcgctacccttcaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14177 - DNA, 201 bp, Glycine max
  Peptide Sequence Number=SeqID_105862
atgggaaatcaacagcgacaagggtatactcaaggaggattttcaggcttccaacagggtccttataatcaacaaggacagtggaggtcacaccctggcaatcagttcaacaaagaccaggcaaatacagaaatgaatcccaaggaggaatgcaaagctgtgatgacaagtagtaagaggtttgtggaggctgagtattag

SEQ ID NO: 14178 - DNA, 834 bp, Glycine max
  Peptide Sequence Number=SeqID_105863
atgggtcagctccagcggcaagcttttcgcaaagcttacggtaagatctgggtcctagccatggtagaagtctctatagaggccattgcctccctcgcccagtattatgatcagccgttgaaatgcttcacctttggggacttccagttatcacccatggtggaagaatttgaagagatcctaggatgtcctctagggggaagaagaccatacctcttctcagggttctatccctcattagctagaatttctaagatagttcaaatctcggcgcaggaattagaccatagaaagcaagttgaaaatggggtggttggaataccgagaaagtgtttggaggcaaaagcaagaaacttggcaggcaaaggagaatgggccccgttcatagacattctcgcactgttgattttcggaggagtcctctttccaaatgtggatgggttggtggacctagcagcaatcgacgcttttctcgcctatcataaccacaaggaaagctcggttgtcgctatgttagccgacctatatgacaccttcaaccgaagatgtgagaagagcagtacgaggattgtttgctgtactccagctctttatgtatggttggtttcacacctttttcaccaagaggggcaccacctagaggaagagctcgcgcctgtcatttcacgaggtttcgataagaccaacgtggagacacttcagaaggtccgcaaggcatgggaggtggtgcaaaagaaggacaaagaactcaggggcagtaacaatgggcccatcggtggctaccaaaggtggttgaaagcctatgtgcaaggtttggattggctcccgagttag

SEQ ID NO: 14179 - DNA, 129 bp, Glycine max
  Peptide Sequence Number=SeqID_105864
atggataaaagcatgaaggtaggagaagatgaatggaaggagagggagaaaaggagcacgaaattttgtgcctcaaataagcccactaatccaagatcaagaccaagattctccactaagtatgcttag

SEQ ID NO: 14180 - DNA, 889 bp, Glycine max
  Peptide Sequence Number=SeqID_105865
ggtcagggatcccgttcgagccagatgctatcggtcagctcctgggatatccgttagtgctggaagagggccaggagtgcgagtatggccagaggaggaaccggtctgatgggttcgatgaggaggccatcgcccaactgctatgtataccggggcaggattttgcccggactgctgcagggaggcgagtgcgaatcatgcgcaccaacatgaccaccctgacccagatatggatgacgttgctcctcagcaacatcctgcccagcgatcataattccgacctccccctgccgaagtgtcagctggtatacgccatcctgacgcggatgagcgtccatgtggctcagttaatcgctgatgccatttatatttttgcaggtatggcgcctaccaggcaccctttggatccagataagtccaacagggccctgggatttccagcactgatcacaggactctgccagtcgttcggagtccccgttgcaccgaccaaggtgattcggccacccatcacttgggcttttattgagaagtactgtacccagagacaggctcagggtgatgctccacaggccgcaggcgcgccaccaccacctcatcaggctggtcaggctggggcatttgacatggagcagtatttacgacatttggttcgccaacaggcggccaaccaccgggcacatgtgcagacccatgattgtctgtaccagatgagcctcagcatgcaaagccagggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 14181 - DNA, 546 bp, Glycine max
  Peptide Sequence Number=SeqID_105866
atgcacaactattatgagaaaggaagagctcctgatcttgaaagtgtattggaagacttcatgacgtaccaagctagctctaaaggtgactgttattccatgcaacagcagggagctcagtttgaaagggactattcttctgtagattatcaatgggagtcaaaatggaaaccttattatcacaatgaagtagaaggattgtctaatctggatgacctgctaatgcaattcaaagatactatagattcaatgcaacaagcctttaaaagaactgaaactcagcttggcaagttggtagatgacatgactaaagttgtggtcagaagagaagaagagtatgaaaagattgaagcacatcaagaaagcattcttcaagttaccacaatccatcatcaattgatcaatgaagaagaaaaggatgaagtctccagtactccagaatatccttgcatggcaactgctggctacgttgtagggacaaataaaggtcgattggagcttagtgtagaggatcagaaaattattttgacctctttgaagccatga

SEQ ID NO: 14182 - DNA, 282 bp, Glycine max
  Peptide Sequence Number=SeqID_105867
atggataagagcttgaaggtaggagaagatgagtggagggagagggagagaaaggacacgaaattttgtgcctcaaatgagagggtacatctacttgggttgttgactgagaacaggagagggtacatctcttgtggatcaattctagtggagggtacatccactaggttgttcaaagagaacaagggagggtacatcccttgtggatctttgcttgtaaaggattttacaaggttgaaaagaaatctcaaggatcgcaggtcgcttggggactggatgtag

SEQ ID NO: 14183 - DNA, 249 bp, Glycine max
  Peptide Sequence Number=SeqID_105868
atgcccagggcattgagtgagggacgaccgaggagtatattgtatgatgtgttatgggtggcatgttggatacttggagtcgagagaccatatttgactaatcgaactagccgtaggtgcctttttcccgtagaggtagtggcccctacactagcaaaacctccagtgatggtgtttatgactcgccttgattcttgggcatgtgtgactatggcttgtggacgaactcctttaggtggccaagcttga

SEQ ID NO: 14184 - DNA, 129 bp, Glycine max
  Peptide Sequence Number=SeqID_105869
atgaactcgctaagtgagcatgctgcgctaaatgaactcgctaagcgcacctaccgcgctaagcgagttcatcttttgaggatgaacactcatcctcttgctgaaatacctatggctaagcgagactga

SEQ ID NO: 14185 - DNA, 339 bp, Glycine max
  Peptide Sequence Number=SeqID_105870
atggaatgccctgaattgaagttatcctcccatggaaggaaggttcagaaatttgggaggtctgctctagaaattgaaaggttagtcgctgccacaggattaagtcctttgatcgcatgttcagtagacactggccatcagggactgatatccgcttttgtggagaggtggcataaggaaactagtagtttccatcttcctgttagagagctgaccatcaccctggatgatgtggcatctctacttcatcctccaattattggcgcattccacagctttgagcctcttcatgtcgacaaagcggtcttgatgttggtggagttacttgaagtctcctga

SEQ ID NO: 14186 - DNA, 408 bp, Glycine max
  Peptide Sequence Number=SeqID_105871
atgccccggggtattcccatggtacgtgcaagttgcgttaggatcataccactttgggaaaggggttggaagatcttcctgggagttattatggccaattggttggcgattagggatggcaagaggtcttcatacgtcattgggagtggggtgaattctggaattggtctcgggggaaagttcctcattgcgttggaattgccggcggggcgagtcgtggttggagttggaacttggggggcttccctctggatgggtgccttaggctgcacgggtgctgaattagaggagttcccggcgggtttgacctatgcgggcaccgaagtgacggcgtgggcatctccctccttcctttttgccccaattgctccgattcttttagcattggcacttgtggaggaaacgtaa

SEQ ID NO: 14187 - DNA, 117 bp, Glycine max
  Peptide Sequence Number=SeqID_105872
atgggaggggccacttgtgctgccaggagtttaagggaagagaaagtgcaaactcagatttatactagttcggccacacccttgtgcctacgtccagtccccaagcaacccgcttga

SEQ ID NO: 14188 - DNA, 681 bp, Glycine max
  Peptide Sequence Number=SeqID_105873
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataataggctcagaattcacgaccttgcgtttagcgccaccctcgcgcttagcgcaacccaactgctgagcataaccatcgctaagcgcagcttcaaagcgcttagtgcaaaggagaatctggcagagcatcagaatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 14189 - DNA, 419 bp, Glycine max
  Peptide Sequence Number=SeqID_105874
atggcggtttacgtcagcccaaacagcgaaatcctgccttcgcgcttgagcgacttgatggacttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14190 - DNA, 333 bp, Glycine max
  Peptide Sequence Number=SeqID_105875
atggttcaacccatagtagtattggattcaagggtgttattgagagactcttcccaagtggaacaggtgctgattcagtgggaaattgctggtcctgaggaagctacatgggaggatgtgacttgggttaaggcaagttatcctcacttcaaccttgaggacaaggttgtttttaaaggggaggacaatgtaacatgtgggaagcaggagggaaatttggcatgtgagtctattacaaaggaaggacacgtggctaatgatccgtatgtgggggtcaaaaagagcacacgcgttaggagggagaatataaggctgcgtgaatactcactttga

SEQ ID NO: 14191 - DNA, 700 bp, Glycine max
  Peptide Sequence Number=SeqID_105876
ggtgcagataaccatgaggtatctccacatgctatcggaccctcgagtcacgatagtagaattgagactttttcgcggtctcggccgaaagatgctgacatctccgggaagggtgcagatgaccacattggtacggataaccataaggtgcgttcgcatgctaccggacccttgggtcacgatagtgaaattgagattttttcgcagtcccggccgaaagacgctgacatcttcgggaaaggtgcagatgacgacacgctgacatctccaggaaaggtgcagatgacggcgttagtctctgcgtgtcaacgggctcgcttgcctctagctgacaaaagtcttgatcagcaggctcgcttgcctctagttgacaaaggtgcagatgacgacctgacaaaaggtgcggataaccataaggcatctccgcatgtcatcagacttgcagctctgcatgacaaaggaaaggtgcagatgacgatgttagtctctgcgtgtcaacgggctcacttgcctctagctgacaaaaggctcgcttgcctcttgttgacaaaggtgcagataacccttgggtatctccgcatgtcacctgactcacgggtaggggtgacagaactgtggggtggtcaacaaaagaagggcttttgctcctatgtatcctcaattgcgatgaggaacttagacctacgtagttcttcaggcg

SEQ ID NO: 14192 - DNA, 471 bp, Glycine max
  Peptide Sequence Number=SeqID_105877
atgggttctccacctgcctccactcctcttcctcctttggacgcatcggcttcgccgtctattgtgaagcggacacgcaaagcctcacgtctacgatcattgtccactagaccacctggtgctgagagaccagtggtgcatgttgatcctgctaccgggaaggccgacagtcccctcaggaagaaattaagaacatatttggggattgtggtgtgtgataaggtggatgtcacctacgagaactggaaggaggcggaatttgatatccaagaggcttctgatagtaggacgaaaaggaagttactgcagaccgtgggggagagatggaggcagtttaaatcagacctcacgaggaaatgggcccttgcagccgatcaggacagtgtcgaggacactgtctgtgagaaatacggcatcagtaaggaaaagtgggtccagttttgccagactcgcagacatccttcttgggag

SEQ ID NO: 14193 - DNA, 728 bp, Glycine max
  Peptide Sequence Number=SeqID_105878
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtgtttataccacctctagtcgtgtatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14194 - DNA, 782 bp, Glycine max
  Peptide Sequence Number=SeqID_105879
atggtgaaagttggaacctcttacgtgccgatcaacgtctcattttcgccaaaagttggcccagggctttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataatagaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14195 - DNA, 120 bp, Glycine max
  Peptide Sequence Number=SeqID_105880
gatgaaggcacccatgatggctacgataatcatcatcaaagggctgaaagcagtaacgaaatcttattagttaataacacttcatttgttcacttaactgctgcagtggcaagcttggtg

SEQ ID NO: 14196 - DNA, 540 bp, Glycine max
  Peptide Sequence Number=SeqID_105881
atggcgcctaccaggcaccctttggatccagataagtccaatagggccctgggatttcccgcactgatcacaggactctgccagtcgttcggagtccccgtggcacctaccaaggtgattcggccgcccatcacccgagcttttattgagaagtactgcacccagagacaggctcagggtgatgctccacaggccgcaggcgcgccaccaccacctcatcaggctggcctggctgggtcatttgacatggagcagtatttacggcatttggttcgccagcaggcagccaatcaccgggcacatgtacagacccatgattgtctttaccagctgagcctcagcatgcagagtcagggcttcacttctttttcatgccctactccagaccagttcagggcagaggtcgcatggcccggggattggcccgaggcccaagcaggagaggcgcccccagaggctcccagcgatggagaggaggcccacgaagacgaggagatggccgatttgcttgacttcttgggagggagtggagctacatga

SEQ ID NO: 14197 - DNA, 857 bp, Glycine max
  Peptide Sequence Number=SeqID_105882
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggcagtcaagaaggcccgccatggtggtgccataaggtgcaatggtgtgtttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14198 - DNA, 567 bp, Glycine max
  Peptide Sequence Number=SeqID_105883
atgataaacagcgcatgtagggacgttctgaatttaaaaaatgatcgaagcttatcgatccgtcacctcaggtttttgggcaaaggccgtcggggcaagtgtaaagcggggtgcaatgacgtgcgcgtaaccaccacaccgccggttaattgcgccgctacagggcgcgtcccattcgccattcaggctgcgcaactgtctgggaaagggcctgatcggtgcgggcagcttgctattaatgacgccagctggcgaaaggggagatgtgctgcaagtgcgattaagttgggtaacgccggagtgtcccagtcacaaaaaaggctgccaccgcggtgcggccgctctagaactagtggatacccccgggctgcagtgatcccatattccgcttccattttcgctcatgatcctactcgcgtatcaagagctgctcggcgagcggaaatggcttcaacaacgggcagatttcctggaaatgccaggaagataaacagcgcaagtgagagggccgcggcaaagccgtttttccataggctccgcccccctgacaagcatcacgaaatctga

SEQ ID NO: 14199 - DNA, 96 bp, Glycine max
  Peptide Sequence Number=SeqID_105884
atgccaatctccccctgcaggtgtatcgggatcgcgcccacaaaacaccaagtggacccgaagaagtccaatagggcctggggtttccaactctga

SEQ ID NO: 14200 - DNA, 201 bp, Glycine max
  Peptide Sequence Number=SeqID_105885
atgacgggagattcatcaaagttcacacatatctctcccaagaaaagtaatccttgtggcgtctatcctgacttatcttccttcaccggaagtggcgtctaccctgacttatcttccttcactggaagtggtgtcatccaaaaattctacagcctgtatcaagcgatccgccccgtaaggttcacatcatatagggtatag

SEQ ID NO: 14201 - DNA, 513 bp, Glycine max
  Peptide Sequence Number=SeqID_105886
atgtcctctcccctcggcggggatttcctcttcagcgaaggtgaggtaattgttggctgtgatgttattggcgatccccccaaagccttctacggagatgtcttgggctacgtgagcttcattcaagactgttaccagcaaagctcagtgaggctcagagctcatgagcagctccagaagggagactctatctggggtcttgttgagttgttcaatgaccttgaactcgctttgttggataatgcggaggaactcaccggcctcctcgatgtttgcaagctatatcggcaggccagagggtgcgaacacgcgatcgcttcgggttatgctgctcagcctggtgatattggttactttggtcataatcacattatgttgcccaacaaagctctaacctttggccatcatttctgctccaaatcgcgaaaggagggcattttcggggtcgtgaagtgcgtgtctacgagtgggacttcgaaatttcaggtttgggtggacttctttctcctttga

SEQ ID NO: 14202 - DNA, 261 bp, Glycine max
  misc_feature (240)..(240): n is a, c, g, or t
  Peptide Sequence Number=SeqID_105887
atgaattatggggtagttttgatacaaagaggtcatcctatcgcgtatataagcaaggcaatggggaggaaatatcagatgttatccgcttatgaaaaggatttttatgctattttatttgcatatgagtggcaaggagaggtgttgaagaggaaagaaagaatagtagtagggcaacaacaagaggtgaaaaacaagttgcttgcttatttccatgaatttgtccttggtggtcactcnaggagcatcacatacatataa

SEQ ID NO: 14203 - DNA, 405 bp, Glycine max
  Peptide Sequence Number=SeqID_105888
atggagcatatcagcgttcatgtggtccagcttatttcagatgctattcaccagattgttattacagaacctcctaggcacccagtggacccaaataaatccaacaaggcattaagttttcctgccttaatcacaagtctctaccagttctatggagtggcagtcacaccaattaaactcgcaagtacaacaaccggagcaagatcagcagcctcagtgagcaacaaatgccccaccaccaccaccacagcaactgccttccttggagtccatctcagcacacctacaaagaatggaactccagatcctatagatgcccaagaagcttcccaaggagatggaggaagattagaggaagatgaagacatggcggatcttgttaattatttcattggaggaaattga

SEQ ID NO: 14204 - DNA, 378 bp, Glycine max
  Peptide Sequence Number=SeqID_105889
atggcgaagatggctacaaggacaacccaagtagaacgattaatggtcaacttgatacaaggggcttcgcctagggtaaggtccttggcatggcattttgctgcaatagctgattttgggaccatgatggtcatcataccaaattggaagatgaaagcattgatggatgctgaccgaaagctcagaaaaatgaacacattaattgggttaaaaatcatgcttcgacagagtaatgccatcatcaacatcaaaggtgcttggatggaggtagtaatgcttcatgagggcacatggtgcggtcatgagctatcagtggtcaacaagataggaaaagaagcaaggagtaagaagatgaaagcaaaggcaagagaaaggtaa

SEQ ID NO: 14205 - DNA, 2226 bp, Glycine max
  Peptide Sequence Number=SeqID_105890
atgggttgcaaaatcgcaaaaacaattctatctgggagcttatttgaatttgtcatagagaaccgtgttgtgtggttttgttctttgcgtagaaagccagatgttcttataaaatctgcaattaacaagtatggtaaccttctgaatacattaaattcgacttctgaggggaaatctgatcaaactacaccaaggtggatagaaattaagagtcacgttcaaagcggaggctatgagtgtggctattatgtcatgcaatggatgtggaacataattggcggggaggtgaagactgattggacgatggaagaaaatatacagagatgttccatgtcagcagattctcaggttgaaaacagtgggagtgaagattcaactgatgatgattatatagatgtgaaagaaaatggttaccatgatgcagagaatgaagttgataaggagacagatgatgatgttgattgtattcagagtggaaaattgagtgagagtagtggttatgctggcagtgatctttatgattacaaggcatttggaggtgatgattccaatgttggatcctccagtagtaaccatgctaagactaaaaatgttaatcttaatgttgttccagataccccactctctgaggatcaaaacaagcaaagaaagggcagtgaaaacccagttgatgagaatgatgcttcaaatttgtttccttcaactgaatcatatcgatccatgggtgagattttatcttctatggaccctggcaaccatttacccatgcaagtgactgaatcaggttttggaaagcaaacaagtaaagctagtagtgctagtttcagttctaagcggtcgacattctggggaaggagcaatccaaggaagacaccgtcaatggaatcagttgattcttctggagaagaggagaggtttcttcagcaatattttgattcaaccctggcctttgttaatcacgagaggaaacaaaggactaaggagagtttgttgggcactaattggagaaatatcaaaggacaagtattggcatctagtaatggtactagacagccttctcgaaagaaatttttaaagtcaagtcctagcaattccaaaagtattgaggcatcaacaagcatgtctgtcgatgatcttggtgcccttgattctgcctctgtgccttccacctcaagagcaacagaggctgggattgaggaagatgatggagcaagtatcggtgtggctcaaatattctgcatgacatcaacaagtagcggccaagaaatggataattgggtccctggttgtggtaggttaattgatgtgtctgcaaatcatcctctagatcatgtgttattgaagaatgtggcagagtatgttgatacaaatgggaactggttgctggataatttcaaagaatatgttcccaataatgtggtgcaagatgcggttgccatgattttccctcaaatgcctgagaataggaatgtgttagcttggatcatcaataaatggaaaggtctagagaaggttaaagggtttctttggaagctgggtcatgaatgttttctcacaaattcaatgaggatgggaatggtgatgagccactcgaacttctgtccatttggtgatgatcaagaggagtcactttttttatcttttctgggattgtcaaaatttcttgctggggaagtggcccttaattgtgatggcgttgtcactgaaggagttccgattgtagaactaaaagccatcttcattgaattgaagctggtgtgggagagaggttttagacacattcgagtggatttagactcaacactggtggtgaagctgctttcccaagcgacaaccggcacagccgagcacgactccttccttttcacacccgacgacctacaccgctacctctactccttcctctctagcccctacgtcacctttgttgggatccaagctggcgtgggcaagcttatgcaggaccaccttctacccatgggcaatgtctgtgacctttgcttcctcgccacgacgaagctcagcgacccgaggctaaaccaggtcgggctcaccatgttgtgtcgctgcatcttgggcttgcagtttgaaaaggacaagtggatcacaaggagtttgtgggataatctctcactctctgtccggcaagttgagtacacggctcttgatgcctttctctcctgtgaaattggacgccgtttgatgacttcttattactacatttga

SEQ ID NO: 14206 - DNA, 285 bp, Glycine max
  Peptide Sequence Number=SeqID_105891
atggcagggagaagcaagagtttgcgagaggctgatgagcgcgagaagaaagaaagcttttcagtttcttcaatgaggtccttcaatggtgattttccaccatggaggtgcagtggaagacaaaggagaagaggtgagaggatgcgccctccactagggaataagccatggaagaaggagcttcaccaccaagaatgtgccttggataagaagcttggagaggatacttcaatggaggaaaagaaagagagagagagaaagagagaggggggagcacgaaattga

SEQ ID NO: 14207 - DNA, 405 bp, Glycine max
  Peptide Sequence Number=SeqID_105892
atgacgtctgaggcaacaaaggaaattgcagataggattgtaagtgactctcatatcaaaactgatgttgtcactgaccacagcagttttctaaaaaccgatgttgacaagcataaagaaagcacaaagaaaggccccccagcaaagcatgcagatgggagaaactatgatggaatgctctcttatttggctgatttctcccagtggaagaagattactcgttcgtatccgaatttcggcaaagagcaaaagtacatgatattgtctatgatgatatcgagctcaagacaacaagaaaatgacatcgatggattcgatcaccgaaaaagtgactcaacaagtaatgttttccttcaaccaaatgcagtcccagatgcaacccaaggaacacatattgcctcctaa

SEQ ID NO: 14208 - DNA, 378 bp, Glycine max
  Peptide Sequence Number=SeqID_105893
atggcagcagaatggagaaggaagagagagaggagatgccacttcaaggaaaagatgagtctagaagcagctcaccaccataggaggccatggataagagctttgaggaagaaggagatgaatgaagggagagggagagaagagcacgaaattttgtgctctaagagagctctgaaatctgaaacctttggtttgacaagacgagactcaccaagggatgaccttgggtttgaggagcctttggagatgcaagactcaccaagggtggaccttgggtttggcaaggctttggatatgcgaaactcaccatgggcagaccttgggtttgaacgagcctttggagatgcgagactcaccgtgggcagaccttgggtttga

SEQ ID NO: 14209 - DNA, 426 bp, Glycine max
  Peptide Sequence Number=SeqID_105894
atgcttgctcttgggactaagtctatttggtgttctattcccctaagaggaggtaacccatggggtatctcttttggaaatacatcaccaaattcccataagagttcttggacctttgggggaatggtctcatgtgtgggaattgtggtagtgctaagggaagtctcccttgagaggagaagagagcttaagacttattttgatttacaaatccagccacaactcagcaccacaactcaatttcttcacaggcatcatataggaaacttagaaaacaagaaaagttcaacaacaaaactacttctaggaattgatttagaagatcacatggatttttctcaaaacatgtttaccaaagagtttttactctctggtaatcgattgccagattattgtaatcaattaccagtagcaaaatggatttga

SEQ ID NO: 14210 - DNA, 192 bp, Glycine max
  Peptide Sequence Number=SeqID_105895
atgataaccaatcaaggaaattgttattccatggagtggagtgtgatgccgcagggagaggtcaaatacaagccagggttgcagaacaaagctgcagatgctttatcaaggtgtcaagatgaaggggaattcagatccctcattttgtaccctatgtggatggatggagcagttctaaacctagaagaataa

SEQ ID NO: 14211 - DNA, 450 bp, Glycine max
  Peptide Sequence Number=SeqID_105896
atgacttccttctctctaaatattggcaatttcatcattcttagactcacccctacaaactacccactatggcgtgaacaagccttaacattagcagaaagtcaagacttgatcacatacctccgcaaggaagatgatcaaagtattggtgaacacatccgcactttcaaaggtttatgcgacaaccttgctgcaattgggaaacctgtcccagacaaagagaaagttttctatctccccacaagcctcaggcacgagtatgaaacattcacaacaaccacgctaaaacctccaaggtcatcatactctgagttaatctcacaactccaaagccatgatcaacatcgcaattggttctccaatcattccaatacgcacaactctttcactcttcaagtggttttctatggcaaacaacaacgatctcgtcagttttcctctcaacattaa

SEQ ID NO: 14212 - DNA, 273 bp, Glycine max
  Peptide Sequence Number=SeqID_105897
atgacaaatgtcaatactggtgataaaatgggccatatgacaaagatatgctggtgggtgtccaagaaaccaactcaatctaatgatatacctcaagcacttgtagcccttaccttagacaacacaattgctaaaacagaatggacctttgacatcggggcctctaatcacatgacaggtacagactctgtgcttattggtgatggttcttctctcccaattcatggaacgagaaatagggaaaccgattatcaccgagaggcgcaagggtga

SEQ ID NO: 14213 - DNA, 288 bp, Glycine max
  Peptide Sequence Number=SeqID_105898
atgcacgagtttatgcccttatttgaatgtgaatacgcaagagaggtttgggcagtagcagattatatttgggagagcaaagatgtgcagccattgatctcaatccagcctgcaatacaatctttcaatgatggagtcatgcaaggaatgacaacactttatcaaacccccatcgtcctcaacctgtttcttctttatggcataagccatagcaaggtcgatacaagtgcaacattgacgcttcaattttcgcaagcgagagggagtatggtattggaatttgcataa

SEQ ID NO: 14214 - DNA, 525 bp, Glycine max
  Peptide Sequence Number=SeqID_105899
atggatgttacatttcatgagcatgaaatgtttttacccttgaaaacgcttcattcttcacctcaaagggggtgtgatttggaggtgcagaatcatgatatacttgaccaagatatcaggttatttgatgttatgccaacaacaacagaggaaggaattcaagataatggagatgagaacatggagaatcaaattcaaaataatgtatcacctgaaacttttactccttttcattctattgctgatacacaaaactatgtttccacttatatacaatgcaatgtctcttctaccccaaattttgaccctatagtgagcctttacactcttccacctcgtactaatagaggacaacccccaattaagtatgaactcattcttaattgtaaggtcaaataccccataaacaactatgtgtcatctgaaaagctgtccaagtcatatgtcaattttgtatctcaactatctagtgcctttactcctagtagtttgcaggaagctctagcagattctaggtggatctag

SEQ ID NO: 14215 - DNA, 168 bp, Glycine max
  Peptide Sequence Number=SeqID_105900
atggcggtgaacttcttattgactcatcttctccttgaagtggagtctccaataatctttcttccatctccaattccgctgccattgatcttcaagaagaaaatgaagaagatccaaggcctacaagctccacatggagcaacatcatgtggttttatcattttttaa

SEQ ID NO: 14216 - DNA, 309 bp, Glycine max
  Peptide Sequence Number=SeqID_105901
atggcttcctatggtggtgagcttcttcttgaagtggcgtctccaatcatctttcttccatctccaattctgctgccattgatctttaagaagcaaatgactccattgatgaagaatatccaagacctacaagctccacatggagctacatcatgttttggaggggtaagattgcatcatgtggagctacaagctccacatgatgtagctccatgtggagcttgtaggaattggatcttcttcatcaatggagtcctttgctgcttgaagatcatgacaccaaaatggagaaggaggaagggtgattag

SEQ ID NO: 14217 - DNA, 411 bp, Glycine max
  Peptide Sequence Number=SeqID_105902
atggaaactctagaagtagatcagatgtgcttagcacatttgattaccttcaaattcgtccattgtcaagtgcataaggacttgctaaacatagagatggtcgttgggaatgggcaattgccccaggtatttgttaatgcaagggtccatgtgtctggtggggctcttggtggaggacggatggttgaagacacatcaagtgttgtaggtggggatcatgtattggacattgttgttggtgtttggtgtgatacaaaatctgttgttaccagtccaagaactggtagatacagtgctgatgtagtaggaggagatgctgcagctgagttgactcgatgttgtaggcactcggctgctgctgttggtgacctaatttttatttatggtggtttacatgggggtaagtcataa

SEQ ID NO: 14218 - DNA, 129 bp, Glycine max
  Peptide Sequence Number=SeqID_105903
atggaggtttttctgaccgaattgcaagaagctctgttatttgttccaaaatggaaggatgtgtgtttaactatcatgtctgacatgcaaaagggactgactcaagctgtaactgatatttttccataa

SEQ ID NO: 14219 - DNA, 165 bp, Glycine max
  Peptide Sequence Number=SeqID_105904
atgtcaagtgaagaattgaagttgaaggatccacgatgtcggatacaatgtcctgacatcctgcccaagaatactggaattgctgtacaatgcaagataaaagtcaagtgcagaagtgaagctgcaggatccacgatgtcggacacgatattattgtgcagttag

SEQ ID NO: 14220 - DNA, 387 bp, Glycine max
  Peptide Sequence Number=SeqID_105905
atggacaggattcattatttactcatgtctgtattgtttttctcgaattgccacactgacccagcaatttctgctgcatcttcttcacatcacaatcacagaaacatgcccgtgagagtattggagaataccgcagcaccttcttctcaggtttcaggtgccaattcgggaaggagttcgtgccaatcttgtagtcttctaggcgttgggcagccagaaatcagcaactctgacttgattgagaccattgagttggaaaatcttctgataaatgcctgcatcaccatgcactctgctgaagcaagaaaagagagtagaggtgctcatgcccgtgaggacttcacaaaaagagatgatgagaaatggatgaaacatactttggggtaa

SEQ ID NO: 14221 - DNA, 945 bp, Glycine max
  Peptide Sequence Number=SeqID_105906
atggataatagcaattcagctgcaacgaccggtgtctggaatgattttcggtcaattgatataataataacaatacttatgaacctcaatgttgtggaccttgcagttgcctcgctggtctgcaaaatgtggaacaaagcttgtcatgacccatctctttggcgcaaaattgatctgtccgaactcaataactcataccttttcaacatacaaaataataaaccgggagcttacaagcattcgagggggaaaattactcaattcttaaagtatgttttgagtctgagtaatggaaatacaaattgcttaatatttaactacaatgttgacttaacggatgagcagttcatcatagctgctgaaaggaccccaaatctgaaacgactagttctaccaaagacatgtgtcttttcaagaaaagcagtgcatacggcaatgaagtcatgggggggcctagagtccattaccatttccttcgatgaccccaataaatacatattttctgcaattgccaaatactgcaagaacataacagagatgaaatttagtcacggttgcctcctctttgaagaaaattatgttaaagcgctgcttaaatgtgcccctaacttgaaggctttgagcattcggtgcataatgacaagcatgggtgctttgtgcggtgtgttcacttccttccaacatttggaggcggtgaatatatgccatagctccattatagatgcaccatattctgattttggtgttgtggatattacttatgtacaaaagcatttgccgccatcgaattacggaaagcttatatactgtaaagaaggatcatgccttaggtgcaagaatgacaggagcattattcctgccggaattttccaaattacaagcattcttatccatgcctcagaggatttgtggcgggaggacgagataacctctcttgcacattaa

SEQ ID NO: 14222 - DNA, 627 bp, Glycine max
  Peptide Sequence Number=SeqID_105907
atgggcatactgtatgccttttctggcacccagaatgtctcaagtgtacaaaaggatgaagcatggagagtaaatgtccgtatacaaggatgtgaccttgagcatgggtatttgtgtggcaccatggaagctcttaatgttcctatggcagacacaccagtagtaacgttctgggaaggggagatagttgatacaaagaactatactttcttcaccggtaaatgggaggcatctccagaggatgatataaggcactggtctaaatttccatctttttctcccttattgggccaagtggaggctgatggtggcaagtctttggacctgagcaactatccttacatattcatgaggtggaaggagcaatacttcgtgaatgttggaacagactgtggattaaccatagccggattttactacatttgtttctcttgcagcaatggctctatcagtggattctattatgatcccaatagcagcccttaccagaagcttgagttgaaatccaccaatgatggaagatcaggcacgttgtttgtgctagaaagttcgctgccagggatgcttcaatttctaagcacacaggcatattcacgttttctggaggagtgcaaaaaacaaacatga

SEQ ID NO: 14223 - DNA, 858 bp, Glycine max
  Peptide Sequence Number=SeqID_105908
atggaagttccttttatttgcaaagtgttttccagtgtggatttttattcagcttttggggtccacagggtgtttggtgcttttttttgttgtggtggtcccttatgtcttcgttggtggggtggtcccgattttgtattccacgggccaactgaagaacaaacagtgaagttaaagattcaccatggtgggatgttcatttatcagccatttactgtgtatatcaatggtcagattgttgaagaagaatggggttgggatgtggatactatgtcctatattgacttcatgaagctgattaactctctcgggtacaaatcattcaagtgcttatggtatagggaccctcgaaaagaactcagtagagggttgaagccacttaattgtgactctgatattttgcaattggctgaagatttttctggctttgatgtggtagaagtgtatgtggaccagggggtgtttgaaaaatctgcaaaaaagttgaataatgttaagggagatgaggtggagggtgaagatgaggcagaggagcatgttaatggacaacctttgactaaggttcaggtggaggctgaggttcaggttgatgaacaaggtttggtggaggttcaagtgcaaggtgaagatgaggctggtgttgtaggtgagatggaggttgttgttgaaggtgtggtggaggatgatgttgagattgaggaaaatgatgatgatagaaatggatattctaatgagttggatactccaaatgaaagtgatgatgaaggtcctccaaaattcagattttctcattttaaggtgcctgaaaatggtgaaagaatcacaaatcaattaagggagtcgacaaggaggacttag

SEQ ID NO: 14224 - DNA, 783 bp, Glycine max
  Peptide Sequence Number=SeqID_105909
atggataatttgctatgtgatgaggtgtggctttcaaagtctgcaaatacttttgaagaagttattagtgaccctgttgcactaaagagttatgaaaatgaagagtttgaagaggcttttgcagtgtgtctagagaaggaggtcttgtgcttgcccgaacctgactatacaaagtacttacactccaacaatttgatttttcctaggtgtagagttattcaatggtttatcaaggattgggaatactggatgcttgaattgctttctattgcatgcttatcaattgccataaagttcaatgagatatcaggactttcgttgcatgaaattcaggtggagggcttggactattcattccaatcaaacgtaattttgaaaatggagctgatcctattgaaggcgttggggtggcgccttaactctatgacaagtttttcttttgcagaaatgctaggttttgatttcttggaacctcatcatcatgtgaagcttatttcacgagtcactgatctccttgtccaagctactttagatcagaaaatgatggaattcaggccaagtgttgttggtatgtctgcattgtggtgcactctagaccagttatttccaccaacatcagacacttacattgcttatattatgagtatcttaaaccaaagccagaaggatgatatcatcaagtgccacaagttgatggaaacacagacttcaatgtgtgttgaaaatcaccattattactgccctttaagcccaacaacagtactattgaacacgcatgactag

SEQ ID NO: 14225 - DNA, 348 bp, Glycine max
  Peptide Sequence Number=SeqID_105910
atgaggattgctcagagtaggcggaaaaacaatcaggacaagaggaggaaagacctgaaattcgaggcaaacaaagcacctaatagggaaggagatttcattggtcaaggtgatctggtgaggtgcatcaggagaataagtcacgtgggaactagagagttagacacgggaagcctatccagccttgttcgagtcaggttcagaacccagctagacaagcgcactgagcgcaattccaacccgagagaaattgcattcaacatgaaatgtcgcgctcaacgtaaatcccaacttgagaggaaatttgctcagcgcaagagaccatgcttagtgcaattcctaacctga

SEQ ID NO: 14226 - DNA, 291 bp, Glycine max
  Peptide Sequence Number=SeqID_105911
atggtgttgaaattggggattctgtgttcaaatggtgcacccacttttaggcctagcatgagacaggtggtgaggtttttggagggagaagttggtttaccagacgagttgagaaagccaggagaggtaggttaccaggagggttttgatgaattcttgaactctctagaaccttcttccttttatcatatgagcacaagttcctatgatataaagacagacatggatgctaggttccctttcatcgatacatctctttatactctccatgctagaggagaaacaaggtga

SEQ ID NO: 14227 - DNA, 198 bp, Glycine max
  Peptide Sequence Number=SeqID_105912
atggagtcaaatgggatagtgaaactcacagatgattcgagtagagtaatgggtcaagctttatacccaactgagcgttgtgttcccgtgtcctctagcatgaggttcttcatagtcatccacctattcatctgctcccccgaacacaaagttcaagatcatcacaggatccaaacacaaacaacaaaccgggagtga

SEQ ID NO: 14228 - DNA, 939 bp, Glycine max
  Peptide Sequence Number=SeqID_105913
atgaaagaaaggattgagagcttgttctccattgaattcttgagatggattataaggattcggcttcgattaaaatgttcctctccatatggtggttcgatagcaagcaatgacgactcttggtggccactggtggtcgtgaatggtggaggaggagtttctaggatctcacttagcgaacttgtctcgctaagcgagaatctacttttggcgttaagcgcaacttttcgtgttgagcgcaaatccctctcagccaagcaagatgtcaaaaattgttattttctaaatcacaatggtcaaaataggaaagctttggttgtgaatctacaatataaatttgaagacgatccaatggttaacgaatatgggattatggttttaccagaacagcgaggcgaggctcacgggtgtgtcttccaaaggaggaaaatgcgcggagtcgccactaacgacggtattagcacctctcacgtcgacaaaagcggggctcttgctcctacgtatcctccatcgaagaagaaatcagacctacgtagttctttcttaaaggagaatttgccttgtgtctcaacttggatccatcacgatgtacagtttgcacgtgattttccacttctctctttggtgttctatgttggtaactcagatagtgttctttggagcgacctcttctttgatgtcaatcaagacttcttaatatttcttgctgctcatcgcaaggggttgatcatatcaaggaactcctccaaggtatttggtaacatttttgaaatggatacaaagaaagaagatccttccctcacaccatccttagtcgacatcagtgactcccagttgccggcctttgtctttggtctttctttactagtcgcaaaggcagacctaaatttctccttcaaatcccgtcatgaatcaatggatctcggtggaagagattga

SEQ ID NO: 14229 - DNA, 342 bp, Glycine max
  Peptide Sequence Number=SeqID_105914
atggtgtatgagactaaagcgatcaatgttgtggaaataggagaaccgaccttcaaaattgcaaacttgaatatgagccagaatgaaggcaatctcaaaactgagtttgatctcattgaagaaagagaaatatctggcataatagatgtgacattgaaaagaaaaacagcagccaagtataacaaaatggtcatcccacgcacctttgaagaaggagactttgtcttgcgcaaagctggcacctcgggaaatgggttcctaaactggggtaaaatcttacaaagtcctacttgttcagctacatgtaagcacatcgggaaacgggttcccaaaccggggtaa

SEQ ID NO: 14230 - DNA, 168 bp, Glycine max
  Peptide Sequence Number=SeqID_105915
atggtgattggtggcctatatctcttggtgttagtaaatggtctgggtgctgatatttggtctgcattaatgccatcaggtttggtgaattattttggaaaaggagccacgtacactgatcatggtgggatggcttggggcctgaatgtatattgttttactgtttga

SEQ ID NO: 14231 - DNA, 582 bp, Glycine max
  Peptide Sequence Number=SeqID_105916
atggagaggtatgaacgtcttgaactgaagctatcttcccatggaaggaagatgactaaggcactacccctgtcgatgtatcgtaggcgtctggacaaactgacccttgatgttgtgtgttggattccatatggtgaccactgttcatttagagaatttgaggtcatctccttgttttctgaccatcttagatggggtcccttggcggtcattcatcgaccggagagggttgtacgacagtttggatgcatccagaccattccgccacatcttgttattccttcggcttctgttgaagaaatggatgctagatggatgcaatttggtgattatattgcacctgtggggcaaatttgcgtagtgccagaccagtgttcgtcagattacatggagtggttctacatggatggttatgtagcaattgctgataaattggagaggctactgaacttgaggatcctgactgaaggaacagaagcctatactgttgctaaagaatgtccgagcattgcaagaagctacattggccaaccaactataggtcacagatcgaggcgtaggcggcgtatggatggtcattga

SEQ ID NO: 14232 - DNA, 816 bp, Glycine max
  Peptide Sequence Number=SeqID_105917
atgacacccaagaagaatgaatttataagaatcctaggcattagaaatgaagacgatgctaagaagggtactgctcatgacgatagagtcatcattagaggcaccgtcaacgaaaaagaggtgattgtttctccaaccaccaccgttgttttgtctgcatgcttggaggaaggtcttgtgtttgaccaaggattgggtacatctacttgggttgttgtaattgagaacaagagatggtacatcttttgtggattagttcaagtggagggtacatccacttggttgttcaaagagaacaagggaggatacatcccttgtggatctttgcttgtaaaggctgttggttctctttctccttcaaccatgcaagatggacaagtcactagaaaagaaggaagaacttttgagctggaagaaggcatcctagccttcaccaaaactttgttcgaagaacataaaagtaaggctaatgaggatgttcatttggctaccttggctggcaaggctgatgaagagattctagatgaagtggtgctggattctctaaaaaccttgtctactgaagaggttcagaggaaagttgttgaggaggataccatgatggacataaatggtcagccaatgcgtgaagctgttattctagaatccattgtggcatatctagatcccgcagagaaagaagcactggaggaagctatgcttgagtctttgattaaatcatctatactcaaaccaggtattaaagatgttgtagagacaaacccaggagttccaaggttgcatcataaacttgtgtctgaagttgatcacaaataa

SEQ ID NO: 14233 - DNA, 144 bp, Glycine max
  Peptide Sequence Number=SeqID_105918
atgaagcgtgaggggctgaagggaaggggttcaacatcatttgtgaaaaagaggctaagtcatgaagtgctaaaagtgacagttgagcttagctcatcaattgggctaagtgcgcatccaccgctaagcatagcttcagcatga

SEQ ID NO: 14234 - DNA, 693 bp, Glycine max
  Peptide Sequence Number=SeqID_105919
atggagttttatgctaacgcctggccgacagaagaaggagtcacagacatgcgctcttgggtgaggggccagtggattccctttgatggcatgccatcaatcagtttctggggcatccactggttttggaggaaggccagcgttgtgagttctcctagaggaggattcagacctccagctttaatgaggagtttatcacaacattctccccagcgaccacaactcagacctctccttgccaaagtgtcagttggtttacgccatcctgactcagggattacgcctccgagacacccagtggactcggagaagtccaacagggccctaggctttcctgctctgatcataggcctcttccagttctacagagtgtcggtcacccccaccaagctcatccagccttccatcaatagggaaggtgcagggtcaggcaccctagcagccagaggaggaccagcagtagccagctgcagatgcgccaccaccgcctctagaggtggtaccatctccaaggtccatttccaatcacctgtggaggatagaactctggatgcacaggacccgcaatggcccctggggatggcggaggagctcaggaggatgatgacatggctgacgtgttggatttcttcatctaacgaggtagagttgcacgaccaggatgccaaaaattatgattttgtttttatttga

SEQ ID NO: 14235 - DNA, 195 bp, Glycine max
  Peptide Sequence Number=SeqID_105920
atgggcgaggaagagaaaataccagaggaaaataaagtgaaagagaaaaaaacaaatgaagaagaaaagaaagaagaagagaaaaaactagaggaatcaaaagatgacaaggaatccaaggaggaatctgcgccgtcagaaatcatgcaagacacaacctttgcaatgcatggatactttaagcacgatttttga

SEQ ID NO: 14236 - DNA, 459 bp, Glycine max
  Peptide Sequence Number=SeqID_105921
atgacatttttgggagaaataagcagtcaggccattgtcaactctagattaacttttatttttccaaatggatcgattattcacaatgaatctggtgtttatttccaaagttccactttgatacccattcgagtacctaatggttatggtttggaaacactaaaaagcataatgcacaatacccttcaactaaccaatgatcaatatttggatgaaatttactaccgacagtcatccgcagatgcaggaaaaattccaaaaagatttgacattccttcgagatgtagcatcgacggactcaaggatgtgatcaagcaagttgcacctcaaggaattcccctttatggtattcaagaatcacaaatggccactgctttgcttgataatgataatgtgtattccacaacaacaccaatggtggtaaaggacaatggtctcgtaaaaaaacctgttacataa

SEQ ID NO: 14237 - DNA, 468 bp, Glycine max
  Peptide Sequence Number=SeqID_105922
atgcaacctgcctattcttcaatcatgcaaattgggggatgtgacatttgtggtgggacctatgagtcaggcatgtgcatggctcaagatgatacatctaaagagcctcccattcaagggcttaatctatatgagaagaccaccaagctggaggatactttgactcagtttatacaggtttctctatcaaatcacaagagcactgagttcgccattaggaatctggatgtgagtaatgaggaaggagagaaaaatgagagtaaggagagaggtgatgaggccttgcatattaagaccaaaagtcagttagctagggaggctagaaaagagataccctcaatcccagtgaaagacatcccctatcccttggtaccttcaaagaaaaataatgagcgatattttgctcggtttcttgacatcttcaataagctggagatcaccattccctttatagaggccttacagtag

SEQ ID NO: 14238 - DNA, 795 bp, Glycine max
  Peptide Sequence Number=SeqID_105923
atgccgctacactcaaaacggagcactttgactccccctttgtcgccaacgcccttgtctctctctacactaagcacgcctctttccacgccgcgcttaaactcttcaaccaaataccacgcaagattgtttgagggaatgccagtcagggatgttataacttggactgagatggtcacaacgtatatggagtttggattggttaatttggctttgaaggtgtttgatgaaatgctagagaagaattttgtgtcttataacatggttctggctaggttctatcgaaacgagcaaggttttgaggtgatgaggttgtttgtaagaatagtggatgagggtttggaattgacaaattttagtttgactagtgttgttgatgcttgtggattgcttggtgattacaaggtcaacaagcaggttcatgggtttgcggtgaagtttgggtttggatcgaatggttatgttgaggctgcgttgcttgacatgtacacgaggtgtgggaggatggtggatgctgagaagatatttttgagatgggtgttggaggagtttagctttgtggtttggacgacaatgatatgtggctatgctcggaatggacaatcggaggaggtgatttatcttttccacgttggtcgatcggatggaaaggtgattatggatgaagttgcaacagcttcaatgcttggtctttgtggaactattggtcatcttgatatggggaaaacacagaagaagaatactattctggaaacaggagggggaggactagagaggctagcaaaacaacaatag

SEQ ID NO: 14239 - DNA, 765 bp, Glycine max
  Peptide Sequence Number=SeqID_105924
atggggaccctgcgggacggggagcaaaatccccatccctgtccccgaattagctgcggggggtttttcattcccatccccgtccttgcaggaaatttttcccgaccgcagggccccgaatgggacagtccccgcgggatcccccgggttcttgaagttacgttcttctgggttctgaagtggatctgtatgctcaaattgttggtggagatttgcgatattgccaaaagtgttctcactataagcctcctcgtgcacatcattgtcgggtttgatcatcattgcatttggataaataactgcgtcggtcatgcgaactataaagtattcttcatttttgtcttgtatgctgtaattgcctgcatctactccctggtcttacttgtgggtagtctcgcttctgatggtgtgcaggatgaagagaaaaatagaagaagctcattccgaactgtatatgttgtttctgggctcttgctggtccccttatcgatagcattatgtgtgcttttaggttggcatatctatctcatgctacataacaagacgacgatagagtatcatgaaggagtgagagctttgtggcttgcagagaaaggtgggagtatctataaacatccatatgaccttggcccatatgagaatttgacatctgttttgggaccgaatatccttagctggctgtggcctactgcaaaccatataggttctggacttaggtatcgcaccatctatgatctcccaaaaggtgcttcgacgtccaaatga

SEQ ID NO: 14240 - DNA, 1002 bp, Glycine max
  Peptide Sequence Number=SeqID_105925
atgaggtcaggtcaccgagctaggcagcttctgcacgggtttaacaaaaaattccaaccaaatattattttagcgtttctattccaagctcagtggatttttgcgtctacattccaactgcatgttgacctcgctctgttccgagctccatcgccgttgacttcttgcccctccacctctcagtgctctggtcccatcaccgcagatccttcctcatttcctgtgattcctcctgccgcagatccaactcttgcaactctcatggcaacaacaacagcaatgattatctcaaagcttctctcctctcaggattcaaatcttataaactctttggatttcagggcatggatctttattttaagacatgatggccaagatgtgacatgtgaatatttttttgctgccatgcgagatgccaatgatgaagatgttgcaaatttcttgctatggcaagtattctcaagctgggatcattgttgtcaaattaagagataccaccaactccttaaggaacccacattcatttctgttgcagtgggtttgcttgattccactgacaaggacattcctctttcaactgtttatgattctatgaggcactgcaatctgtttcaagctgcagtcagagatgttcaggaggcttgtgtctatgaacgtaattttgaggagtatagcattgtgtgggctgaagctcggaagcaaaagtatttgccttctttggctcaaatgaaagctatagcatgttgggcttttactaaacttgactatggaaatgatgccaatgctctaaagaccacaacaacaaagatgggaggtggttggatccttgatggccaaaagagatggataggaaataatacgtttgctggaaggcataggtgggttgaatatgcagagaagacaagatataatgcctcccaggttccaactgaatggcatggttgggtccagttcataactgatcacactggatatgaggtttcatcttccaagcctaaatag

SEQ ID NO: 14241 - DNA, 231 bp, Glycine max
  Peptide Sequence Number=SeqID_105926
atgggccatcaagcattagaacagttttgttacacctattacaagttgggtagcaccatgataaagagagagaggagacgctacttcaaggagaagatgagtctagaagaagctcaccaccataggaggcaatggataagagcttggaggaagaaggagatgaatgaagggagaggaagacaagagcacaaaattttgtgctctaaaagagctctgaaatctgaagtttaa

SEQ ID NO: 14242 - DNA, 1259 bp, Glycine max
  Peptide Sequence Number=SeqID_105927
aaggtgatgccgaagtgcccttcccaacatcagagattcaatatgtcaagcaggctcttcaaacattcattgcatggccaaaaaatcttgtgaaaaaagtgtcacatgaggagtcccatacaagtccaaagaaacttcctaaaacagatgaaagggggatgaatgatattgaacatgatccattgcgtcaacttattaagagcctatattacatgtacgacacacctattgagttgaagtgggatggcagcaaatttgggcttccaaatgttgatgctttgttcttcttgacattctctgatgtaaatgaaatagtagcaggatacaaatgtttgaacatatctatactacaattatggatgttgtttttggatgagtggagctcaactttgggtcatgcttccgtgtatggattccttgagccacaatcgatacaccatgcaaaggaccgacgcactgaatgtgagcattacttacaagcatggctcaaggaatctcaacaagaggtgtacctaggagcttacttaaatcaaggtcattggcaactgctagtagtgtgtcctgtgaccaatgttgttgcatggttttgtttgttacacgttgatcatgctattattataagcagtgcaatgaagacaacaaacacagctgcgaatggtacaaataatcaaggaactcctaagtggattgaagtcaagagtcatgttcaaagcggagggtatgagtgtggctattacatgatgcattggatgtggaacatcgtcagtgggggtttaaagaatgattggaccatgtggtttcttgatggaacgacgttagacaaggaaacaattacaacgattcgccagaaatgggcagcatattttcttaaagaaagtcaactcaagtggggaatggtagcggctgctacaatagacagcagagatgaggaagaggttgtggagactctctatgccatggttggaatgttccctcacaatgcctccaatcataatagtacagatttagatggcaaatctttgcctgataattcatcagttttgcaagacttggaggataatgctagtgatgctcttcaagcctcagcaactgctcctgttgcaagtcctagttgtcatgaaagttcagctggagaagcttcaaaaaccagttggttgaatgaagttgttggtcaaaaacaacctgatttgcctgatagtgcaacgctcttgatgccatctcatagcaatggggtggtcattttttttgttgcattctga

SEQ ID NO: 14243 - DNA, 267 bp, Glycine max
  Peptide Sequence Number=SeqID_105928
atggctgacaacatgatgcctattatggagcaagggaaagaacaggctcaaaagcagttccttacattacgaaaacaaccaaaatctggacctttcgatactgtaaagggattaacaaccaacactattgttgttcttgatcaatctgtcaatccaacattggcaaagatattagagaaaattctagttaaacaacgagttctagtgtctcatgcaaacaccaatgtcaaggagatggtggaggtctgcttcaccaatatcaattga

SEQ ID NO: 14244 - DNA, 180 bp, Glycine max
  Peptide Sequence Number=SeqID_105929
atgaaggtttggagattagggaaaaagaggcacatcgagaggagtttggttgcacaatgtgactggtttacagtgttgaactggatttttggagagattgattgcacttgtattatcacatctaataggtatatggtcaagaaggattccataatcagaaagttgttgcttcatccataa

SEQ ID NO: 14245 - DNA, 579 bp, Glycine max
  Peptide Sequence Number=SeqID_105930
atggacgatgaagcaataaaattatctggttcaaataggagaccacattctgaaataactaagaactccaaaagaggaaatgcgaaagccaatatggaaactgacaatttagagtctgttcaggaaccaaaatcagaaatgcagttgaatactataccaaggaagaggggccgaaacaaaatcggagaaattagccaatccagaaaggctcgcaattgcagctctccttatccatcttctgaaaaactgacttctagaaaggataagttgcatagaatgcctaaaactattagtgaaactctagtttgtatgcagaaaagtgagaacatagcaaaagttgtccaatccagaaggactgaaaatattagcactgattttctagctaatgatacaagcgaagttcatgaagctttagcttctaaacataaagctgatgataatacggatgttgcttctgtaaataataactatcctgatggacgtcatgtcaaacatggccagccaaggaaaataaataacactaggaatcatcaagatgttcattccaattctgtgtcaatgttaaaggaagataaataa

SEQ ID NO: 14246 - DNA, 213 bp, Glycine max
  Peptide Sequence Number=SeqID_105931
atggacaaagacacactagggtatagtgggcagagagatttgaggaacctaggggaattagcgagtggcctcactttgctactcctaacgagctctaagactatgctttttgagttgggagatgaggggtcggtgtacgatgtatctggggatgagggggagggaggattgaaaggaggggaagagattagggaacaagagagggatgagaag

SEQ ID NO: 14247 - DNA, 240 bp, Glycine max
  Peptide Sequence Number=SeqID_105932
atggatcaattattcacaatgatgctggcgtttacttccaaacttcaactccggtgcccattcgactatccgacaaacaatttttggatgaaattcactaccggaagctattcaccgatacagttattatgcactgttggaagaacaccagatggaataataaacttacttcaacgcactaggccccgtactcatgacgcgatcctgtattacaacgagaaatggaacatgccaccgtag

SEQ ID NO: 14248 - DNA, 165 bp, Glycine max
  Peptide Sequence Number=SeqID_105933
aatccacttcagtttcaggccaaaagaagagaaggtctagcagctggtgtctcgctaagtgaggcatatgcgcttagcgagagacatccgctaagcgaggcactcagctcgcttagcatgataggaaaccctagaagaggatcaaccagaaatatgctcacctag

SEQ ID NO: 14249 - DNA, 56 bp, Glycine max
  Peptide Sequence Number=SeqID_105934
atgcaaggctctggtaatcgattaccaggaagtgtaaccgattaccagaagacagg

SEQ ID NO: 14250 - DNA, 333 bp, Glycine max
  Peptide Sequence Number=SeqID_105935
atgtttggatgctttcaaaacattctaaatgaattaagatctctagacaaaacatatgataactataatcatattgacataatcttgagaagtttgtctagaaaatggagaccacaagtaatagcgctaagggctctaaagaatcctgactctatgtcccttgaagaaatggttggtactctcaagaatatgaggaagagtttgatgaagatgaacttgccttcatctcatggaagattcgcaagatgtggaaaaacaatgacgtatccaaatggaagaattcctcaaaaagggtgctcaaggaaaagaaagataaagataaaagctccataa

SEQ ID NO: 14251 - DNA, 249 bp, Glycine max
  Peptide Sequence Number=SeqID_105936
atgaaagaggacttgaagaaattaagagatatgaataaagatagcgtcaactcccaaactaatgtagtaaaaagtgttgaagatgaagatgatgtgtttttggcaacaaatgatgaggttgctaaaacaaaatgggtgatggattttgctacctcaaagcacatttgtagacatcgagagatgtttgatactttgaaaactgatggagaattcaaccatttcaagttagggaatggtagaaaaatgtag

SEQ ID NO: 14252 - DNA, 1130 bp, Glycine max
  Peptide Sequence Number=SeqID_105937
atgaggtccttcaatggtgattttccaccatggagatgcagtggaaggcaaaggagaagaggagaggggaggcatcatccagtagagaataagccatggaagaaggagtttcaccaccaagaatgtgccttggataagaagcttgaagaggatgctttaatggaggaaaagaaagagaggggggggggggagcacgaaattgaagaaataaaagagggagagaagtggaactttgaagtgtgtctcataagactttcattcatcaaagttacaacaagtgttacacatgcttctatttatagactaggtagcttgcttgagaaactcgaaatctaccctaaggctcatgagaaccctagggccttcccttggatctctgacccaatctacttggagtcttctatccaatgcccttgcgggataggattgcatcatgaagcttatttgaatggatgcattggaaacaaacttgtggtgcttcgtctgcctcttcacaacaaaaacaactcctccgccattgctcacccaaccctattccatttccctcactccttcactccttcactcagtccctatcaaaatgcacagtgcaacgcacgccgaagcagagcgtcttctcagcatgcaatcccatattcgcgaccttggcttggactcctccttggagctgcacacagtctcggaggacatggtcgggcaaatcacaatctcaccggcccctttgatttaggtgtcaaatttgacggcgacatcgcagctgtaggagacattccagtgctagtcattgcaggtgctggaggttcccttgtctctttggaatcctgtcaagctatggcctcaaaacttctcaattctgatgaaaatcggaagtggaaaatggatagggagaaaatgaaagctgttagatgtggctatactttttccaatggtagcaaagttcccaggtataggacttacctagttcatgatgaaacacatgggggagcttcacagattgtgactagtaatgaaacttgcaatgttgttcatgagaatagcaatattgcatctgatcattttgaagcaaatccaactgagctgcagaatcagaagttgagtacagaaccagatgcatctggcaataaaccttc

SEQ ID NO: 14253 - DNA, 954 bp, Glycine max
  Peptide Sequence Number=SeqID_105938
atggtcgtgatgacatactcaacactaccattgggcgacttgaccatgggggtcgtgatccccgtgctcaccccaattgaggctgacatactagaattaggcgctcgtgtcagcataaagggaagtaaagttgaaactggtgtgcacccttcagagaaagatgttgctgatgtcataccaagtatgggattgtatgtgcaatgtcatgttggtacacagttggtggcattaggaaaaatacttcaggagggttccaccatacacagtgtggcttatgcagatgatatggatgcacaaattactccaaacaaagtggatgcacatgtgccaatgccggctgatgtggatgcagatgatctgatgtgtgggctgataaagttgagttttgatatttacaacaagcctgtagaatttgtgtttgatgggagtaaatttggaattgtagatggagctacatcgatcttcctaacatattctgatgttagtgaaataatggtaggtatatggatgagtggagttcaagcttgggtcatggttccgtgtatgcattccttgagccacagtccttgcacaatgcaaaggatagacatggtgaatgccaacaatacgttgaaacatggcttaaggaatcccaacgagaggaaacctgatattcatatcaaagccgcaattaacagtgcaatgaacaaattaaagatgacttcgcatggtgatactaagcaagctggacataagtggattgaagttaagagtcacattcaaaccgaatgttatgaatgtggatattacgtgatgcattggatgtggaacatcgtaagcgaggaggtgaagactgattggtccctgcggtttggtgatgacatgccattggacaaggacaccatgacaacaattcggaagaaatgggcaacttattttttaaagcatagagacatagggtgtaaaaaggcttaa

SEQ ID NO: 14254 - DNA, 279 bp, Glycine max
  Peptide Sequence Number=SeqID_105939
atgcaaggggcacctgttaaggtcaggcgacctattgattataatccttccttagctgctaccctaggcccaaggcaacctaacccaaacctgaatcagggtgttgttagcttaacacctgggttggccactggacttcatgccagcctcatttctcaaactcgtgcagtttcttcagatgagctcaaaaatgatgaagaatatgatgagatacttgatgatatgagacaggagtgctcaaaatttgggaatgcattcaaagacggttattacgaataa

SEQ ID NO: 14255 - DNA, 702 bp, Glycine max
  Peptide Sequence Number=SeqID_105940
atgttggagaacaaattgttcaatggtgttgcctatgacgatcctatgcagcacctaaggaagttcatcaagttgaccaacacgtggaatgcagaaggaagaaaaatgattggaggcgccatggataagagcttgaaagtaggaaaagatgagtcaagggagaagaagagaaggagcacgaaattttgtgcctcgaatgagcccatgggcccgaaatctaccctaaggctcatgagaaccctagggccttatcttgcatctctagtccaatcatcttggagtcttctatccaatgcccttagggggggtaacctcatgttagaaccccttgttgatgccattaagatcattgaagagatgtgctccaacctctataacaacttaggggatatgagggttatgaagaaaggcgtcaaccaagagaaagtgtttaaagtgtttgagtcggcaattaactcctcctcctcctcctgtacatgtaattttgtgcaaggcaccaacaagatgaaaacaattatggataaacctcaccctcgtgtggggaaagaaaaccctcaaaggaagaaagtaattcctaaatacactggatggagtaaggaaaagggagataacatcaccattcaagctcttggttatggagtggatgattatattggtggatcaatgcaaaaagggaagatcaccttgtttgagggtggttga

SEQ ID NO: 14256 - DNA, 138 bp, Glycine max
  Peptide Sequence Number=SeqID_105941
atggcatttgggatgaaggtagctcgcccaggtgagctgttacttcattttgaagcaaccttgctcgcccaggcgagttggttacttcaccatgaagttattttggtggcgcaggaattaatgaagcattgggcttga

SEQ ID NO: 14257 - DNA, 258 bp, Glycine max
  Peptide Sequence Number=SeqID_105942
atgtttaaatccatactaggagaagcacctacgtgtactgatgacttgccgcaagacgtcccaaaggcatctgataaaactttacgggatttgcagctggactatttggatctctaccttattcattggccagtcagtgcgaataattggcagcttaccaaacctgacatagctagcacatggagagcaatggaggcactctacaattctggcaaggctcgagatataggggtcagcaaatgtgcctccagttgttaa

SEQ ID NO: 14258 - DNA, 324 bp, Glycine max
  Peptide Sequence Number=SeqID_105943
atgggaggagggcttcctgctatggtggaaagggagaaatttgatcatatagaggaaaggttgagggtcattgaaggaggcgaaaattatgcttttgttgacatggcagagttgtgccaagtgcccgacgtggtcattcctctgaagttcaagtatcagtacaattctgatatggctccagatagaatacagttgcagaacatgtgcaaaagggagcatgaatctttcaaagaatatgcccaaaggtggagggatttagtgtttgcgagtgagaggattgaagtaggcctaaaaagaggcaaatttgattacgctgctcgatga

SEQ ID NO: 14259 - DNA, 942 bp, Glycine max
  Peptide Sequence Number=SeqID_105944
atggcaaagttaataaaattctttgagttgaacacaggggccaagattccttctgttgggttaggcacttggcaagctgagcctggtgttgtagccaaagctgtcaccacagccattctgaatactaattcaactgaagaatatttctccactggttttagtttttcttatgatttgagtttagttctaattcttgttggatacaggcatattgattgtgctcaagcgtataacaatcaagcagagattggttctgctcttaagaagctttttgatgatggtgtggtgaagcgtgaggacttatggatcacctccaaactctggtgttcagatcatgcttcagaagatgtgcccaaagcattggataaaacattgcaggatttgcaacttgattaccttgacctctatctgatccactggccagtgcgcatgaaaagcggatcagttggattcaagaaggaatatctcgatcaaccggacattcccagcacatggaaagcaatggaggcactctatgactcaggcaaggcaagagccataggagttagcaatttctcttcaaaaaagcttcaagatctcatgaatatagcaagagtgcctcctgctgttaaccaagtggaattgcacccaggatggcagcagccaaagctgcatgcattctgtgaatctaaaggagttcatctgtctggatattctccactgggctcaccaggagttctcaaaagtgacattcttaagaatcctgttgtgatagagattgcagagaaattggggaagacaccggcacaagttgcccttaggtggggactgcaaacaggtcatagtgtgctgcctaagagcactaatgagtccagaatcaagggaaactttgatgtgtttgactggtctattccagaagaagtgatggataagttctctgaaattaagcaggcgagtagttag

SEQ ID NO: 14260 - DNA, 540 bp, Glycine max
  Peptide Sequence Number=SeqID_105945
atgaggggtggaggttgttcagcggctcacccaggcgagctggttacttcctctagaagtaatcttgctcacccaggcgagttagttacttcagccctaagctttttggtggcccaggcgagccagaggctagcctgggcgagccaagggcctgaaaaacagctggtgccaagcagctcaattcagctagcaagaatcaaaacgttagcaaatgaaggtccccagatgaaattagggtatgacaattgcacaagtaaaagctctctgctctcaccttacattagccacccaaagacacaaaacaaccaatttcctctcctttttcttgctttaaccgtgagcccaaaggaggagaaggaggagccaattaaaaattttgcacttcaccttgtgggtggtgccattgcaaggctgagaagcttgcactctcatcttcttctcttctccaaattgtgtgaactgaacctagggtacgggggagttctttttatgaactcagcccatgatttccttggggaggaggcaaccatggtgaagtga

SEQ ID NO: 14261 - DNA, 303 bp, Glycine max
  Peptide Sequence Number=SeqID_105946
atgcccactactcacacttctaatattaattttggcaaggatgagttgatttatgatcactcagttggtgagggcagacactggggtccttggattcccagccttgattactcttctttgccattgccaaggggtgccacatatctctccaatgttgaagcactttgggaggcttatgggtcaagcctacttttcttgatgaggagggtgttgcagctactacgaaggaagctggagattgaagtgatgatgatgatgcaaaggaatttggaggagatggagatggacgagtgttggagttga

SEQ ID NO: 14262 - DNA, 2280 bp, Glycine max
  Peptide Sequence Number=SeqID_105947
atggcggacgacaaactctccttcgagtgcttggaccgtctcgaagctctcattgccaacctcattgccgcccaactccattccatcgtgattctcgattccatagtctccaaactcaatgccattcttctgaaacgacatatctcgatcctatcttcttcatcgatcaacagtcaccacgttgacgaggaagttcccaacgacactgtggaggaacttgtctctatgggttcgtcagagttgtcttcagaggtgccccctctgcccataacacacggtgcggcgcaagcggtgtggttgccgtcgcgacccgtatcgacgtcggagttctcggccaagttgccccctctgtgtttcgcattgaccacccacactaccgccacggccacgaccactgcaacacggtccccctacggcagcgtcatctggcatagcggtgttgctaacgcgttcggcccctgcgccactactagatattcacttgcctctctcccacgaccactgtatccgccgtcgtcacccccaccacctctgaaaccaccgcctccaccacgagcatggtcggcgcgggtttgcgccttgtggaccgtgatgttcggccgtcaaggtcttggccgtgcaaatcgcttttcacaactatcactccctcttggagcagcagctagagctgctggtgtttccacgagccacaaccaagcagaggaaaggcgcagggatgggattgatgctctacggcacaggtcaccacccagcccactcacctttaggatgttggtaaccctagaggattattattggcgtgggaatgttatgaatcaaccatcagacaaacctaaccatgaggaggcaagcgctaacagaataggagcaggattgctgagctggcattgcgggattgggcccttggatgatcctgtcgggaatatgctttttctgaattctgggcctcgaactccagaaacaccagcacccataacaatttcaattgttagggtaagaaccctaaaggctggcttcgagggcaatgacctccagaaagaagagaaggaagggaaacacaaggaatattctagtaacagaattcgttttgcaaatttgcccatgagggagcaaaatgccacaagcaggatttggtgcagatcttcctatttttctcttccgaaattgccctcaaacgtagtcttcaagcgtgttcgtaacaactcctctttgtctgctatgcttccctatcactccctgccccatcaaaaacaccttgtccgcaaggcgttgggttttcagactaaggccttcaaaaacaatatcggggtcccaaggcttatgccgatgaagtgtactaggaaatccagcaataggcaagcgcgaaacacccttattgtgccgatagaggtggcgaaattagtgttggggaagaagacgcaaagtgatggcgttctcgccctgcaattccacgaagcgtccgtgatgaaagaacatcacgcagcaggtgtgggttttgggtttgggtcaggtgtgggttttgggtctggtccttcggatacgggtgtggctagcttcgggttaggttacgctgtattaagacccaatgggttgtggcacagctcgtgctcatggcgcgaggctaactcctccggggtgagacgcctgacggtcggagcctgtgacggtggcggcgaagaaggcagcaaatggggcaagggcgtgatacgaggggaaaccaaaggggctgacggtggagctaccagcggtggggtttgcggccacggtggaggtagacaaaggtccgacaactgctacttctggagcttcgcaaggccggcggcttggtccacgggggtcggcaagccgataattctattaaccaagtcttcgaactccttcaggaacaaaggtggagtggtgaggaactggtgtgggtttaggtgtggtggcgaaaggcacagaagcatggcagtgaaaaagcttgtccatgttgagggtcatagagtgcatgtgattgtcaagacgagcaatggcctcgtcgaggttgcggaaggccacgaggacaaacgagagcaccaattgttaggtgaacttagcaatcagctcttcaggaatagaccagttgaagacatcaaaattttccttgatcctagcttcattagaggtctttggcagaacactatgtcctgtttgtatgccccaccgaagggatacttgtgcaggtgtcttccccaatttctcagcaacgaaattgataacaggattcttaagcacatcactgttgagaaatccttgtga

SEQ ID NO: 14263 - DNA, 570 bp, Glycine max
  Peptide Sequence Number=SeqID_105948
atggctgcagctaccgctaaggtggctgaactggcaacaatcgtattggtatcgacgacagtgatcatggtagtgatcatgatggtggtcggtagtaatggtgacgatggtgataattgtgtcttctggttgggttggccttatgatattgtcatcttgttactgacgagaatgagtccattcatgataatgctacatggtaagattgatggaaacttggtattggggatcaatatagttccaaatcttatcattgcgatgatgccaaatgttccaaagaagcataacaaactttacttggatactctgagagagcttatggaggagtttgaacaccgaacctttgatggttttggcaatttggacttcattggatatgacacttactgggatgtgtttgagtccaggtggaggtggtgtggtgatgaaagggtagtgggggtgttggaatcagctttgagaccaaacatttatcttgtgatagtttcccaatttccattgaagaccttccttgatcaatacttgagaggcatggatgttacaccatacacagctaggattgagacttaa

SEQ ID NO: 14264 - DNA, 231 bp, Glycine max
  Peptide Sequence Number=SeqID_105949
atgccaagtttatcaagggattttgtagagactagactacctattaaggaaggattccaaccacatcgacacacccctagacgttgtaatcctcaactaatgcctcaaactaaggcagaaatagagaggatgttgggggtagtgtcataccctaatttcgtccggggaccttttcttgatgacatgcgacttttgtttggtccttgtgaggtgcttggaacccatcattag

SEQ ID NO: 14265 - DNA, 744 bp, Glycine max
  Peptide Sequence Number=SeqID_105950
atgcattgcccgaaggaaaacctcaataaaaccacctctcaagtgaagaccataattgaagatttggccgatagtgagagaactgtagaaacaaatcggtcaaatcccctcaaaggtatgtatgaacttaatgttcaagataatcttttagctcttcaacaaaagatgcaggtgcaaatagaagtaatgactaaggcaatccaacaaattccgcaacaactccaaggggccatatcaaagaaactccaccaagcgttcatgtgtgaagaatatggaagagaccatcaaacatcaaaatgcaccaaggagggcaattggccaaacaattgtaaacttcttcaattggcttttttcacagccatcgagaagaacctaaggggccattgcaaggctattatctgcaccatagagtgtgacgtgggaggtgaagaagaagaagaaaaggtagaagaaagcaccatgctagaggaagagatgaaagcacaagccaactcttcaacccaaggtatgcaatcctcacttaatcctcaattgtttgattttagcaagctaagaatccataagcaaggacacgatgagagaatggacaaatttgagaaatacatggagatgctacaagggaagaaagaggaaccacctattgaaaaactcacatgggacgtgctacatcaagtaagaccccataagacatttgttggacaagggatgttttaccatccccctcacattgggaaatccctctag

SEQ ID NO: 14266 - DNA, 687 bp, Glycine max
  Peptide Sequence Number=SeqID_105951
atggcagaatcatctaagaagagaaaaagctccacctccaccaccaccgctgcaggacaatgccgccacgacacttctggtgacccaccagcaccacctaattcctctctttcctcaccatgttcattaactctattttcttcaaacgaacagcgtcaaagtcaaggtgtaccttttaagggcactttggttgatgactggaaacatatttattcaaatcatgatgcccacaaaatggtgttcaatgaaaatgctgatatgaccgacagattgcttgctggttcattcacttttgaatgttgtatcatgcactatattctatgtcgtattttgcttccttgttcaacaaatcttgctcaagcctctgaggaggatttaattctattgtgggaccttcaaaccggtcatcaaattgactcggcccatcttgtctggtaccgaaaggatatggatgaccaatctgtgcggaaacaataccttccacctctgactcctgatgaacgaacaccttccccaccgccacaaagggattcctcgtcttcattgttgaatgatgttctcactgaacttagggatcttcgagcctttgtcagtgatcgtttcgatgctatggattcacgaatcacgtgtcttgaggatgatatgagcttcattcgtcgatgctttgatcctctagcagatccatag

SEQ ID NO: 14267 - DNA, 1203 bp, Glycine max
  Peptide Sequence Number=SeqID_105952
atgggtggttctgccaagtcttggcaggaccatcgacactacaccgaagtctggtggcagccgaatgtcactagaggctttatgtggttggaacaggaacctctagttctagccaaagagacgtggccggagactttaccgccatataaagtctctggtgtcacatcatcattcatgtacacgaataaggtagggttgcaatttgcaatccacttggcacgaattctaaaggagactttccagttagggctagaaaacgtgaggtggtttgtgatgggagacaatgacactgtatttttcacggagaacctagtcactgtgcttgcgaaatacgatcataatgaaatgtactatattgaagacaactcagagagcgtggaacaaaacgtggcacaaacctatggcatggcttttggtggtggtgggtttgccataagctaccctttggcagaagtgctagtgaagattttggatggatgcattaatcgctatgctgtgttgtttggctctgatcaaaaggttcacgcatgcatgagtgagattggtgttcaactcaccaaagagcctggttttcatcagactgacgggcttctcgcggcgaacccaatagcgccacttgtgtcactacaccacctccatgcttcagagccattgtttcgagacacaggtcgggtcgagtccttaaaaaggtttgtatccgcatataaaatggatccaggtcgaatcctccagaagagcatatgctatgacccgaatcggaattggacattctcagtgtcttggggctacaatgtggagttgtaccgttctttagagacgtccattgagttgcaaacaacgtttaagacttttcaaacatggcgtgggtatgaggacccgttcacattcaatacccgacccgttatccccgaccagtgtaagaggcccgtggtgttcttcttggatcagatcgaagatgggggactcggggaatggactgaatcctcgtataagatatatgacaatgttttgctcgagaagtctaattgttctctggaagttcaatatgtcaatgtcactgcctcatactttaggcctgagctgtggaaaaaggcaccacgtagacaatgctgcgacataatcaaaggcacagatgaagggagcaatgtggtcgaaatcgtgatcagaggctgtcatcaatttgagagtgtcactcctccttaa

SEQ ID NO: 14268 - DNA, 228 bp, Glycine max
  Peptide Sequence Number=SeqID_105953
atggccaaaatacaaggcccaaaaagaaggaaaacctattctaatatttacacagaaaagtggacccaaccttggcccatgggatcagaaatctaccttgagattcatgagaaccctagggccttaacctgggtgaaaatggactatggaagcgcacaatgtgggtacgatagtcagagatggggaaggtgtacctggtggcgtggactctacatgccttttccataa

SEQ ID NO: 14269 - DNA, 66 bp, Glycine max
  Peptide Sequence Number=SeqID_105954
atgaaaaggcatgatgatgtggcactccgactgtcacctcataacttaacggaaggctatgtttga

SEQ ID NO: 14270 - DNA, 93 bp, Glycine max
  Peptide Sequence Number=SeqID_105955
atggatgagctcatgagagtgcacaaagaagactatattgagcttcgggagtgctttgagcctacctcagaaaggatcctcttggagacttaa

SEQ ID NO: 14271 - DNA, 1284 bp, Glycine max
  Peptide Sequence Number=SeqID_105956
ttgcaaaaccagcatccagctccatcgccattattgattcatgaggttagggatgacgaagggagtgaggtgcagtggagaaggatggaggcaacaaaagcgagatggggcaacgacgtcgaggagaaggcgtggtgcatcaccgacgggaacaaggtcatgcgattacatttcctaggtttcgtcgaggacagtgggccctatgacggtggtggttgtgtatggtcatttctagaaaagaagggggtagtgatttgcactttctctggtgcaaacccagattttgttttctcggtggcacaatggtgggatatgaggaatatgaaggctcagtttctgtgtgatgctaattctcttacttatgtgcttgggcagcctaaatatatcttgtattctgcgaagaagaagctgagagagggaggtgatgattttgattggaatattgatgatgagcttgagattgagaactataactcttcatcttcatgtttaacccttcctaatggggatgctggagaggcaagctcgtctacagttttggctaattccaaggtacttgaccacttcgtcaacatgggattttctagagaaatggtttctaaagtaattcaggaatatggtgaagaaaatgaagataaactacttgaagaacttctctcatacaagccttactatgctcttcctaattggggaacttcatatagagacttcgttgcagatgtgaaaagtgaaaataatgccaagaaagcatccaagtatctagctttgcatcttatatttgaaattgacatgatagctcattctttatgtgaatttgcgggaggtgaagaagagaggaaagaattggaagcatatcgtgaaatccatgttcctacattgtcactgctgaagtggactacaaagaaaagtcccttactcgttaaaaacaattggaatcttctgtgcatattaccttctccttctaagctcaggtctgaaggcctatgtcctttgacactcgaagaatccatccttatgcttggtgctcttggttttaaccgcaaaatgcacatatttgtagttggttttaatttgtacggaggtggctcacaattggttgctttgaccaacttgtaccctaaattagtcaccaaagagaacttgctttcttcagctgaactcgaatcttttgctaattattcctctcaattagcagcactggacttcataggctgcactgcttcggatgcattcgccatgactaattcaggaagtcagctatcatctttggtgtctaggtattga

SEQ ID NO: 14272 - DNA, 312 bp, Glycine max
  Peptide Sequence Number=SeqID_105957
atggcctcttatgttggattgtatgatgctaaggctcttaccgactggtcatgccttgcatctatcggattgccaagtcaacactatggaaacacgagtataagcttgacacctttatccataagaactctcaagtcagcgagcatacctcaggtaccattttatgaggccatcccaactctaaggatttactcctcaatcagtcatcaccgagggtttactttatcgtcattgtggggcccgactgctcaagtattgaatgtcgttgaaagacaaaccaagtccgaaaatcttctcgacttaaaatcataa

SEQ ID NO: 14273 - DNA, 255 bp, Glycine max
  Peptide Sequence Number=SeqID_105958
atggataaaattcctaggcatttgtgtgcgtctttgtggggggatgaagagtttgagtggagagaatctccagctaaaatgtcagtggattactttgcatttggaataaagaaaagttggtggtcaatgctacatttgttgggaagggctacttgggagtgcaaggagtttggaaacaagtggatgtaccctccactagaactgatccacaagaagatgtaccctcttcttgttctcagtcaacaacccaagtag

SEQ ID NO: 14274 - DNA, 213 bp, Glycine max
  Peptide Sequence Number=SeqID_105959
atggcccgcaccaacaaaactggccaaatgacgtttgaggcagcaaaggaaattgctgacaagattgatgtactgactgttgccattgggcgaccagaacaccctgattgtgtgtgtgttgctggagtcggtgtcacgatcaagcaatactttggattggctccaaggaactcctacacgtcttcggccatggctcctgaagacttggagtag

SEQ ID NO: 14275 - DNA, 2274 bp, Glycine max
  Peptide Sequence Number=SeqID_105960
atgaaaagagaaaaacatgcctcctatagtagtcataactcttgcaagagcctaagtgaagaacttcgtgactattacgaaggaaggcataggtcacatcttagacctcaatcccatagaagagaaaaggaaagaaagcctcaagaggctaacattaacctcccatacttccatgggaaggacaataaagaccaaggtcaaggcatcttaggggtgacaccttctaagcccaaagatgataaagggaagacaatagaaaagcaagcccctaaggctagtatgcaagagaaaactagctctataaagcgctttaaatgtcttggaagaggacacattacttctcaatgccccaccacaaaaaccatgattatgaggggccaagacatttatagtagccaagataaggctactacttcaccttcctctagtgaaaatgaagaagcaaaaggggaagaacctagtgaagaaatctacccccaagaagaaggacaaccattagtggttaaagagaagtgtaaggagacacttgctagcattgccacacctgttaggcttgagtttattcctcaagtaaagaagttgttggatgagggtttggtttgcaagagcttaaatccttgggctttgttggtgcccaaaataggtattattaggcaccaagtccctaaaatgggtggggttcccatgaaccctaagagaataaaggtcattcctgagtggcccactccaccaagtgttgagggaaggagcccagagtatgaagaacctcgggatttgaggtcaaatcctttccaagttctagcttctcatcttaaggaggtgagcttagctattagagagggtggaaaatcaccattaaaggacctcattgaagctcaaagatccagcctccatagaagccccacaagcaagcttccatcactaaagacagtggagagttttcgctacacccttgtgtccacccgaggaatgcctaatgggtgtcagggtgatgacgaatgttatggagtaggtcacggaactccgtgctatgcttctgtgattagtgatgatgatgaaaggatgtttggaagaagcaccatgcccatgaccgaaccggacatgtctgattccaatgtgaaaggctgcccaaaatcaggggaggccaaaattggtgcttccgtcatagcttgcttcagtttgtcaaaggagtgcattcagggtgcgatagtcaacacaacatctccaactttcgtccttcttcttgaccaacagcatcgaagaggaaaaagggttgtgattgacctagatgaggctcgcatccaacatagtagaaatttgtttctcaagctcaattttctggaagtgaaggtaacgctatggtctaacgttcacgggcttggaattgggaagaaggtgaatgtgaagggtgatttgcttagggtgacgaaaaggaaaaggtgtggacagggttgggtaagggagaaatgtggaaaagaactgagacgctttgtgtatgtaagagacactttacttgttgggcctaggctgaggctgggtggaaagggacatctacgtgaaagtggtaagccattgtatgcccaggatgatggtggcaccgttcagggtcaaggtgtacaaattgggagtaaaggtgtgaccctgaatcacgagtggcacctgggagcaaacactggtgcaatagagtatcccatcatagccaaccacgacgcgaaaggtgggtatcagagtggtaggaaggtcaaggaatttggcaaccctattttgcacaaaattgtgggtactatcgccatcgaccaaaatcgtaacgcgatggtggttgatacggtcataaaagcaaaagtcagagttgggtgtggggtcggaatcagcatcgccatcagcaatgaaaagctgaatggggttggtaaggctgaactgaaagactgcgtccggcgtgacaatgatcggtcagtttgccttcttgcaacttttccaatgccacaacctgaggaagcattagcagttgaagggcttcctgaggttcaaaccagagatgaagcagctgagaataaatggaagggccaggatgacagtgcgatttgcaaactttttgaactctatgaggggaaggatgaggtggagatggaggcaaaggggatagcgatgaggccaaagccgtggaaagggcagccaatcggagttctagccttgggtccatcggttgacggcttcctcaagatgatttgtagtagtttgacaggcattatgatctggcatggtgaagaggagtag

SEQ ID NO: 14276 - DNA, 978 bp, Glycine max
  Peptide Sequence Number=SeqID_105961
atgctggtggaggcacttcttactttcatgggagggtgtagccttccgctgcttctccggtcggggaacttgtttgatcaccataatttgtctcccttctgttcttcggggcaaggaagagtggtggtagggacgatagggcatccccctatgtgcggcgtaaccacagtgctgggtcaccatcgtccttttactgttgctggctatgaatgggactcttgcaagatagccatccaagcttgtgggagtgacgatttcccttttctgagggcaatgttgggtagtccacccttcttttttgtgtaccgttgtttctttgatgttctggacaagataggctgggtttccttgaacactctgtccaagaagttgtttgagtttgacttgaaaatattttgccacttcaaggaccatttcttcaaggccttggctactgacatcatggttgatggattgccattgatgttcaacagggacagggagcctcgcttcccattctaccgacagtttgaccccaccaggttcaagtatttcgacgaggatctattgacccttgtggagagggtcgacaaagttatattggagcaactaccgaccttgctgggtgtgtgggccattttgtctcttccttcggcggatgatcctttcgctatcttggatggaaaaatgccttaccttgtcctcttttgtgtcagaggtgggactgtcccatcgtctattgttgctccttttgttggggaagagggtcaacctgctgttgaggttggccctactgctaaagttgttggggctgaggttgccatatcgagggccactacttgtacattctggagaatggagcgccctaaggtagctaatgccataatcgccttcgctaaagctgtgaattcgaaccatcaactatcttccaagggcgaaaaattgttggctgacaaggtgaagagcattgtggctgaggaggatgctggcgaggagtag

SEQ ID NO: 14277 - DNA, 1029 bp, Glycine max
  Peptide Sequence Number=SeqID_105962
atgataggcccagagtatattgttggctacctctgcctgaccattggtttggggatgttcaacagaggttacgaggtgaacttctccacctcgttggctgtcatttctcatagtggtcttgcctcgatccacttggtgaagctaaggggagctcaagctattgagattgtcaagagggatgcatggaacattagcaaattcttggcatcatttgcatcgcttggtgaagtcgagggcgttaaccctaagcgtcggccaacagtagccagcatgcaccaatttggtggcaagggagcgtcccccgatatgaaggccgtagatcccttcatgaacttcccgcatgacatagtctgcctgttggctattcaagtatttgagaaaggtttgaagtatctccaagaagatagtcttgaggtgcccagtctttttggtgctaaccagcttggagaacaggctttgaagttaagcttgagggcttgctctagagtgacattgccagggccttcaaggatgattcctgccttgcttcccttcacgttggacctttcgcaaaacctatttgatgggatagttcgtcttgactaccacttgatgactctgaaagtatggcctgagacgtcgggccgagtgcttctcaatgtcatggagtatgcggctggtgaagtagatgagaagttagagcttccctttctcttgggtacccctagcctgggtcgactcaagactggtggtaaggaaatggacttcctagacattggtaggactgcgcatctccagtatgattgtgcatttgtcggggtgcatgttgtatttatggatttttctaaatacttcttccaggtttgccacgtgttgggctatgctatgggatttgatgaccatgttgttgacatagaccttgacattttttccgatctgctgcttaaagacccggtccatgaatctttggcgtccaagaacccaaatgcaccatcaactagcctgtcgatgttgggcaaagggtatgcatccttgggtcatgccctatga

SEQ ID NO: 14278 - DNA, 690 bp, Glycine max
  Peptide Sequence Number=SeqID_105963
atgatatatgtgagtgcattttctcgagctttgaggcatcactttgcaaagattaaagatgctgacagtgcaataagattggaaaagatttgggttgaagaaggtcttcaatctgaacaagttgctttggacttcattgttgctagatcctatggttcttttagggatgttgaaactatgcttgatcaactgagtttgcttggtaaaataattactatttccttagtccacaagctttatgttttgccctttgtttttctgctgactggggtcatttctgatcatgaattgcttgatttgttggacttggctttatcaactgacacttcaaatacaattgtaaatgtgaacttggtgattttgaaatcaaaacaagattttgcaatagatactcttatgttgatatttgcaatacatttcctaaaggggacaacttggagcatcttgctacaacaggttaaaaagaggataagtcatgaagtgctaaaagtgacagttgagctcaactcatcagttgggctaagcgcgcatccatcactaagtgcagctttagcgcgcttagcgcggcagaagaatctggcagagcatcaatatcaaggccgtgctaagcacgagattagtgcgctaagcgcaacagttgtcttcagccaggctcagcacatgactggcgctaagctcaaatccacttaa

SEQ ID NO: 14279 - DNA, 456 bp, Glycine max
  Peptide Sequence Number=SeqID_105964
atggatgatgcaaaagaaatgaagacacctctgcctccaaccatatatcttggattggacgaggaatcgaagaagtccctccaacaagcgtccaagggctgctcaaacaaagaggagtctctagaagcaagctacagagaataccaagtggaaaaggcacccccttctggtaaggaacttatccttgcgtccactatgcctaggaagatgaagaatagggcaactcgagctaaacatgtcattcttgacaaatcatggacaccatctacccaagggtcaagcttaagtgatacatcttctagtgaatcctttatttctgaaaaggaaatgcatccaccttctcttccaaggaatcattcacctccatctccacttcacttggacagcttaatgtggctccatgtagagcttgtaggccttggatcttcttcatcaatggagtcctttgcttcttga

SEQ ID NO: 14280 - DNA, 247 bp, Glycine max
  Peptide Sequence Number=SeqID_105965
atggcttccatgatggatgccatgctaggaatgagacaactaatggagaataacgcggcaaccgccgccgctgtcagttcggttgccaaagcagacccaactctcccagctaccgtgcaccaccctatcccaagcgtggtaggacgagaaagaagcacactggggcacatcaacaaccctcatccggtgtacaaccgagtagcttacccctatggattaccacctaattacacaccaccagacatac

SEQ ID NO: 14281 - DNA, 510 bp, Glycine max
  Peptide Sequence Number=SeqID_105966
atggtctgcaatgaccaggctgacatgaccggaagattacttgctgggtcattaactttcaattgtcacatcatgcattatatcattggttgtattttgcttcctcggtcttcaaaccttacccaagcctctgaggaggatttgattctgatgtgggcttttcaaattggtcgtcagatcgattgggcccatttagttcgataccggatgtataaggcattatgggccaatgcacctatgtcttatccccaccttgttactctttttcttcatcatttcaatgttcctttggatgatgaaccatatgtcaaggttaaaagatcgttttccattggtgtcggtgtggttacctcctttagttatcgaaaggatgttaatgtactcacagagctccgcgaccttctagcttttgtgggtgagcgcttcgatgccatcgatatcaggattactaggcttgaagatgatataagcttcatcaggcattgcttcgatcccccaatcgactcttag

SEQ ID NO: 14282 - DNA, 320 bp, Glycine max
  Peptide Sequence Number=SeqID_105967
atgtctcgggacttcatttattgtgcaacaagggacgccaagtacctcaaagcggctaaccaaaggttgcatgtcatcaaggccctgaggataactttgttgcagcctctgcctaactgtgggtctaaggatgttcaactatttaggtatttgagcaaggggggtcatcccgttgtgtttcttctcttctccgaccataacttcctcagtgtctatgatgggagtttggagtgtctccatgatgatagtctagagatgcctgatttttttggtgttggccaggttagagagcaagtctgctctagtgttgctttccctgg

SEQ ID NO: 14283 - DNA, 561 bp, Glycine max
  Peptide Sequence Number=SeqID_105968
atgggtgttggagatgtaggggttggaactaatgcatctgaaggagctcgggccttggccttgcaggaccctggaaatgtgatagaaggatcctcaaggttccagcagttcttcctaatatatgccaaattaatggtcgggctcagagactcgaacgtcaaggaatcagacacaacccctctagttaagcataatgtggtgataagggatggaaagcccaaccaagaggagttggactgggcgatctgggatatctggcctgaaattatagagcccatgtccatgtccatcttcatgaccaagccatataccaaccttgctctttccatgttaagattagagcgggagtatgctgagtatctctcccctggctcaagcaccactagggtctctagaaaggtgttcaatgtggcagcatcgaatttaatcgtcttcccccgcactttgcactacctgggggagcggtcttctggatcgtacaagttggagcagaactccttgaccaaagctaggtcaatgtggttctccatttgccttgtgaggttcttgtgccaccggtga

SEQ ID NO: 14284 - DNA, 141 bp, Glycine max
  Peptide Sequence Number=SeqID_105969
atgttaaaagtcataatcattgtctcagtcctgaagcacgaggagaaacttaggcttggcatccaatgtagcaatttcaggtctaccttcaaggctgtgattttgaatggagcagtcgtggttgtgaaggtccttggttaa

SEQ ID NO: 14285 - DNA, 138 bp, Glycine max
  Peptide Sequence Number=SeqID_105970
atgaaggaaggattggaggcttcgttctctaccgaatcctcgatggcccgacaacaagcaaaggcaactcgtggcggtcaccggtggttagtggtggcggaggaggaggttgggggtgttgggggagggtttaggtga

SEQ ID NO: 14286 - DNA, 222 bp, Glycine max
  Peptide Sequence Number=SeqID_105971
atggtgaaagttggaacctcttacgtgccgatcaacgtctcattttcgccaaaagttggcccagggctatctaatcaacagggacaccagtgtattatattgaagcattttcttctcacaagcttattggcgcaaactgtccttcctgttcagctgaaattgttatccggggtggtgcgtaacggcaaaagcaccgccggacatcagcgctggcaagtgtaa

SEQ ID NO: 14287 - DNA, 714 bp, Glycine max
  Peptide Sequence Number=SeqID_105972
atgactcccctgctgtttcacaaatatcacggcctgggcaacgactacctggtatgccaccgttcggtcgccgatcgtctgagtcaggaacagatccgcctgctgtgccacccgcattacggcatcggttccgacggcctgctgatcgacagcggcgacgccgtcaatcccaccctgcgcatcatcaacccggacggctccgaagcggagaaaagcggcaacggcctgcgtatctacgcgcggtatctgttcgacagcgagcgcgtggggcatcagccgtttctggtgcacaccgccggcggcgacgtgcgttgccaagtggcggaagacgcgcatcagataaccgtggagatggggcgcgccaatttcagcccggcggcgctgccggccttgatcgatctgccggaggcgctgaactatcccctgcccctgagggaggagacgttaagcgtttcgctggtgtcgatgggcaacccgcactgcgtggtgccggtggagaaactggatctggcgcaggtgcatcggctcggaccgcagattgaacgccatccgctgttcccgaaacgcaccaatgtacaactggtggaagtggtcgatcgccagacgctgcgcatcggcatctgggagcgcggcgccggttttaccctcgcctccggcagcagcagctgcgccgccgccagcgtgatgcgcaagttgggacgagtcggcgatcgg

SEQ ID NO: 14288 - DNA, 447 bp, Glycine max
  Peptide Sequence Number=SeqID_105973
atgaaggacaggtgcatgaagttctgcgggatttgctgcagcaagtgcaactgtgtgccatctgggacttatgggaacaagcatgacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14289 - DNA, 558 bp, Glycine max
  Peptide Sequence Number=SeqID_105974
atgactctcccttcacacgatgcttggattcacacttcccacaccctcctccccagatggaaatctctttccctcctctctcatcagggtttgctcaccttctccttattcatcttcataaccctattcccatattcattcattattacctactgggtcttttttactttcagcaaaaccctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14290 - DNA, 291 bp, Glycine max
  Peptide Sequence Number=SeqID_105975
atgactattgcagacagtattaagacaactctccttaaaattgaaagtgttaaaaattttatggggttagtgggagagcactcccaaatagctgataagtctcttgctaggacattaatgagtacattgatcaccatgaagtttgttggttcacgtactatgtatgaacatgtcattaagatgacgaacattgcaacaagacttaagaccttgggaatgattgtgaatgagaacttccttgttcagtttattttgaactcattactgtctgagtatggcccgtccaaatga

SEQ ID NO: 14291 - DNA, 723 bp, Glycine max
  Peptide Sequence Number=SeqID_105976
atgaaggcctcattggaagaacaaacaagacagggtagctttgtcccccatggtcgtgaagacatacttaacactgccatcaggcaactggatcatggaggccgtgttcgtgcagcggggtctggggtcacaataactcaatactttggcaaggcagcacatggctccagttgctcatcagcctccatcagccaagtacagttggctgaaataataggaagcctacaggaacagtggaaaaatgatatacaagtattgaaacatgagttgaaggaacaaataatacttgagatgttgcaaaggggatcgccgatctcagcacctattcagccagatatacatgtgttaggagcaagagtgagcacaaaagggagcaatgcggagactgctgtcaacccatctccacctaatcatgttgctcctgtcaaacccactatggggttgtatgtccatcgccaagattctactgagttggtggccttgggaaaaacatatgacggaggctcgacgatacacactgtggcttatgcacatgatgtcataagggttagtgttgagaaagttattaacagtgacgctgaagtcccattctcgacatcagagattaagtatgtcaggcaagcccttgacacattcattgcatggccaacaccacttgtaaaactggcctcaaatgagcttaaaggcaccactctaactacagtcactgaagctgttgaaccg

SEQ ID NO: 14292 - DNA, 354 bp, Glycine max
  Peptide Sequence Number=SeqID_105977
atgatgataacaaaagacgatgacaaaggtgatgacaaaaagctcaaaggtcaatcaaaggatgagttcaagatgttcaagaaggaatcaagaacatttcaagactcaagaggaaaggttaaagacacttcaagatttaagagaaaagttgaattcaagaatcaagattcatggatcaagcttcaagaatcacgatcaagattcaagaactcaagagaagacttaatcaagataagtatgaaaaggatttttcaaaaactgagtagcacatggatttttcacaaaacatgtttaccaaagagttttaactctctggtaatcgattaccagattgctgtaatcgattaccagtag

SEQ ID NO: 14293 - DNA, 330 bp, Glycine max
  Peptide Sequence Number=SeqID_105978
atgctgtgtacatccccgtgttatgcttttgcacatctgcatcatgtcgtcacgcacgcgttgtatgttggtctcatcttatgtcatgggaagccggaaggtccatatcaccttcttaactacacatggggcactgcgtccccgaatgcgcaatcgaagtattggcgatcaaattgtcattctttggattatggggttgaaccaagctcatgcttttacgaaaaggttcatcaagtcaagttgaagcatggaagtaaccatcttgcaaaaattggggcaaaagatggatcgagttacatcgctacttcatctactgccaaacacatttag

SEQ ID NO: 14294 - DNA, 653 bp, Glycine max
  Peptide Sequence Number=SeqID_105979
atgaaaaacggcattgttcccatatatgagccgaaccttgaagagatgttccatagaaacattcagtctcaaaggttatttttcaccaccaatttaaaagaagcattagataaaagcgaagtcgtataccttgctttacctactcctcccggggaagacggatctgctgatctttcttatgtgttgagtgttgccaatagtattggcgaactgatgactgaatataaggtcattgttaacaaaagtacagttcccgtgggaacggcagaaaaagtaagagaagttatttcttcaaaaacaaacattccttttgatgttgtttccaatccggaatttttaagggaaggctttgctgtagaggactctatgaaccctgcaagagttgttgtcggatcaagttcagagagagctaaaaatatcatgtccaagatatatcagccttttaccaatacaggaattcctattatattcatggatgaaaaatcgtctgaacttaccaaatatgcatcaaactcatttttagcggtgaaaattacattcatgaatgagattgccaattattgtgaaaaagtaggcgctgatgttgacaaagtaagactgggaatgggaagtgatgacagaattggtcaccgctttttgtttcccggaattgg

SEQ ID NO: 14295 - DNA, 178 bp, Glycine max
  Peptide Sequence Number=SeqID_105980
atggacgccttctttatacagcagctgattaacgggctgacgctgggcgcggtctacgggctgatcgccatcggctacacgatggtttacatgatcggtagctatgtctcctttatgattatcgcccgccctgatgatgatgggcatcgacagcagctggctgctggtcgccgcccgg

SEQ ID NO: 14296 - DNA, 504 bp, Glycine max
  Peptide Sequence Number=SeqID_105981
atgacccaagatctggtaacccgcggagacaccttacggttatccgcacctcgtcattcagtgaccccaagtgtgattgatgagcagaggccaatgtggtcatctgcgccctttccggaggtgtcagcatttccaggtagagactttttcaagtctcacaagttatctagaactacaggcggcgggcccgatgacatgcggagacaaaatttggtcattccgcacccctttgccattcagacacagtcgtgtccgatggcacgcagagacaaattatggtcattctgcacccttttgtcatccagaggcgacgggcccgatgacatgcggagacaaaatttggtcattccgcacccctttgccattcagacacagttgtgtccgatggcacgcagagacaaattatggtcattccgcacccttttgtcatccagaggcggcgggcccgatgacatacggagacaaaatttggtcattccgcacccctttgccattcagacatag

SEQ ID NO: 14297 - DNA, 147 bp, Glycine max
  Peptide Sequence Number=SeqID_105982
atgcagcttggcacgacaggtcccgactggaaagcgggcagccctgagcgcaacgcaattaagggtgtgagtgtagctcacgtcttaggcaccccaggctttacacttgtatgcttccggctcggaaggacagctatagaaccatga

SEQ ID NO: 14298 - DNA, 456 bp, Glycine max
  Peptide Sequence Number=SeqID_105983
atgacttgcaaagtcaatctacgatatatctgtggtttggagttaggattaaacacttgtctatgtgagattttgtacacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14299 - DNA, 525 bp, Glycine max
  Peptide Sequence Number=SeqID_105984
atgaattcatcttcagcagctgaaaccaagaagcttgaaggtaaactagatgccttagttaacctggtaacccaactagccttaaatcagaaatttgtgcctgtcgcaagagtctgtggtttatgctcctctgccgaccaccacacagacctttgccatcccatgcagcaacctggagcaattgagcagcctgaagcttatgctgcaaacattcacaacaaacctcctcaacctcagcagcaaaatcaaccacagcagaacaattatgacctctccagcaatagatacaatctcggatggaggaatcaccctaacctcagatggtctagccctcaacaacaacaacaacaacttgctccttccttccaaaatgatgttagcccaagcagaccatacactcctccaccaatccaacaacaacaacagccccagaaacaacaaatagttgaggctcctccgcaaccttccctcgaagaacttgcagtttcaacaagagaccagagcctccattcagagcttaactaa

SEQ ID NO: 14300 - DNA, 405 bp, Glycine max
  Peptide Sequence Number=SeqID_105985
atgtcgcgggggtcaggagaccttggggacgtcaggtggggtgctattgcccaaaaccaaacttggctaatcccgacccaacccgggcatagtcagccagtgagaacctgtgacgtacctaaacaggcgagctcctggcagtcaaccaataaaagaacaaagtccacgaagcaagaaggcttgtgtggcggctggccagctaattatcttgggtgttatctgaaaattaccctctgggcactggtaatcgattaccagttgtgtgtaatcgattacatagtgctacctgctactatcgattaccatttatggatcgcgatggcagcgcagttgatccatgatcgcgttgtaatggagtgcccagagggtgtttgggagaccctcgaaggcaatgagaggtgctga

SEQ ID NO: 14301 - DNA, 345 bp, Glycine max
  Peptide Sequence Number=SeqID_105986
atggtgaaagttggaacctcttacgtgccgatcaacgtctcattttcgccaaaagttggcccagggcttccgtgtatcaacaggtggacaccagaggagattccatttgtctggaatggatatccttccgtcacagaggcgcgtttcccattcgccatgtcaggctgcgcaactgttaatgaatcggaacgcgcgggcgatcgagtgcgggcctttgctattacgccagcggcgaaagggcggatgtgtcatacggcgattaatgttggcacgtgcagggtgttcagtcgaagtgcttcatgtggcagaaaaaaaggctgcaccggtgctcagcagaatatgtga

SEQ ID NO: 14302 - DNA, 255 bp, Glycine max
  Peptide Sequence Number=SeqID_105987
atgggtccaagagagcctaagcccatgtgttgtgccagtgttgctggtgtccaaaaaggatgcaaagatccacaagggatgtaccctcccttgttctctttgaacaacctagtggatgtaccctccactagaactgatccacaagagatgtaccctctcttgttctcagtcaacaacccaagtagatgtaccctctacttgtaccacaaaggatgtaccctccaatgtgttaagacaaagatctcaggcggttaa

SEQ ID NO: 14303 - DNA, 858 bp, Glycine max
  Peptide Sequence Number=SeqID_105988
atggctccgagaaagctttccaataagatatctaggagggacgccgcggccgaaggaactagcgccgctcctgagtttgacagccatcgtttcaggagcgcagaccaccagcagcgtttcgaggccatcaaaggatggtcgttccaccgagagagacgcgtccagctcatggacgatgagtacaccgactttcaggaagagatagctcgccggcgttggacgtcgctggtcacccccatggctaagtttgacccagagatagtcctggaattttatgccaatgcttggcccatggaggaggggcgtgcgagacatgcggtcatggacaccctcagccagttcctgggagacccactagtgttagaggagggccaggagtgcgagtatagtcagagaaggaatcgggccgatggatttgacgaggaggccattgcccatctgttatgcataccgggtcaggattttgcccggaccgctgccgggagacaggtgcgaatcatgcgcaccagcatgaccaccttgactcagatgtggatggcgttgctgctcagcaacgtcctacccagcgatcataactctgacctccctctgccgaagtgtcagctggtgtacgccatcctgacacggatgagcgtccatgtggctcagttgatcgctgacgccatttatttatttgcaggtatgccacctaccaggcaccctctagacccagataagtctaacagggccctggggtttccagcgttgatcacgggcctctgccagtcattcggggttcctgtcacacttagtaaggtgattcgaccgccgatcacccgggctttcattgagaagtattgcacgcctagacaggcgtag

SEQ ID NO: 14304 - DNA, 456 bp, Glycine max
  Peptide Sequence Number=SeqID_105989
atgaccatgattacgccaagctcgaaattaaccctcactaaagggaacaaaagctggtaccgggccccccctcgaggcacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14305 - DNA, 684 bp, Glycine max
  Peptide Sequence Number=SeqID_105990
aacttcgaagctccggaggaagatgaagaagtccgagctctaaagttagagctagggaaggcgagactcgccaaggagaagttcaaatcagctgctacacacatccggaaggagtgcaccgagttacaagaggaaaacgctgccactgcaagagctcttgaacaagaaaccaaaagggcccgcaaggaggaacatggccgagaaaaattccgaggagcattgtggggtagcaacaatgagctcaagctccgaagagaggagagagatcggtcacgggtgcatggcatgatcttaaaagaagagttagttgcttgcgcgaggtccaaaaggagtttggctcaacacttggaagccacggagcaaagcatgctagccatcatagggcaatacaagaaagaattgaaccagtccatggcccatgaacaaaagctagtggaggattttgcacaagtgtatgccgaaaaagaagcaaaagggagggtgattgatgcgctgcatcaagaagcgactatgtggatggatagattcgccttgaccttgaatggaagtcaagacctcccgcgtctattagccaaagcaaaagccatggccgaagtgtgtactgcccccgaggagattcatgggctaatcaattactgtcaacacatgatagatttgatggcccatataattaggaatcgttag

SEQ ID NO: 14306 - DNA, 477 bp, Glycine max
  Peptide Sequence Number=SeqID_105991
atgtccggaaagagtgtgccgggttacgagaagaaaatgcagctactgcaagagcccttgaacaagaaaccaagagggctcgcaaggaagatcatggtcgtgacaaattccgtggagcgttgtggggcagcaacacgtttatgcgagacagagaccaacatgttagctatcatcaccaagtaccaagaagaactaagtctagccacggcccacgagcatagggtggcagacgagtatgcccaagtgtacgcggaaaaggaggctagagggagggtgatcgactcgttacaccaagaggcaaccatgtggatggaccggtttgctcttaccttgaatgggagtcaagaacttcctcgattgctagccaaggccaaagcaatggcggacacctactctgcccccgaggagatccacggacttctcgactattgtcagcatatgatagatttaatggcctatataattaggaaccgctag

SEQ ID NO: 14307 - DNA, 522 bp, Glycine max
  Peptide Sequence Number=SeqID_105992
atggctcattccaactcttctcgcctaggcttcctagctttaatcacagccttgtgcaggtcaaggggagttggatttgatgctcttacttcttacaagagcctaaggccgggacaaattctcattatgcacagcttgcaagaattggcccaccagaggccaatcataagtgtcgagcagttcattgagcaggtggcctggcccagagctcgaccttcttttgttagtgataatagaagctctacagcccaggcacctcagcagcaaaagccagagccagaagataaccaatccgctgaagccactgttcctggagcttttgaggctgcttatcctgagctagtaccagtaccagctgatccaccatctccagtgatggatccatcttctcttatgccagaagcagctctcccatctacacctattcttatatctgatgaccctacagtacgaacacctgaatggattcctactcctctaaccacacctgagcttcaattttcagataaggaagagggataa

SEQ ID NO: 14308 - DNA, 390 bp, Glycine max
  Peptide Sequence Number=SeqID_105993
atgctgacaaagacgaaccggtacatccatattgacaaaattgcagtggaaggcaattgtagtgttgtgattcaacgcattcttccacataagcacaaagatcctggagttgtcagataccgtgttccattgggaggttgctacatagaagaggatgttgatattcctctcattcttggccgcccattcatgtctactacaagttgtgtagtagatatgggaaagaagatgttgctaatgggaatagaagatcagaaaataagctttgatctatttcatgacgataaagagcctcctgaccataatgtctattttaaagttcatgggatgaaggaaagaagacctgagaagaaagtccttcaagtgggaactttattggattctggataa

SEQ ID NO: 14309 - DNA, 895 bp, Glycine max
  Peptide Sequence Number=SeqID_105994
gttgcctatagactacagagagatagaggctgccttatgcatacctcgccgagggttcatcttgaactctgagggccatcctgggaaaattctcaggaaggatctgactacactagctcaggtgtggagtgtcctctcatactacaacttggcccccacatcacacacttctgacttgatagtggatagagctaggctgatctttggcctagtctttcgcatggatatgaacataggagtgctgatctctggccaaatgacctctatagccctgtctaacacttctagacttgggtttcctactctgatcaccgcactatgtagagtcaaaggggttgtctatgatagccttacttttgagcgcttgagcctggtcattaacttggcctacatcaggaagaactgttggaatcccgaggatctaacagtttctattcgaggggctaggagggcgagggtgaggctagttgagcttccttccacttctgcagctcctactctagcatccacttcagcagctccttctgtggttgcacctccaggatttattcctttagttgagcaattcaaggagatggatgagtcatctgaggcaaccatcccagagccatttgttttaggggaggaggcaggtgagacacaattgagacaagtagctgctaccactcctgagagatcccttgaggccacttcagagccttctgcactagtggtgaacctaccttcacctcagcatgcagcagacccctccactcctcttctagagatgccaaaggacccgactacactagtcctggctgtggacacttctcctccagctactccagtactgcatctgacagatgaggaggatgttcagacacaggacacccaggaccagtcacaggaattttga

SEQ ID NO: 14310 - DNA, 696 bp, Glycine max
  Peptide Sequence Number=SeqID_105995
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtttgacaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14311 - DNA, 351 bp, Glycine max
  Peptide Sequence Number=SeqID_105996
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgtccttcccaacagttgcgcagcctgaatgccgaatgggacgcgccctgtagcggcgcattaagcgcggcgggtgtgtggttacgcgcagcgtga

SEQ ID NO: 14312 - DNA, 372 bp, Glycine max
  Peptide Sequence Number=SeqID_105997
atggttcaaagagtccgaaaagcatggaatgtggtgcaaagaaaggataaggagcttagaggaagcaacaatgagatcatcggcggctataacaagtggttgaaggctcgaatgcaagagacagactggctcctaaagctaaaggtttcaagtgaggaagaggttgaaacccctgaggagagtgaagaggtgcaagccttgaaggcggaacttgaaagaacccaagtggtcaaggaaaagttcaagacgacgaccatcaaggtctggaaagattgcgacaaaatgagggacgtcagcatggccacaactgaggcattagaatgggaaacgaagagggcccgaaaagaagaatggggccgaaacaagttctga

SEQ ID NO: 14313 - DNA, 773 bp, Glycine max
  Peptide Sequence Number=SeqID_105998
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14314 - DNA, 884 bp, Glycine max
  Peptide Sequence Number=SeqID_105999
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaatggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14315 - DNA, 616 bp, Glycine max
  Peptide Sequence Number=SeqID_106000
ggtgatagaatcattgcacggcaaagctatgaaatggatggatagattcgctctcactctaaatgggagtcaagagcttccaaggttgttagccagagccaaggcaatggcggatgtatactcagctcccgaggaagccgacatgaaggctatgaaggaccaaatgacctccatgatggaggccatgttgagtatgagaaggatgatggaggacaatgaggccgctgttgcctccaccagtgctgccatcgaggcggatccgatccacccatccggcataaaccaaacaagccatccagccccagacatggtaggtcagggaagagaagtgttgggcagtatgggcggtccccatatggtgcaaaataagaattctttcccatcgtacgactttccacctaactatacaccacccaatgcggtgcatgtgcccaatgagaatgcctaccactctgttctcgttctccttgaaggtcagcaaccccagttggggcatgcacccttcgctcaacctgtgggggaagcccgtgaggagccccgggatcacactttgggtgagttcgaaccataccctacatatgccgctgagggaccagcatttagtggcatgccttag

SEQ ID NO: 14316 - DNA, 987 bp, Glycine max
  Peptide Sequence Number=SeqID_106001
ccggtgcaaggtgagggtggggtgcatatcccggccagcctcaaggcttatctgcaaggtttacgcgaaatctgtgatgccaacggctggttgctgatgttagacgaagtgcagtcgggtattgccagaaccggcacctggtttgcattccagcatacaggcatcgtgccagatgtgatgactctggccaaaggcctgggttcaggtgtgcctattggcgcctgcgtggcgcgtggagtggctgctgaaaccttcacccctggcaagcatggctctacgtttggtggtaatcctctagcaaccgcggccggcttggctacgctggatattattgccgaagaaaagttgcgcgaaaatgctgaaacagtgggcaattacatcagagaacaatttactgcatcgctcaaaggcgcaaccggggttgtgaatatacgcaatgccggcatgatgataggaattgagctggacaaaccttgtggtgacctggtgaaacaggcactggctgccaaactgttgattaacgtgacgtcggaaaagtttaacgacctggcccgagacgagattgaacatattttcgcccgtgccaaatggattaaatcgcagtttaaagactacaaacaatactggccgctggtcgatcgcaccctggtgatgatttttgaaaaagccagtacgcgtacgcgtctgtcatttgaagccggtatgcagcaattaggcggttcagccatttacctgaatacacgtgactctcaactaggtcgcggtgaaccggtagaggatgcggcgcaggtgatttcgcgtatgagcgacatcgtcatgatccgcacctttgagcagagtattattgagcgttttgcgcagaattcacgtgtgccggtgatcaatggcctgacaaacgaataccatccatgccagattctggcggatatttttacttttatcgaacatcgtgggtcgataaaaggcagcagaagtactggattttaa

SEQ ID NO: 14317 - DNA, 480 bp, Glycine max
  Peptide Sequence Number=SeqID_106002
atgaccatgattacgccaagctcgaaattaaccctcactaaagggaacaaaagctgggggtgtttatttctgacgttggcattgggagcgattatttgtattatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14318 - DNA, 288 bp, Glycine max
  Peptide Sequence Number=SeqID_106003
acttatcaaggtaatccttgtggcgtctaccctgacttatcttccttcactggaagtggcgtcaaccctgacttatcttccttcactggaagtggcgtctacccggacttatcttccttcaccggaagtggcgtctaccctggcttatcttgcttcactggaagtggcgtcgtccaaaaactctacagcctgtatcaaacgatctgccccgaaagattcacatcatctggtatcagagctttggctcttgatgcaggttctatcctatcctattattttcctttgtaa

SEQ ID NO: 14319 - DNA, 527 bp, Glycine max
  Peptide Sequence Number=SeqID_106004
atggtgaaagttggaacctcttacgtgccgatcaacgtctcattttcgccaaaagttggcccagggcttcccggtgttaatttcgaggctccatggcgtaatcatggttctatcagctgttctcctgttcagctactgacggggaatggtgttatccgctcacaattcgcacacaagcataccgagccggaagcatcagcgcggcaaggctgcccgcattcccagttcagggaaactgtcgtgcaagctgcattaatgaatcggccacgcgatcggtgcgaggccggtttcgcgtattacgccagcggcgctaaagggcggatgtgctgcaactggcgattatatgttggtgtaacgccagggtgtttcccagtcacgagtgcgttcgtggcaggagaaaaaactgacggccagctgaattgtaatacgactcactatagggcgaattggagctccaccgcggtggcggccgctctagaactagtggcttatcccccgggctgcaggaattcgatcatacagttcaa

SEQ ID NO: 14320 - DNA, 471 bp, Glycine max
  Peptide Sequence Number=SeqID_106005
atggtgaaagttggaacctcttacgtgccgatcaacgtctcattttcgccaaaagttggcccagggcttccccggccgccgctgttatttttctgccgcggcaaggcgctccgttccgctgctgtttcacaggatgatcaagcttattggcgcaaatggcgtatctggtttctatcagctgtcccttcctgttcagtactgaacggggtggttatccgcgtaacggcaaaagcaccagccggacatagtggcaagtgtaaagccggggtgctgagtgagcgtaaccaccacaccgccgcgttaattgcgccgttcggcgcgtcccattcgcccggctttgcgcaactgtcgggaaagggcgtcggtgccgggccttcgctattaatgaatcgccaacgcggcgaaagggggatgtgctgcaagtttgcgataagttgggtaacgccgggtgtattccttacatgtcactga

SEQ ID NO: 14321 - DNA, 243 bp, Glycine max
  Peptide Sequence Number=SeqID_106006
atgtcatcttccagtgaaattgaagcacaaagcttactgggcagtgaaagacttgcaacttctctatggatcaagctggtgaggaaaagaaagttgcaactgattgagatcaaaagcgactccacaaacaagagcttcaaggtcaatggacatcaacttaagccattcctcacgaacccttctttagtggaggtagtgggggaagagacttccttactcccccctatttttcctccaccatga

SEQ ID NO: 14322 - DNA, 299 bp, Glycine max
  Peptide Sequence Number=SeqID_106007
aggaacccgcacgcacgcttcagcagcctgtggagtggatactacctacacctactccatatcgactagtggagccaatccaagtgatagaggtgtcatcctctgaagaagatcctgaggaggacccagaggagttacctcctgaacctgatgtggatgaccttgacttacctaaggatgatgaagacccactccctgatgtggattctccagaggatatcatgtcagcatctgaggcagactctatagaggagagtggccctggagggacagcgaatagtgaagactcttcatcatag

SEQ ID NO: 14323 - DNA, 141 bp, Glycine max
  Peptide Sequence Number=SeqID_106008
atggtgtgcaaaggttggagctttgatggagcttcaatgatgtgccacatgtcttcttttgagtggagcaaaaaggggcccactttttctcttgatgtgactcatactcagtcacaagaagtgaaaaatctgaccttttga

SEQ ID NO: 14324 - DNA, 468 bp, Glycine max
  Peptide Sequence Number=SeqID_106009
atgacggccaacccgggcgatcgaggcgggcctttgcgtattacgccagctggcgcaaaggcggatgtgtcatacggcttactatgttgggtaactgatgagggtgttccagtgaagtgcttcatgtggcagagaaaaaaggctgcaccggccagtgaatatgtgaatacgactactattccgggcgaattgtctgactcctaccgctcggtcgtcatgcggcacgctctagaactagtggatccccacggggcaggaattcgacaatggcggaagattcagagtgtgcgaatgagagggccgcggaatcggtttttcctactaaagggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccg

SEQ ID NO: 14325 - DNA, 207 bp, Glycine max
  Peptide Sequence Number=SeqID_106010
gggggcggagcctatggaaaaacggctttgccgcggccctctcacttccctgttaagtatcttcctggcatcttccaggaaatctccgccccgttcgtaagccatttccgctcgccgcaggcttcgaacgaccgagaacgtagcggagtcaggagtttccagaggaagcggaatatcgaattcctgctagcccgggggatccactag

SEQ ID NO: 14326 - DNA, 298 bp, Glycine max
  Peptide Sequence Number=SeqID_106011
tggcgtctcctctctctcttccttctccattccactaccattcatcttccaagaagcaaaggaatccattgatgaagaagatcctaggcctacaagctccaatggagcttacatcaataatcaacctaaagaagtcaaagaaccaactagacgcttgctaagaaaacattatccagaatctcatatcattagtgatcccaaggacaaagtgcaaacaaggaactctctcaagcatacaattcaattgttagagatcaaggcaaaacacatagatgatgatatgtcttataagcactaa

SEQ ID NO: 14327 - DNA, 345 bp, Glycine max
  Peptide Sequence Number=SeqID_106012
atgaatccaaaggacctatcatccaatgagcttagaaagaataacccaccttctacttcatccaaagaaggaaaagttctacaaatcgctaaacttgcactagtgtccatcattgctgcaaaagtttcactaaaagacaaggagcccaaggttcacattgaacacttcttcaacatcgagtcattggagaattttggctacgatatcaaagcacacctcatgttgtgcgacatccatcacttcttcaaggactcaaaggtggtggtccttgaactaattcatgaattctggaggacaaccaaggtctaccgtaatgaagtcattggtagatattttgctggctaa

SEQ ID NO: 14328 - DNA, 288 bp, Glycine max
  Peptide Sequence Number=SeqID_106013
atgggggtgcaaatagcaacaaggcccacttgggccttccagattcttcctccagaaggtggttgcttctggagaaagcaacctggcttgcctgggcgagctagaaaatccatgtcgaggcgcttccgtaacgtttctgtgggtgatttcgtgaagattttctatcgttcttcgacgttcttcggtcttcaaccgggaagtggtggcacaaaggaggagtgtggctgcgcagcgccactgcatttcgtgagtatttatagaggaggatgtgatgtaatcgattacaag

SEQ ID NO: 14329 - DNA, 1407 bp, Glycine max
  Peptide Sequence Number=SeqID_106014
atggggaaaataacgcacattgtagtaattcccagtgcagggtacagccacttcgttcccgttatccacttctcaaagagacttgttgagcttcacccagaaattcacgtcacatgcatcattcccattctggggtctctcccaagtgctgcaaaacccattctccaaacccttccacaaaacatcaacacggttttccttccaccggtgaaccctaatgacctaccacaaggtgttcccgtagttgtccaaattcagctagcaatggctcactccatgccctccatccaccacaccctcaagtccataacttcaaagactccctacgtggccatggtggttgattctttcgccatgcatgccctagatttcgctcacgagttcaacatgttgtcctacgtttacttccctatatcagccaccacactctccatgcacttgaacttgcccttgttggacgaggaaacatcatgtgagtacagatatctgccggaggctatcaaattaccgggttgcgtgccgtttcacggccgcgatctctatgcccaagcccaggatcgaaccagtcaactctaccagatgtcgctgaagcgttacaaacgatgctggttcgttaatgggatcttcatcaacagcttcctggcattggaaactggtcctataagagcattgagagatgaggatagaggttaccctgctgtgtaccctgttggaccacttgtccaaagtggtgatgatgatgcaaaagggttattggagtgtgtaacatggttggagaaacagcaagatggttcagttttgtatgtttcttttgggagtggtggaacactttcacaagagcaaatgaatgagctggcttgtggtttggagttgagtaaccacaagttcttgtgggttgtgagagcaccgaacaatgcaaaagctgatgctgcttatcttggtgcacaaaagtgtgttgaccctttgcagttcttaccatgtgagttcttggagaggacaaaagagaaaggtatggttgttccttcatgggcaccgcaggttcaaatccttagccacagttcagttggtgggttcttgactcactgtggctggaattcgaccctcgagagtgtgctgcatggtgtgccattgataacttggccactgtatgctgagcagagaatgaatgcggttgtgctttgtgaggatctcaaagtgggattgaggccgagagttggtgaaaatggtttggtcgagagaaaagaaattgctgatgttgtgaagcgtttgatggaaggaagggaaggtggggaaatgcgaaaaagaatgaagaaactagaagttgcggctgttaatgctctcaaagaagatgggtcttctaccaagactctttcagagttggcactaatgtggaaaaatgtggcttag

SEQ ID NO: 14330 - DNA, 408 bp, Glycine max
  Peptide Sequence Number=SeqID_106015
atggtgaaagttggaacctcttacgtgccgatcaacgtctcattttcgccaaaagttggcccagggcttcccggtatcaacaggacactcgatttatttattctgcgaagtctgtcagctgcaagggttaatttcgagctccagtggcgttctggtttctatagctgtttcctgttcgtagagaatggtgttatccgtaatcggcaaaagcacacgccggaagcatcagcgcggcaagtgctgccattcgccattggtccactgtctgggaagcctggttttccagcggagtgtaaactggcattaatgttcactatgagggtgtcagtgaagtgcttccacccgtggcggagaaaaaaggctggcccccgggcgtgcaggaatagtgatcaggataacgttcggtag

SEQ ID NO: 14331 - DNA, 333 bp, Glycine max
  Peptide Sequence Number=SeqID_106016
tttggaacctcttacgtgccgatcaacgtctcattttcgccaaaagttggcccagggcttcaccgtgatcctccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 14332 - DNA, 219 bp, Glycine max
  Peptide Sequence Number=SeqID_106017
atgtgcagcagaattttgtgcttgtgtagaaaatgcgcattgctggttatgggaaagcttggaggggttgatggggacccggtgctgagaggaacgaggataagggctatgtgggggtacgtcagctcagttgaaggtgggcaactagggatggtgggttcatgtttgatttgtgaatgtgggagagttgatttgcaccatcgcccgatcgccacctag

SEQ ID NO: 14333 - DNA, 234 bp, Glycine max
  Peptide Sequence Number=SeqID_106018
atgagggttcactgtaaccaagcaagtcggagacctagcatgatcacagattcacctccactccttatgttcccacgagcccggtccccagcggagtctccaactgtcgcaacctacccttcggtgggagggcgatgcctgactcgcgggagcgtgttccaagaaaggaatacgcgcggagtcgccaccaatgtttatttgaggaaaatgtcggaaaaaccggaaaagacgtga

SEQ ID NO: 14334 - DNA, 399 bp, Glycine max
  Peptide Sequence Number=SeqID_106019
atggctgaggtcttaaaacagttccagtggaaattgggcagtggcgatcaaatattattttgggaagactcttgggtgggtgatggaataactcttagagaaaaataccctgaattgtatcaaatatcatctcacaaatttcagttagtgggaagcatggggtcctttggagaagaaggttggcagtgggaattctcatggagaagaaacctttttgacaatgagctaggaagtgcctcagactttactgaacaggtcacagctctaagccctaatgcagctttgaaggatcattgggtgtgggccaacagcctacctaaatcgtggattcagacagttgtgggaagtcaaagtacctccgagagccctatcctttgcttggagactactttgggatag

SEQ ID NO: 14335 - DNA, 491 bp, Glycine max
  Peptide Sequence Number=SeqID_106020
atggtgaaagttggaacctcttacgtgccgatcaacgtctcattttcgccaaaagttggagcccaggtcttgagacccggtatgcaacagagtaagtggggacagccttgtattgatacacttctgaggttcgatcacagcttattcgcaaagtgcgtcgggctgttcctcctgttcagtactgaaatcggggtggttagcgtaacggcaaaagcaccgccggacatcagcgggcaatcgggaaacgcgtcgccattcgccattcaggatgaatcgcaactgttgggaaggcgatcgagtgcgggcctcttcgctattacgccagctggcgaaagggcggatgtgtgcaaggcgattaagttgggggaatatggagtccaccgcggtggtcctcgctctagaactagtggatcccccgggctcaggaattcgactgccgagcggaacgacccatggcttacgaacggggcggagattccgaagatgcacag

SEQ ID NO: 14336 - DNA, 234 bp, Glycine max
  Peptide Sequence Number=SeqID_106021
atggtttctgaaagtgatagtgatccaccttctcctagttccgctaagataatggcttcattggctaagcaaatggataagttgcaaagaaatgtagagaggaggatgggagagagattttatgagatacaaataggcactcaagagttgagtgggagaatggaagacatagagaggaggaggcatcatcagtcaccttattcttctcaagggagtgatgatgaccatgaataa

SEQ ID NO: 14337 - DNA, 258 bp, Glycine max
  Peptide Sequence Number=SeqID_106022
atggctttcactcttatccaaggaaggaccaatcctaaggaattttgggggctgctccttcaaaacccaaggaagataaggagatgtcacattgcctctcaatgccccacaaagaacaccatgattatgaggggtcaagacatttatagtagtcaagaggagactacttcttccccttcctctagtggaagtgaagatgaagcaaggggagaagagtctagtgaggaattcttaccccatgaagaaggtgcctcctaa

SEQ ID NO: 14338 - DNA, 495 bp, Glycine max
  Peptide Sequence Number=SeqID_106023
atgcaaagaaggtcttctgcaggtgttttgattcccatagacttggaaattaatgcaacttgcaggaaaaggaacgcagaaagaaatataaagtttttgcaggacattaaggcagcagcaattcaggaagaacctctatcttctgaggcatcttctagttttccaaaacaaagggaatctcacacagtattaattgaagccaatatcatggctgatgagccaagacgagtgaccctggaagattactcaagtacttttgtgccgcaattcttcacaagcattgtgtggctagagttaattcagaacaatttgtttcatggtctgcccaatgaataccagtatgcatatctagttacctatattgagatatgcaatactgtcagaatagctggtgtgcctgaggatgctgttagattgagcttgttttcattttctttgtctggagaggcaaaaagatggctccattcgtttaaaggtaatagtcttaacacttag

SEQ ID NO: 14339 - DNA, 345 bp, Glycine max
  Peptide Sequence Number=SeqID_106024
atgggaatggaggatgcaatggaggagaaattgatgctcagattgatgctgtccagatttgcccaaccaattgccttctgttggagaattttcagaaacaaattgcctactaaggctaacttgagaaagagacacatcactttgccttcgtataggtgcccgttatgtgatagtgaagaggaagatattggccacatcatgttctcatgcagaatgactaggaatttatggtgggaggctttgagatgggtcaatagagtgggccctttccccattgaacataaaaatcattttatgcaattctctcattggaatcgcaaaagctttatagacatagatgggtga

SEQ ID NO: 14340 - DNA, 186 bp, Glycine max
  Peptide Sequence Number=SeqID_106025
atggctcacaaattctgttttggcattggatggctaatgacattgtctataattataaaaaatcatcaacaagtccagcttgatgctagaactcttcaaaatctggtcttgcttgaaatgaagaactgttgcaagcaaatcaaagacaacttagagctatccttcaatgccatatcagaggtgtga

SEQ ID NO: 14341 - DNA, 426 bp, Glycine max
  Peptide Sequence Number=SeqID_106026
atgacaccggtaaaccgaaaggcaggaacaggagagcgcacgagggagccgccagggggaaacgcctggggggcggagcctatggaaaaacggctttgccgctggggtaccctgctcacccgcgttagtcggggctctttggctggatcgaattcctgcgcccggggcacatccccctttgcgccagctggcgtaatagcaaaggcccgcccgatccccggttgccgattcattacagttgcgcagcctgacatggtccgaatggaaagcgcgccctgtagcggcgcattaacgcggcgggtgtggtggttacgcgtcagcgtcagcaccccgctacacttgcccgctatgcttccggctcggtatgcttgttgccgattagcggataacaccaccccgtcagtagcaacaggaagacagctatga

SEQ ID NO: 14342 - DNA, 480 bp, Glycine max
  Peptide Sequence Number=SeqID_106027
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcaacagattgccgacgggcctgtcccgccgctccaatgacgacgcgctgagcggccgcgccggccttgcctacgaattcgacaatggcctgacgccctacgtctccgccgccacatcaagcttatcgataccgtcgacctcgagggggggcccggtaccagcttttgttccctttagtgagggttaa

SEQ ID NO: 14343 - DNA, 369 bp, Glycine max
  Peptide Sequence Number=SeqID_106028
agaccagagcttgaagcaagagccggtttaagagcttcagatgagtctgtgagtgattgtgagatcctagaggtgaaggagacatcctcaccacttgcttcttggtatggaaagctaaatcctctgttggatcttccctttagatgcatgctgtcgcaacctaccattcggcgggaaggcgacgcgagactcgcgggatgcgtgttccacgaaaggaatacgcgcggagtcgccaccaacgtttattcgaggaaaacgtcggaaaagacgcgatctacgaactttttagtgaaaggttcgggagttgtatttacgcacggggaaggtattagcaccccacacgtccgtcccaagggacggcagccttaa

SEQ ID NO: 14344 - DNA, 246 bp, Glycine max
  Peptide Sequence Number=SeqID_106029
atggctcattttcaagacgttggtggcgactctgcgcgtattcctttcgtggaacaggcatcccgcgagtcacgcgtcgcccttccgctgaagggtgtacccctcgaatctccccaacaattggtatcagagccattggttcaagttggtgactggctcagacaagtatgcaagtaccgcaggtggccagaatggctagcgggcagggcaagtaccgcaggtggccatggctatactcgtcgatga

SEQ ID NO: 14345 - DNA, 396 bp, Glycine max
  Peptide Sequence Number=SeqID_106030
gattgttactgtttgactgtgggcactgtcgatgaggtgatgattgatacaccatggagttatgacagttgtccatactgtacaaccacttttgatccattaaaaataggtgccgcctgccgttcgtgccagaatcatgttactcacactattccaaggtataagttagttgtcaagatggaacagaacggggagaaggcaaacttccatttttgggatgcaatgaatgatcgtcaagagttgattgcgagtggtgatgagatcaaagggtgttccctgcgtgtgttgatcaattgttgggtaaaacttgggttgtcagattcaaacaccgtatacagatgcaccaatcatccgtgttggattttagtgaacaggaacatcatatacaatcagtga

SEQ ID NO: 14346 - DNA, 186 bp, Glycine max
  Peptide Sequence Number=SeqID_106031
atgcgcggagtcaccaccaacgtttatttgtggaaaacatcagaaaaaccgaaggaaaccggtcataaagaatattccagattcgggagttgtatttacgatttgaggaaggtcgacaaaagcggggctcttgctcttacgtaccctccatcaaagaggaaattagacctacgtagttctttctaa

SEQ ID NO: 14347 - DNA, 139 bp, Glycine max
  Peptide Sequence Number=SeqID_106032
atgaacagcaaccgcatctacgcctatcttcgtgcctccaccaaagaccaaaacgctgagcgtgcgcgtcaggatttgcaggagttcgccaccagcaatggcgttgctatctctgcgtggttcattgagaacgagtctg

SEQ ID NO: 14348 - DNA, 396 bp, Glycine max
  Peptide Sequence Number=SeqID_106033
atggctgctgtaaatcatttttggccactggtgccaattctgcgacacatttcgactcactgctacattgcttgtacatctggagcaacccgcacacacacttcagcagcctgtggagtggatactacctacgctaccccatatcgactagttgagcccgttcaattgatagagatgtcatcctccgaagaggatcctgaaggggacccagaagagttatctcctgaacctactatggatgcccctgacttaccagaggatgatgaggacccatttcctgatgttgattctctagaggatattatgccagcacccgaggcagactctacagaggagagtggtcctggagggatgacgaatagcgacgactcttcatcacagcagacgactccttag

SEQ ID NO: 14349 - DNA, 276 bp, Glycine max
  Peptide Sequence Number=SeqID_106034
atggagcgatctgccaactggagggtcatgcgtgtgggcattatctctagctctccaagttgccggcacatggagagaggcattaaattgatactagctcccaagtctaagagctttacccacagtaacctctccaatggaacacggtatagtgatacttccaggatctttgtgcttcagaggaaggatgagttgaatgaccgcactatagttaccttccactactatcgtgtcactgtggatgtaccggttcttctttgtcagcatgtcttttaa

SEQ ID NO: 14350 - DNA, 225 bp, Glycine max
  Peptide Sequence Number=SeqID_106035
atggctacgcaaaccgttgaggataattctagatctggtccaagacgaactgttgtaggtgatttattgaaaccattaaattcagaatatggtaaagtagctccggggtggggaactactcccttgatgggcgagttgaacgaagggcctagggaagtcggggctgagcaacctttctctagctttttcagtgggggaacttggcctgggaggggcttcagatga

SEQ ID NO: 14351 - DNA, 990 bp, Glycine max
  Peptide Sequence Number=SeqID_106036
atgtgtgaagcacaagggacatcaactctattaataccaccaaacaaagtattcttggtgacgagcatgttactaaagggtccttgcgtcgccccaagtgttcaaattcagcttcaaggggtaatagttgcacctaccaaggatgcatgggtggaaggtaatctgaatactttgattatgatctcaaatgtaaacggtctcacaattgatggaagtggtggattaatcgatggctacggttctgcttggtgggcatgcaaatcttgtccacgaccatcggttcttattatcaattcctgcaattctgttagtgttactaatctgaacatgattaatagtccaaaatctcacatacacgtaaatggttgtgagggtgccacattttctcatattaatattagtgctcccggtgatagtcctaacactgatggatttgacatttctacttccaaaaatatcatgatcgaagattcaactatagccaccggtgatgattgtattgccatcagtggtggctcctcctacatcaatgttactgggattgcttgtggaccaggccatggaataagcctcggtaaaaagtttgatacagtccaagaagtttatgtacgaaattgcagcttcataagaactacaaatggagcaagaatcaagacatttccaaatggaatgggttatgcgaaacaaattacttttgaggatatcaccttagaacaaactcgcaacccaataattatagatcaagaatatcgtgatttaacgaatcaagcagttgaagtcagtgatgtgacatacagaggaattcatggaacatctctagatggaagagctattaccttagattgcggcgagtctggttgttatggaattgtattggatcaaatcaacattgtctcttgtttaacaggaaagtctgcttcgtgtttttgcaataatgctcatggaacagctacagctacaaatccaaattgtacttgcttattaccatga

SEQ ID NO: 14352 - DNA, 492 bp, Glycine max
  Peptide Sequence Number=SeqID_106037
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcaacccgaacgctgcgccttatccg

SEQ ID NO: 14353 - DNA, 189 bp, Glycine max
  Peptide Sequence Number=SeqID_106038
atggatggcgaggagctaccctcgcccgtgaactccaaggggcagaatcgtcttaggccgcggtcagaagtcgagacaaagttgacggcagaaatcaaccaagatagggtcacgaccgaccgatcttcgtcccttcccggcgctggacaagcagagcacgtcgctgcaaggcagcccagtatcctttga

SEQ ID NO: 14354 - DNA, 507 bp, Glycine max
  Peptide Sequence Number=SeqID_106039
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctcctcaacaacaacacacaattacacgtgaacatcttagaacaagaggaggtagaggttgtagaccaagaggacaataa

SEQ ID NO: 14355 - DNA, 603 bp, Glycine max
  Peptide Sequence Number=SeqID_106040
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccgggctcgcgcgagacgcgccgctggatcaccgtgccccagtcgctcagggccaggtcgacgttgaagccgatccgggggagcaggtcggccgcgacctgggtcagcgccgacggcgccaggatgtcggtggggccgatcagccggatcggggatcctctagagtcgacctgcaggcatgcaagcttggcactggccgtcgttttacaacgtcgtga

SEQ ID NO: 14356 - DNA, 342 bp, Glycine max
  Peptide Sequence Number=SeqID_106041
tctggactaatccatctgttgccaaagtttcatggtcttgcaggtgacgatccacacaagcatcttaaggagtttcatgtagtgtgttccaccatgcgatcacatgacattcatgaagattatgtgaagatgaaggaatttccattctctcaagatggtgtggctaaggactggttgtaccttcaactagataccatcaacaccttgacagatgctcctattgctgtcagacaattgatttccaacatggcaataaattatcagcaatttggtactagagttgctacaccatctagaattgttgcaagtgaagtttctatttctatggtggctaataattag

SEQ ID NO: 14357 - DNA, 252 bp, Glycine max
  Peptide Sequence Number=SeqID_106042
atgttaggattcacaagcgattctcctcaaattttagctagcctgcatcaattagactttgcaccttatgcttcaaggccctacaatgctcaatggaatgccctggggcttctccatgacaagcacacgttgtgttcgagtcgtatcctcaaagaaatggaggttgatgaaccttggctggggttatggctaccattgaattatcaagtagatatgggagcaagtcagcataggacaccggaattggggtga

SEQ ID NO: 14358 - DNA, 828 bp, Glycine max
  Peptide Sequence Number=SeqID_106043
atgacattcttaggagaaacttcgtctcagacaattgtcaactcaaagttggcattcatttttccaaatggagccatcattcacaatgagtgtggggtttattttcaaagttctactccagtgcccatgagagtaccaaacctgtgcgatttttcaactcttaaaagcataatacataacacccttcaactaaacaacaatcaagttgtggatgaaattcattaccggcaaccgctcaaagatacaagtaacaatattcacttccaatgtatgcaattgaaacatgacatggatgtgaacaccatgttaatgtgtaatgatcaattttcatgtgttggattgattgagttgttatgcaccgttggtagaacaccagatgcaattttaaacttacttgaatgccccagcatccctactcatgatgcggttctgtattacaatgaaaggtggaacatgccatgccaaaacaactttgtgggttacgcgttcacaggaataaatccccaaaaaattaatattccaaaaggatgtaccatagatgaactgaaggatttgatcaagcaagtagcacctaaagggaatcctcctcatgggattcatgaatcccaacttgtaaggcgttggttttatcgacaacctgctcatttggagtattctgacaaagttttaaaatttgaaattattgagctgaaatctgacgacgatgtgttaaaggtgttggtagagtccaattactggaaacaatttgtgccaatagaaattttggctctctttagtaaagtggatttggaaaatgaggacgaggtgcttacgtccttgcatgtttga

SEQ ID NO: 14359 - DNA, 333 bp, Glycine max
  Peptide Sequence Number=SeqID_106044
atgaccatgattacgaattcgagctcggtaccccttgatgtgaaggcactgcaacgaacaatttcctttgagacaggcatgcaaagtagcctgcttgccctggctcttgctaataagttcttcgaagatccaaaagtggctattcctccagcaatttctagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14360 - DNA, 269 bp, Glycine max
  Peptide Sequence Number=SeqID_106045
atggcttttagagaaccatcatcgaaattgaaggctttctacgacattgccttcaaagacggtttgaaaccgtctttgtatgtcactaagaactgtcgtggaatgggctttctccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 14361 - DNA, 394 bp, Glycine max
  Peptide Sequence Number=SeqID_106046
atggctaccgcaccaaaagaaacttcagctcctggttcaccctctgtaccatcatccaccaaagcaccatcaaaccaggaacgacctgaattcaatatccaacccatccaaatgattcctggttcagcccctgttcctgaaaaactggtccccaaacgacaacagggagtgaagacttctgcaaaccctagccttgcaacaagtcctagggaagtagacacggagatggataagaagatccgcagtattgtgagtagcattttgaaaaatgcttctgaccctgaagctgataaagatgtcccaacatctgtcaacccaaatgtttctgtgcctgatgctgataaagatgttccaacatctttcagtccagatactgaagtcctccctttcacca

SEQ ID NO: 14362 - DNA, 252 bp, Glycine max
  Peptide Sequence Number=SeqID_106047
atggcctcatcaaactttctatttctcgaaggaaaatctattaataggcctcctatattcgatggagtgggttaccattactggaaaattagtatgcaaatattcatagaggttatggatttaaacatcaaggaagccattgaaatcggtccttacatccctacaatggtagtaggaaacacaactatagaaaaacccagggaacaatgggatgaagaaagaagaagggtacaatatgacttaaaggcctaa

SEQ ID NO: 14363 - DNA, 405 bp, Glycine max
  Peptide Sequence Number=SeqID_106048
atggcgctgaagacgacgttagactacgtgttattaggcttttcgtcttacagacagcaaaaagtttatacggataagcactcgggtattctgcccgtcagcgtgactcaaaagtcacttgtcgccgcgattgacgaaggtgaagacgacgttagattctgcgtgctatcaggcttttcgtcttacagacagcaaaaagtttatacggataaccactcgtgtatttccgcccgtcagcgtgactcaaaagtcagtatgacagatcttgtgagcgcggaagatgtaaatctccacgtgtcaacgggcttgtcggccgtgattgacgaagggcgcagaagacgacgtttgtctctgcgtgctatcaggctttacgtcatacagacaacaaaaagtttaaacggataa

SEQ ID NO: 14364 - DNA, 566 bp, Glycine max
  Peptide Sequence Number=SeqID_106049
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccccacatttttgtgtatgacattggcgatgcactggtgctcgtgactggtaaagtccctactgagccgtgtgcactgcctgggtttaggtctaagttacagctgggcaagctcttcgatgggttttgggcctctatcaaaattttcgtctcgtggatctatgtcaaactcattgccctggcttgttcggtcaaggctcaggcttga

SEQ ID NO: 14365 - DNA, 303 bp, Glycine max
  Peptide Sequence Number=SeqID_106050
atgaaggatgggtcatctgaggccaccgttccagaaccattcactgtagaggaggaggcaggtgagacacaggttagacaggaagctactgctacttttgaaaggtcgcgagaagtcacatcatatccacccacacttgtggtggacctatcctcatctcaacatgcagtaaacccctccactcctatactcgagataccagaggacccgaccacaccaatcctgactctaaacacttctcctccagctactccagtacttcatctgacagatgaggaagatgctcaggcacaggatacttag

SEQ ID NO: 14366 - DNA, 198 bp, Glycine max
  Peptide Sequence Number=SeqID_106051
gaattgctctcaaagcatcatcctcaattcaaagaaagtgatcaggataatgatgcagatgatgatgatgatctaagtttctttgtaaaagattcaacaaatttcttaaaggatgaaaagagtttcaatgatggtagttctgaaaatgaagagataaatctttgccttatggcaaaaagttacgaaagtgatgaagag

SEQ ID NO: 14367 - DNA, 257 bp, Glycine max
  Peptide Sequence Number=SeqID_106052
gcaagggaagtcggcaaaatggatccgtaacctcgggaaaaggattggctctgagggctgggcacgggggtcccaaagtcctttccgaacccgtcggctgtcggtggactgctgagctgcttccgcggcgaggcgctggtcgtcgccctcgggggacggattgggaaaatcgtggcctctcctcttccccgggcgtcgaattcttcgatgacaactctttgagaactggtacggacaaggggaatccgactgtttaa

SEQ ID NO: 14368 - DNA, 327 bp, Glycine max
  Peptide Sequence Number=SeqID_106053
atgtatggggtaggaatgaatgaaaaagtgaaggttattctaaggatgaatgctctcctagaacttaagcttttgaatcctagaaaacccatgaattgttggcagcctaaccccattacaagcctagaaagtccttcggattcattgttagccgtctctagaatatttccattggatttaatgatgaaatctgtgcaatttcaggttaaaaagaggctaagtcatgaagtgctaaaagtgacagttgagctcagctcaacagttgggctaagcgcgcatccatcgctaagcacaacttcaacgtgcttagcgtggcagaagaatctg

SEQ ID NO: 14369 - DNA, 375 bp, Glycine max
  Peptide Sequence Number=SeqID_106054
atggaaatttatgtgagtgatcgactaggaaaaaaagttgtcatcatcaaaaagggggagattgtagaagcaaagcttcatgatgaatcaagattgattcaaagatattttgatgataacaaacgtgatgacaaaaagctcaaaggtcaatcaaagaataagttcaagatgttcaagatagaatcaagaaagaatgagtttaagatgttcaagatagaatcaagaacacttcaagattcaagaggaaagttgatttcaagaatcaagaatcaagattcaaggatcaagcttccaagaatcaagatcaagattcaagaatcaagagaagacttaatcaagataagtagaaaaaggttttttcaaaaaactaagtag

SEQ ID NO: 14370 - DNA, 162 bp, Glycine max
  Peptide Sequence Number=SeqID_106055
atggacatcctcaccctgggtcaaggtttatgggataaaggggatgtcccacattatttccatgacacacatgcaacaatgatgattaggaaattttatgcaaaactggtcatgcacgcacccatgtggacactcaagcatcatgtttttatggtcacatga

SEQ ID NO: 14371 - DNA, 378 bp, Glycine max
  Peptide Sequence Number=SeqID_106056
atggaagtaaccatcttgcaaaaattggggcaaaagatgaatcgagttacatcgttgcttcgtctactgccaaacatatttaggattgttgatgtccttgttacttctagtttcacgttgacaaagatgtcatggaccatgttgaaaatcttccccgtgccgtcccttgggacggacgtgtggggtgctaataccttccccgtgcgtaaatacaactcccgaacctttcacttaaaagttcgtagatcacgtcttttccggtttttccgacgttttcctcaaataaacattggtggcgactccgcgcgtattcctttcgtggaacacgcatcccgcgagtctcgcgttgccctcccgccgaagggtaggttgcgatag

SEQ ID NO: 14372 - DNA, 168 bp, Glycine max
  Peptide Sequence Number=SeqID_106057
atgggtgttaaacactttgaggtggtcaaacgaaggtcgcctgctgacaaacaatgttcaatggcagcggaatggagaaggaagaaatatgattggagacgccacttcaaggagaagatgagtcaagcacaagctcaccaccataggaaaccatggataagagcttga

SEQ ID NO: 14373 - DNA, 231 bp, Glycine max
  Peptide Sequence Number=SeqID_106058
atggggggtgtaccaagcatctgggcccatctagaatattccagaaaagggattgctttaagtggaagcaacccagcttgcttgggtgagctgggcggcaaccacctcccacatttccttataaaatggcatgagggggagggggatgagtttaaggggttcagcaccatgatagctcataaatcccttaaaattagtgaggacaagaagaaagaaggaaaaactgaatga

SEQ ID NO: 14374 - DNA, 801 bp, Glycine max
  Peptide Sequence Number=SeqID_106059
atgccactggagaaggctccagcgctgcccagccagctaacacggattatgacaaccaccgataacagagcaccgagcatcaacagcgcttcgagaccatcaagggatggtcattcctcagagagtgggagctcaggatatgcgctcatgggtgcgggaccagtggatccccttcgatgcagatgccctcagccagttcttaggccacccgctgatcttggaggaaggtcagcagatttcgcccagaccactgcagggagacgggtgcagatcatgcgcaccaacatgaccaccctgacccagatatggatgacgttgctgctcagcaacatcctgccctgtgaccacaagtctgatctccctctaccgaagtgtcagctggtgtatgccatcctggcacaaatgagtattcacatggctcagttgattgctgatgccatttatcagtttgcaggaacggtgcctacgaggcaccctgtggacctagaaaagcacaatagggcattaggatttccatcactgatcacaggcctctactacaaagtcatccagtcgcctatcaccagagccttcgttgagaagtactgcactcccaggctagcgcagggtgctccaccaccacctctagagtctacctctaatcagttgtggagattggagcgcccgtacacgtggccgactacggagcagtttgaggctacagtagcatgcacggggattggcccgaggatcaaacaggacccgcctgcactcgtggaggtagggacgaggctgaggatgattaggacatggcagacatga

SEQ ID NO: 14375 - DNA, 297 bp, Glycine max
  Peptide Sequence Number=SeqID_106060
atgacaaagggtgcagaagatgacgttagtctctgtgcgtcaacaggctcgcttccccctggtgcggataaccatacagtatctccacacgtcatcgggctcacaggtcatgatagcgaaagtctctaccagaagatgctgacatcttcggaaagggtgcagatgaccacattggtctctacttgtgaatcagacttggggtctccgaatgatgagactctcggatcgctggatagcaaagggtgtgtgtgggttaccatcgggtgtctccgcatgccaccagactcttgggtcacg

SEQ ID NO: 14376 - DNA, 1170 bp, Glycine max
  Peptide Sequence Number=SeqID_106061
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccgaagcgggctttgtcttcaactcaagcagacaattcgaccaacagcttgttcaggcgacgaacgtacgccgccggatccttcaagctgtcacctgctgccagcgcagcctggtcgaacaggatgtgggaaagctccgcaaagcggtcctcgctctgttcgttatccagcttctcgatcagcgggtggctcgggttgaattcgaagatcggcttggagtccggcaccttctgaccactggcctcgaggatctggcgcatctgcaggcccaggtcctgctcgccgatggcaaggatcgccggagagtcggtcagacggtgcgagacacgcacttcggcgacactctcacccagggcggtcttcaggcgctcgaccaggccttccttctccttggcgacttcttcctgggccttcttgtcttcctcggagtccagcttgcccaagtccaggtcgccacgggcgacatcgacaaaggccttgccgtcgaactcattgaggtagctcatcagccactcgtcgatgcggtcagtcagcagcagaacctcgatgcctttcttgcggaagacttccaagtgcggactgttcttgacctgtgcgtaggactcgccggtcaggtagtagatcttgtcctggccttccttggcgcgggccaggtagtccgccagcgcaacgctctgctcgccgctttcgtcggcggtcgaggcaaagcgcagcaggccggcaatcttctccttgttggcgaa

SEQ ID NO: 14377 - DNA, 741 bp, Glycine max
  Peptide Sequence Number=SeqID_106062
atggtgtactacccgcggtccactctgatgctggccgggcatccgagagatcctcatcatcaccactccgcacgacgcggcccatttcgagcgtctgctgggcgacggctcgcagttcggcgtctcgctgtcgcgttcacgatcggcgcggacttcatcggcgatgacagcgtcgccctcgtgctgggcgacaacctgctctacgggccggggctgggcacgcagctgaaacgcttcgccgacatcgacggcggcgccgtcttcgcctactgggtcgccgaacccgaggcatacggcgtcgtggccttcgatgccgcagggcaggcgatctccctcgaggagaaaccgaaggccccgcagagcaactatgcggtaccagggctgtacttctacgacaacgacgtgatcgagatcgcccgcagcctcgcaccgagcgcacgcggcgagtacgagatcaccgatgtgaaccgcgagtacctcgagcgcggcaagctgcaggtcgaggtgcttccccgtggcaccgcgtggttggacacgggaaccttcgaccagatgaccgacgcggcggactacgtgcgcacgatggaacgccgcaccggcatgaagatcggcgtgccggaggaggtcgcctggcgtcagggtttcctcgacgacgatggactgcgcacccgcgccgaggccctggtgaagtcgggctacggcacctatctgctcgaactgctggaacggggaaagcgatga

SEQ ID NO: 14378 - DNA, 631 bp, Glycine max
  Peptide Sequence Number=SeqID_106063
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcctcttctgcagatgcatttcggggaatatacaaaaatagacccaaggatggggaatatactttgccattgatccatgtttatggattctccaaagcacgagatccagaatttgattttcacgaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgcttgcgccttatccggtaactatcgtcttgagtccaacccggtaagacacgacttatcgccactggcagcagccactg

SEQ ID NO: 14379 - DNA, 441 bp, Glycine max
  Peptide Sequence Number=SeqID_106064
atggggacaaatcaaaccggcaagaggttttaccaagtcaaggttaaaggcctagataccaccagcatcaaggaattagggcggttgatggaacctctccaaatgcaagccttccgcaagacttacggaaagatcttagagttgaccatagcagaggtatccatagaagccattgcatcactcacccaatactacgaccagcctttgagatgcttcacgttcggagacttccaattggtaccaaccattgaagaatttgaggaaattctaggatactcgaaacggcatagtgggcctaccacggaagtacctagaagacaaggcgaagggtatggccaatcaaggagattggatctcgtttatggatgtgttagctttgctaatttccggggtcgtcctctttccaaacgtagatggtttggtggacctagcagcaattga

SEQ ID NO: 14380 - DNA, 776 bp, Glycine max
  Peptide Sequence Number=SeqID_106065
atgacacgcgagtctgctgccagcctggagttgcttgatagcggcgacccgcaattgaagctggctatcagtcaggtgaagcaggtgctcaatcgtgacatccctatcctgattctgggtgaaaccggcgcaggcaaagaattgttctcgcgtgccattcacgatgccagtgcgcgtcgtgacaagccatttattgcagtgaactgtgctgccctgcctgaggggttaattgaggcagagttgtttggctatgaagaaggtgcttataccggcgccaagcgcaaaggcaatatcggcaagatacagcaggccgagggtgggaccctgttcctggatgaaattggggatatgccactgtcattacaagcgcgcttgttacgggtattgcaagaccgcagtgtgaccccgctaggttcaagcaagtcgattccggtgaattttatgctggtgagtgccactaaccagaagctcaaggataaagtggcggcaggcgagttccgtagcgatttgtattaccgcattaatggcttggccgtgcaattgcctgcattgcgccagcgacaggatatggcacgcctgattcagatgattttgcaaattgagcaagcgccgcaagtgaccttgagtgaagaggtcatggcgttatttgctacccatccgtggccaggcaatgtgcgtcaattacataatgtgctgcggacggcagtcgcgctggccgagggtggcgttattcaaaggccagcatttaacaccatgatttcctggatgacatggcg

SEQ ID NO: 14381 - DNA, 361 bp, Glycine max
  Peptide Sequence Number=SeqID_106066
aaatgatgctattgtcattagaggagtgcatgaagtacccacgaattcatcttcatcagctgagactaagaagcttaaagacttttgcccttctgtgcaacaatctgaagcaattgaacagcctgaagcttatgctgtaaacatctacaatagacctcctcaacctcagcagcaatatcaaccacaacagaacaattatgacctctccagcaacaggtacaatcccggaccatactttcctccaccaattcaacaacaacaacaaaaacagcaacagccccagaaacaacaaacagttgaggctcctctgcaaccttcccttgaagaacttgcgaggaaaatgactatgcaaaacatgtag

SEQ ID NO: 14382 - DNA, 562 bp, Glycine max
  Peptide Sequence Number=SeqID_106067
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgtcttttgttattggtgctggtgcggttatcttgtttggttaccgtaaggatgatgatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14383 - DNA, 289 bp, Glycine max
  Peptide Sequence Number=SeqID_106068
atgggtactagtaccctcaccttcagaggactagacgtcctcgccttcagagggctgtacgccctcaccttcagaggactacatgtcctctccatcagagggctgcacgccctcaccttcaaagggatacacgccctcaccttcagaggactacacgtcctcgccatcagagggctgcacgccctcaccttcagaggactacacatcctcgccttcagaggactagatgtcctcaccttcataggattgcacaccctcgcctttagagggctacgcgtcctcactttta

SEQ ID NO: 14384 - DNA, 444 bp, Glycine max
  Peptide Sequence Number=SeqID_106069
atggggatgtcaatttcccccatcacttcccgtcgagtaccatcaaaggctcgtaccaccatcgagctcggttttaaacgtgacgcactaaaaggaagcttttccaaagtggtcttcggcatcacattcaaacttgatccattgtcgataagaactcatgagcctcttccaaagtcactgtctttccttgaagaccctccttcttttcagccccttttatcacttggagaatccacttcttcgatgggggccatggccctacgtctgtgggctcttggaccatgggcgctttccccttcgaggcaattcccgagggttcaaccccaacccatatttgtatgggttccccctaatgtcgaccacatcggcattcccgtggctgtccttgcccagacctattccgagctcataaccgtgcctgagcatcacccgtgccaccattag

SEQ ID NO: 14385 - DNA, 845 bp, Glycine max
  Peptide Sequence Number=SeqID_106070
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattcgacaatagaaggcttacacttttgcccatattgtccctctcaaactcttcaatcctcttatttctccaaggtttggtatcctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14386 - DNA, 842 bp, Glycine max
  Peptide Sequence Number=SeqID_106071
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaaaaaacggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14387 - DNA, 287 bp, Glycine max
  Peptide Sequence Number=SeqID_106072
atgcacaagagccacaatctgtcagggaaattatcttttattgcacaacaacacgagaaattcagtcttttccacgtggttgctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 14388 - DNA, 444 bp, Glycine max
  Peptide Sequence Number=SeqID_106073
atggtggggtacacaccttcaagctttgttgatttagttttcaccgatgaaaggatcgaaatgagtctgaaaagaggcaaatttaatcatcctgcttggacgaatgagaaaactggggcaaatgaagagggtgagaatgagggagaaacccatgctgtgactgccattcctatacggccaagtttcccaccaatccaacagtgtcattactcagccaataacaacccttctccttacctaccactcagttatccacaaaggccatccctaaatcaaccacaaaacccacctaccacacaaccaatgctaaacaccacctttagcacgaccgaaaacaccagcgaaggaaggaattttgcagcaaaaaaaaaacctatagaattcaccccaattctggtgtcctatgctaacttgctccatatccactcgataattcaattgtag

SEQ ID NO: 14389 - DNA, 513 bp, Glycine max
  Peptide Sequence Number=SeqID_106074
atgtgggcatgggaacaatgcacgactttggctccaaagagaactactcccgtaatagaaaataaaccactcggacacaggtggctgcgacgtgaaaatcaacatattggcaatgatgatctgatagtttttcgtcacaaattgaatatcatgaaacgacatgagtttccgtgggagccttacacaacaactattatgtcaatgttgtctccaatttgtttggttggtagtgtagcgtggtgcgtggtggtgtcactcatttgtttccatgttgttgagtggcaccaacccgatagagtgctgcgacaatttggaatgcaacaacctattcccgaatgtcattcgcaaccactgaatatccatggtctaacgctaaaaggcaagcaagatgaaaattggtttcagctgttggccccaatgatcagtcaatggaccaatcgagctgagtttagggtcgacgtttatcctcgacaggatgacctattgagttttaactccgactacatggtctga

SEQ ID NO: 14390 - DNA, 342 bp, Glycine max
  Peptide Sequence Number=SeqID_106075
atggagaatccgatttgaggacaaatccttctcaagagggagagaatgatgaggacatgaccaagagcaagggcaaggatccacttgaaggacttggaggacctatgccaagggctagagtaaggaaagcaaaggaagctcttcaacaagtgttgtccatactatttgaatacaagcccaagcttcaaggacaaaagtccaaggcgaggctcacgggtgcgctttccaaaggaggaaagatgtgcggagtcgccaccaacgaaggtattagcaccactcacgtcgacaaaaacggggctcttgctcctacgtaccctccatcaaagaggaaatcagacctac

SEQ ID NO: 14391 - DNA, 279 bp, Glycine max
  Peptide Sequence Number=SeqID_106076
atggtgaaagttggaacctcttacgtgccgatcaacgtctcattttcgccaaaagttggcctcagcttcagcgcgaggtgtatcaacaggaccaggattatttatgagtcgagtcagcgacatcacagcttattcgcaaaccctgttccctcctgttcagctactgacggggtggtgcgtaacggcaaaagctaccgaccggacatcagcgctggcaagtggtgttcagtgacgtgcttcatgtggcaggagaaaaaaggctgcacggtgccagcatga

SEQ ID NO: 14392 - DNA, 75 bp, Glycine max
  Peptide Sequence Number=SeqID_106077
atggggggaggaggttgcatgacagctcgcctaggcgagttgcttacttcctccagaagcaacatgcttgcccag

SEQ ID NO: 14393 - DNA, 1044 bp, Glycine max
  Peptide Sequence Number=SeqID_106078
atgacatgccggtggaatgttggaacccaaaacacaatttataatgtgatagattttggtgccgtgggagatggcaaaacagacgatacacaagcatttttaaaagcatggcaaagcatgtgtgaagcacaagggacatcaactctattaataccaccaaacaaacttcaaggggtaatagttgcacctaccaaggatgcatgggtggaaggtaatctgaatactttgattatgatctcaaatgtaaacggtctcacaattgatggaagtggtggattaatcgatggctacggttctgcttggtgggcatgcaaatcttgtccacgaccatcggttcttattatcaattcctgcaattctgttagtgttactaatctgaacatgattaatagtccaaaatctcacatacacgtaaatggttgtgagggtgccacattttctcatattaatattagtgctcccggtgatagtcctaacactgatggatttgacatttctacttccaaaaatatcatgatcgaagattcaactatagccaccggtgatgattgtattgccatcagtggtggctcctcctacatcaatgttactgggattgcttgtggaccaggccatggaataagcctcggtaaaaagtttgatacagtccaagaagtttatgtacgaaattgcagcttcataagaactacaaatggagcaagaatcaagacatttccaaatggaatgggttatgcgaaacaaattacttttgaggatatcaccttagaacaaactcgcaacccaataattatagatcaagagtatcgtgatttaacgaatcaagcagttgaagtcagtgatgtgacatacagaggaattcatggaacatctctagatggaagagctattaccttagattgcggcgagtctggttgttatggaattgtattggatcaaatcaacattgtctcttgtttaacaggaaagtctgcttcgtgtttttgcaataatgctcatggaacagctacagctacaaatccaaattgtacttgcttattaccatga

SEQ ID NO: 14394 - DNA, 352 bp, Glycine max
  Peptide Sequence Number=SeqID_106079
gggcactgtttcagatgacataactagtgccaaagaattacttgctgaaattgaaaagcactttgcaaaatgcgataaggcggaaacaagtactctcatttcaaacttgatttccatgaagtatcaaggtaaaggaaataaatggtctcttaaagagatcatttcatactatgtgcaagaagaggaaaggttgaagcaagaaaggattgaaagtgctcatgttgtgagtaactccaaagacaagggcaaaagaaaaataactgaagagcctgagaatgaagctgctaagggtccagcacaaaagaaacaaaatcaaggtgacaactatttcttttgcagtaagcctggatag

SEQ ID NO: 14395 - DNA, 569 bp, Glycine max
  Peptide Sequence Number=SeqID_106080
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgatggtggctttggattagttcctggtgcagaatctcatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 14396 - DNA, 643 bp, Glycine max
  Peptide Sequence Number=SeqID_106081
atggctccgaaaaagctttctgcgaagagatctaggagggacaccgcggctgaagggaccagtgccgctcccgagtttgatagtcatcgtttcagaagcaccgagcaccagcaatgcttcgaggccatcaaaggatggtcgttccacagagagagatgcgtccagctcagggacgatgagtacacagattttcaggaggagatagcttgccaatattggacgtcgctggtcactcccatggctaagtttgaccctgatatagtcctggagttttatgctaatgcttggcccacagaagagggagtgcgaaacatgtggtcatgggtgaggggtcagtggattccctttgacgcagatgcccacagccagttcctgggtgacccgttagtgttggaggaaggccaggagtgcgagtttagtcagaggaggaacagggccaatgggttcaacgaagaggccattgcccagctattatgcataccgggtcaggatttcgcccggaccgctgcagggagcaatgtcttgcctagtgatcataactccgaccttcctctgctgaagtgtcagttggtgcatgccatcctgacacggatgagcgtccatgtggctcagttgattgctgacgccatctatttatttgcag

SEQ ID NO: 14397 - DNA, 210 bp, Glycine max
  Peptide Sequence Number=SeqID_106082
atgagatctttgtctcaacacattggagggtacatcctttgtggtacaagtagagggtacatctacttgggtttgactgagaacaagagaaggtacatctcttgtggatcagttctagtggagggtacatccactagggtttcaaagagaacaagggagggttggaaaagaaatctcaaggaccgcaggtcgcttggggactggatgtag

SEQ ID NO: 14398 - DNA, 297 bp, Glycine max
  Peptide Sequence Number=SeqID_106083
atggaatctaaacctttgggggtcctaggtaaccccaccatgaaatccatggagatgctatcccacttccactcaggtggccttgttggtgcttgcacgcttagcgcgaatctggaccgcttagcgcgcattagtgaatttcgacttagtgcgcgtcttctcgctcagcggatggactcaagcggtgcacttagcaggatgacacctcgctcagtgaacatgcacaactcatccttcttccagattcttcctcgcgctcagccaaaggagtgctgcgctcagcggatggctcgctaa

SEQ ID NO: 14399 - DNA, 393 bp, Glycine max
  Peptide Sequence Number=SeqID_106084
atggctcgactccacaaaggcgaaagcagccgagcatggctcggctatacacaaggcgaaaggcggccggcggtagttcggcatcatcgaggagcagttcatgtcttctgcattgagggtggttgcagtggtggggtcgccgaccagttcggcgacgtcgcgcacgttgctgctggtgcggcatctgctggcgtcgctgcagcagcgggtgcatgccagtgtggatctggtggagctggcgccaatcgcgcgctcgctgggtcagtcgtttgtcgcgcgatgaagtggaacccgccgtggagcaggcgctgcagacgatcgaggcggctcggctgctgggtagtggctgcgccggtctatcggggatcgtatccggggctgttcaagcacctg

SEQ ID NO: 14400 - DNA, 357 bp, Glycine max
  Peptide Sequence Number=SeqID_106085
atggggacactgggtcccgtggatgacattaatttcttcggtacggctggccaagacgggacggcggtggcctacacgcacgtccccacccctatcctgcagcaccgccgcacacctccacctccatccaaatccagcaccaccatgcaacaccgtcacccaatgccggcctacgcagcactaccatggaccaacaaagtcatgtcgctgcctaccggccacaatccatgcatgcaacttcaacctctgaggctttgtgagcgcaaccctctctcctcctcgacccttcagctcctccgtccctcatcggcagcaatggtcgtgtcgattgcaatgcagggcccaaagtcttgttaa

SEQ ID NO: 14401 - DNA, 318 bp, Glycine max
  Peptide Sequence Number=SeqID_106086
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttcgtcctgttgggaagtctcttcctggtgttaaacatgcgaatacgggtatatcgaattcctgcagcccgggggataaccactagttctagagcggccgccaccgcggtggagctcaacgaattcgcccggatatag

SEQ ID NO: 14402 - DNA, 143 bp, Glycine max
  Peptide Sequence Number=SeqID_106087
gtaatggtgcacgcaagatgctaagcaaccatgtcagcttcagtgcagctcccttatgtgcattatctggagggagtttgcctagtaactcgtcgcatgactcatcccaatgtaagaagctaggtcctgttgtcataccttaa

SEQ ID NO: 14403 - DNA, 75 bp, Glycine max
  Peptide Sequence Number=SeqID_106088
atgaaggtacacagggacggatgcaagtggggatggggtcacgaccgattgatcgtcgccccttctccgcgctaa

SEQ ID NO: 14404 - DNA, 357 bp, Glycine max
  Peptide Sequence Number=SeqID_106089
atggcctatggtggtgatgaattcgttcatcctgacaatgcggtaccagtttctctcactcggtccggttaccctcggatcattccgtctcatcataggcgtatgattctgaagaaggatgagaaagcggacatgctgatcattactttggcaaagaaggttgataaatcaacgttttctagtataatatccccacccgataatattgacgaggtggtggggctggttggttcgattaaggagaactttaatcgacttatcagtcgctatgctccctggataaaacgtataccccctggaacaaacaagggttacggtttgaaccaacctggaaagccttgccgacacactcattga

SEQ ID NO: 14405 - DNA, 456 bp, Glycine max
  Peptide Sequence Number=SeqID_106090
atggcttacactcacattccggattcaacaagcgattctcctcaaatttcagccagcccgtatcaattagaccttgcaccttacgcttcagagccctaccatgctcaatggaacgccccggggcttctccgtgacaagcacacgttgcgtttgagtcgtattctcggagaaatggaggttgatgaaccttggctagggttatggctaccattgaattatcaagtagatatgggatcaagtttagcatatgacaacggaatttggggtgaaccctacaggctttttgctgcaaaattcctttttgttgtggtcttcgtcattggaagtgcggtagacagactttgtgcccccccccccccgatggcctttgtggataactgggtggtgggtaacgaggaggtttgttattggctgagtaatgacattgttgggttggtgggaaacttggccgtatag

SEQ ID NO: 14406 - DNA, 135 bp, Glycine max
  Peptide Sequence Number=SeqID_106091
atggcttcaagcgatttttgcggacaaagcttggtttgttacagcacgaacgaccgattggattttgccttcatcaatggattcttttgcttcttgaagatcaatggcagcggaatggagaaggaagaaagatga

SEQ ID NO: 14407 - DNA, 643 bp, Glycine max
  Peptide Sequence Number=SeqID_106092
atggtggcggcgcttacactagtcatgccggcactgtcactgcgtgcacggctacgttcacaaatggggggagtacggcgggtatcacctcgaccgcctccactacgacgaccgccaggaatgcatgcaagactgcacccggctacatcatcacctctaacgcaaacgctgccgataccgccatccgcgtggcgcaagtgcctcccggcaatagctgctggttactggggcgctgcgggtgccgtagctggtccggcggcgcttacaccagctcatgccggcactgtcgctgcgtgcacggactacccgcgctccactacacacgcggatgcatgcacgttactgcacccggacactctcacgttcgcggtctacaacgctgcatccttccactctggccgcgcggcgtcacggtgcaaatctcggcggcgccggttcgacgacggcgagcagcggcgacacgttcagttacacgacgtattggaaaaccttttccaacgcaaagccgctaatgcgtacagccagacgtggactgagatcacggataccggcgtgaacaccggcatcggtgtatacatcaagtgggagtctggcgtgtcggtcaccgccggcgacgagggcgtctgcacgcgccgactggaaa

SEQ ID NO: 14408 - DNA, 210 bp, Glycine max
  Peptide Sequence Number=SeqID_106093
atgatattgcatgagattagaaggcctaactctctaaaaatagtccccagcggagtcgcctactgtcgcaacctaccctttggcgggagggtgacgcgaggcccatgggtgcgtcttccaagaaaggaaaacgcgcggagtcgccagcaatgtttatttgaggaaaacgtcagaaaaaccggaaaggtgtgtgtggtctacggactttga

SEQ ID NO: 14409 - DNA, 201 bp, Glycine max
  Peptide Sequence Number=SeqID_106094
atggaaaaatctaacaggaaaaccttcaaagataagaaagcaaagaaagcttacatcacttgggaagataacgatatggattcatttgaggattcagaaaatgaagtcgtgaatctaagtctcatggccaaaaattatgaaagcgaagaagagatgcactcaatgacttgcataaagaaccaatcaaacttgccaaattag

SEQ ID NO: 14410 - DNA, 942 bp, Glycine max
  Peptide Sequence Number=SeqID_106095
atgaagtgtcttcgatttagtcaaattcgggcttgttgggtggcgattgagctaggtggtcttgatctgggtgttcctgatagtggcataaagtgtttgaaggctcgcaaacttgcagataaattaccacctcttgatcttagggcattggtttctatggtgcttagtgtgagatttagttttctgttagtttggtcactatgtttagattgtgtggagttacagggagttcttgcgttcgctaagcgcaacactcattggctaagtgcgaggaagaatttggaagaagaagagctgtacaggaggtttcctggttatggaaagctaaaatcctttgttggatcttcccttggaaactggtctgattctgatgaccttgataggacagggctaagttgttgtacaatcacgaggaatcggggcaatttagttcctctggacttagaaattaaagctacattgagaaggaatagggccgagaggagaaggaaacttatgcaagacagaacagttgcatccattcttgaggaagagactcatttctctgacttactatcacctgattcaccatcatcaagggaatccgccactcaattacctaaagtcattaccatggaaaaagagcatgaccagaggattacccttgaggattactcaagtagttcagtaccacaatttttcaccaacattgcacgtcctgaagtgcaagctaacaacatcaattacccacattccttaattcatttaatacatgacgaagctattaggctcagccttttctcattctcattggcaggagaggtcaagaggtggctcaactcattcaagggtaagagtctgaaaacctgggaagaagtcattgaaaagttcctaaagaaatacttcccagagtctaagattgttgaagggaaagctgcaatatcttcgtttgggatcctctag

SEQ ID NO: 14411 - DNA, 448 bp, Glycine max
  Peptide Sequence Number=SeqID_106096
cggggggtgcgtctcggtgtcgaaacgggtgcccgaacgcgatcggtcgcagccggtgagtccggacggcgccgatcgcgtcgagcagcggcgacggaaaagggggaaacccaagattgaggcgccagttcgggaatcgcgagagcggtgcgggttgttacgcgacatcgtcgaggaacgggtcgacgaaggggcgaccggttcgcatgatggagtcatgcacgccgttcgccagtcggtgggcatcaccgtcaaacgtgcgatgcccggcgggaagcacgcgaacggccgcccgcgggcttcgggcggtgcgtgcacaagagcggaggagcgtggcgatgccccggtcgaagagtggggactgagacgtacgccgtgtttgtgcgaaacacaagccggttggtccgttcgcgcgcacgacgacgcgtttgaaacgcgcacggattag

SEQ ID NO: 14412 - DNA, 370 bp, Glycine max
  Peptide Sequence Number=SeqID_106097
atgtcagttctagaattgtacgtaaaaaaagatgttgctggtggttctatgtatcattctgcaaattttgttacgtcatgtggacataatatatctcatcatgagtcggaactgccaagaaatataagcaatttacatgatgatgatgatgattatcttgcatctaactcatacgttgaagactctttggatgaagatgatagtgttgatggaatatctgatacagacgatgaagtcaccgacatcattgaaccaatttcaattgttcacccaaccgaaggtgcacaaggaattcaaaatccattttggaatgatgctttgcattataacaatatcaattggagtcatccggacgaggaggacatttgcg

SEQ ID NO: 14413 - DNA, 180 bp, Glycine max
  Peptide Sequence Number=SeqID_106098
gccacttgatccaacatgtggcacttcttgttctaatttgtcatcttctagtaatactaataaggacattgtgtttgaacctaggaggagtaaaagatctaaaaaagttaaggattttggttctgaattttgctcttttctgcttgaagataatcctaaaacttatggtgaggccatgag

SEQ ID NO: 14414 - DNA, 756 bp, Glycine max
  Peptide Sequence Number=SeqID_106099
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14415 - DNA, 126 bp, Glycine max
  Peptide Sequence Number=SeqID_106100
ggcgaggatggacattctcaccctaggtcaaggtgtatggtgagttgggattttggctcaaggcttgtagaacgactggacatgatatatgtcagagcattggtttggccagcagttcagggataa

SEQ ID NO: 14416 - DNA, 383 bp, Glycine max
  Peptide Sequence Number=SeqID_106101
atggcggatagttttcttggggacatatcacagcagcaacttcatcccctaagggaggacacttggatttggaaacctgaacctgcaggagactactcaacaaaaagtggatatgatttgatatggggagagctgatggaggcaagacaggaacaggattatggggcaatatggaaactcaaaatacccacaaaaacagcagtgttcacttggaggctacttcgggatagattaccaacaaagcagaaccttagaaggagacaaataccaatagatgaaatgctatgtcctttatgcagaaatataataaggaggagggggatgaacacttgttcttcaattgtagcaaaaccctccctttatggtgggaatcaatgtcctgg

SEQ ID NO: 14417 - DNA, 508 bp, Glycine max
  Peptide Sequence Number=SeqID_106102
tatctccttcaagaggtttgctaagaaggaaagtcattttgtaataaagacaaacattacagaaacttcccttcttagacaacctccacatcttctcctttgtaaaaggacacttgttagcactgccatacctcttgagcttgatgttattcctcaagtaaaggagttgttggatgaggatttggtttgtaaaagcttaaatccttgtgctttgttggtgtccaaaataggtattattaggcaccaaatccctaagataggtggtataatgaatgtgttgagtagtgcaaccctcttttgtaaagtcacccatgcacccaacatcttcatgattcgcatacataggaactcattaggtgttgaaggaaaaagcgcagagtttcaagaacctctggatttgaggtcaaatcctcttcaagagggaggggatgatgcaatcctaccccccaagggcattggatacaagactccaagaaaattgggtcaaagatgcaggagaaggccctag

SEQ ID NO: 14418 - DNA, 811 bp, Glycine max
  Peptide Sequence Number=SeqID_106103
atggtgaaagttagaaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgggatgtggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagattttcctggaagatgccaggaagatacttaacagggaaa

SEQ ID NO: 14419 - DNA, 306 bp, Glycine max
  Peptide Sequence Number=SeqID_106104
atgggtggttatcgcgtccaattcgcaaaagcaccgagccggaagcatagcaagtgtaagccggggctgcgcaactgttgcggagggcgatcgggcgggctcttgctattacgccaggcgcaaaggggagtgtcaaggcttaatgttggtgtaacgccaggggcgaattggagctccaccgcggtggcggcgacgtctagaactagtggcccttacacgggctgcaggaatttcctggacatagaagcaagaacacatatttttgggaatagtgacgagggccgcggcaaagccgtttttccatag

SEQ ID NO: 14420 - DNA, 815 bp, Glycine max
  Peptide Sequence Number=SeqID_106105
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcttggttatcccaactagatgcagctaggaaatcagcctgtggagagaatgctaagccagtgactgtattgcttggtggttgcgaaacatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14421 - DNA, 980 bp, Glycine max
  Peptide Sequence Number=SeqID_106106
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggaggatcacttgagcccaggagttcaaagttgcagtgagctattcttgtaccacaccactgcactgcagccagggcaacagagtgaaactcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 14422 - DNA, 225 bp, Glycine max
  Peptide Sequence Number=SeqID_106107
atgagcaagagactccaagaggattgggctagagttgctgaagtaggccctagggttctcatgaaccttaggactagtgtcgcaacctacccttcggcgggagggcgacgtgagactcacgggtgcgtcttccaagaaaggaatactcgcggagtcgccaccaacgtttatttgaggaaaacgtcggaaaaactggaaaagacgtggtctacgaactttaagtga

SEQ ID NO: 14423 - DNA, 797 bp, Glycine max
  Peptide Sequence Number=SeqID_106108
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatttttgtgagaagagcacaaagggtttgggaagggaaggagaagtaaaggggagacaaggggaagggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14424 - DNA, 324 bp, Glycine max
  Peptide Sequence Number=SeqID_106109
atgagtcatcattcatctagtgttaatggtgagggtactagtcataaggaccctctatctagaatcttagatgagttgagtttcttcaagttatggaaagaaaaactagaaaggaaagaaaaagggaaagagagggtagaaataaatcaaggtgagagggaacaaataagggaagaagaaagaaggacaatactaaaagaattaagaaaagaaaaacatacatcctatagtagtcatgacccttgcaagagcctaagtgaagaacttcgtgactattatgaacgtacacaaaattgtgtgcctcaaatgaggtctgaactttga

SEQ ID NO: 14425 - DNA, 467 bp, Glycine max
  Peptide Sequence Number=SeqID_106110
atggagttcttgtggagagcgtacgcggacgagatggccctgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14426 - DNA, 1479 bp, Glycine max
  Peptide Sequence Number=SeqID_106111
cccggaatcgcggatcacccggtcggtctgcacgtgcagcggcatgtcggcggtttcgtgcgccagcgactccaccagttcgataaagcgctgcagcgccgacgcagcgcggccggccaacaccttgtcctgcatcagctcgcgcgtcgcctgccacagcgtcagctggcgatcgcgcgccgcctggcgcaccacgtcgagggtgcgatcgccgatgccgcgcgtcggggtgttgaccacgcgctcgaaggctgcgtcgtcgttgcggttggaaatgaggcgcaggtaagccagcgcatccttgatttcctggcgttcgaagaagcgctggccgccgtagatgcggtacggcatcgccgtctgcagcagcgcctcttccagcacgcgcgactgggcgttgctgcggtacaggatggcgcagtcgttcagcgcgccgccgttgtcctgccaggtcttgatgcggttgaccacgaagcgcgcttcgtcgagttcgttgaaggcgcagtagatggagatcggttcgccttcgccgccttcggtccacaggtttttgcccatgcgcccgtcgttgttggcgatcagggtgttggccgctttcaggatgttgctggtggaacggtagttctgctccaggcggatggtttccgcgccggggaaatctttcaggaagcgctggatgttttccacctgcgcgccgcgccagccgtagatcgactggtcatcgtcgccgacgatcatcacgttgctgttgccgcccgccagcaaacggatccaggcgtactggatactgttggtatcctggaattcgtccaccagcacgttggtgaaacgttcgcggtagtggttgaggatatgcggcttgttcagccacagctcgtgcgcgcgcagcagcagctcggcgaaatccaccagccccgcgcgatcgcaggcttcctgataggcctggtaaatgcgcagccaggtggcttctaccgggttgttgtaggtctcgacgtgctgtgggcgcaggccctcgtctttcttgccgttgatgtaccacatcgcctgacgcggcggccactgcttctcgtcgacgttcagcgccttgatgatgcgcttgagcagccgcagctggtcgtcgctgtcgaggatctggaaatcctgcggcaggttggcttccaggtgatgggcgcgcaacagacgatgcgccaggccgtggaaggtgccgatccacatgccgccctggctggtgccgatcagatgttcgatacggtggcgcatttccgccgccgccttgttggtgaaggtcaccgccatgatcgaatacggcgagcagttctccaccgacagcagccaggcgatgcgatgcaccagcacccgcgtcttgccgctgcccgctccggccagaaccaacaggttgctgcgcggcgccgccacggcttcacgttgtttttcattcaggctgtcgagcagatcggagacgtccataggcaccactaa

SEQ ID NO: 14427 - DNA, 727 bp, Glycine max
  Peptide Sequence Number=SeqID_106112
atgagcgttaacgcgctggaagcaatccgcttctacgtcagctttgcctgctcgttcgcctttgccgagcgcgaactgatggaaggtaacgccaagatcattcgtctgatcgcccgtgacgaagcgctgcacctgaccggcacccagcatatgctgaacctgatgcgtaccggtgaagacgaccctgaaatgaaagagatcgccgcagaatgtcgtgacgagtgtttcgatctgtttaagaaagcggccgagcaggaaaaagagtgggctgagtatctgttcagcggcggctcaatgattggtctgaacaaggacattctgtgccagtacattgagtacatcaccaatatccgcatgcaggcggtgggccttgatctgccgttccagacgcgttctaacccgattccatggattaactcgtggctggtgtcagataacgtgcaggtggcgccgcaggaagttgaagtgagctcctatctggtgggtcagatcgactccgaagtgggcgaagacgacttcaacgatttccagctctccggctcccggctggagtgcgcagacgaacaccctaatctgctgacgacgctggaagcacacaatgtgtgcgtcgagtttcagtgtcgcgaaagctactgcggctcctgccgcatgcgtctgctgaaaggcgaagtggattatgcggaaaccccactggcgtttattcagcagggcgagattctgccctgct

SEQ ID NO: 14428 - DNA, 222 bp, Glycine max
  Peptide Sequence Number=SeqID_106113
cgagcattcgctaagcgcgacactcagtggctaggcatgaggaagaatccagaagaagatgagctattaggttcactaagcgcaccgctccaggtcatcaagcgcactgcttcagctcatctgctaagcgagataagcgcgctgagccaaaaatcactaacatgcgctaagcggtccatacgtgcgctaagcgcacgagcacgaacaaggccacctatttaa

SEQ ID NO: 14429 - DNA, 186 bp, Glycine max
  Peptide Sequence Number=SeqID_106114
atgacaccggtaaaccgaaaggcaggaacaggagagcgcacgagggagccgccagggggaaacgcctggggggcggagcctatggaaaaacggctttgccgcggccctctcacttccctgttggaagttcttcctggcgaaacccacgcctatccgaattccgcgcccgttggggtaagccactag

SEQ ID NO: 14430 - DNA, 1239 bp, Glycine max
  Peptide Sequence Number=SeqID_106115
ttgagttgtgccggcagtctcgtgctgatgaagtctggtttgtcacatcgactgaaattggtgcttacccgaacgttgatcgtctgtttagccgtgtgccaatttctgagatcggtagtatttacgcctcttgcgatgttttggttaaactttccaccgttgaaggaatgtttggccccccgttggagatttatcatactggtggcacctccatcagttatgatgtgactggttacgacgaatatattgagcataatgtcaatggactggtgtctttcagccgccaaaaccaggaaatcatcgagtttataaaccgccttaaggataaccctgatgagctggctcaattgaaagcaaatgctttggctaccgctgaaaagtggccggattgggaaagcagttccaaagagttttcagcagcgtgcgagcagcttattgcatcgggagttattacctcggttaccttacttaaggcgcagacagagcgcttttggctcttctatgaggagtcattgcgccaggcgcagcaggggggacaggcgggcattccctctctaaatcggtatgcacattttcttgtggtgtgtacttacaacggtgaacgctacattgtcgagcagcttgcctcaattgtcggccagacaatctctccgcggaggatcattgtcagtgacgatggttctacggataatacgctgaaattgattgctaatttcgctgcaacgacgtcagttccgttcgatgtgcagcagcgtgttgcgggcccaaaagggcccgcgcataatttcctgcatgcgctttctttgacgacggcaacgaacgtctttttgagcgatcaggatgacgtttgggtaactgataaaattgaatattatcagcgagcggtcagccaaatcggcgatgagtccgtgccgttattaatcttttcagatgctgaattagttgacagcgaacttcgcttcttgagcgcttcttttttacagaatgagcgacttaatcctgatcaccagttggtgtttcctcgcttgcttttccaaaactgtatccagggtgcaactgtgatggtgaatcgatcactgcttaagcatcttcgccctagccagcatatgttgatgcatgattggtggctgggtttgctggctaccacttttggaaggttggtgttccttcctgaacgattgataaagtatcggcaacatgcgaataacgtggttggcagcagtggctatggattgaaac

SEQ ID NO: 14431 - DNA, 234 bp, Glycine max
  Peptide Sequence Number=SeqID_106116
atgttactggggtatttgagtaagaaaaactgtggtattgagattgatggggacctggtgttgagaggaatgaggataagggctacgtgggagtacgtgagctcagttaagggtgggcaactagggatggtgggttcatgcgtgatttgtggatgtggagagttgttttgcaccatcgcccgatcgccacctagtaccacatgtgacgggtaccccataatcctacaagcttga

SEQ ID NO: 14432 - DNA, 444 bp, Glycine max
  Peptide Sequence Number=SeqID_106117
atgggtgaagtagaggagatacaagagaagatgaaggccgacatggaggccatgaaagagcaaatggccatgatgatggccatgatgagcatgaggaagataatggaagccaatgcggttacaattgctgctaccagcactgttgctaaggtgaacccgatgcccccatctggcctcaaccaaatgaatcattcaacctcagctatggtaggcaaagatttgggaggtatggacgaccccatgatgtgcaaattcaaaatgagaatgccttcccgccatatggcttgcctctcaactatacgccacccaatgtggcgtacactcccaataagaatgtcaataactccactcctatacccattgagagtcagcaaccccaagctgatcatgcacatgtctcttaaaccgtgggggagacacatgaaattccccatcacaatctag

SEQ ID NO: 14433 - DNA, 881 bp, Glycine max
  Peptide Sequence Number=SeqID_106118
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttagagagcaaaggtctaggaattgagaaagtccttaagtttggagtggcaatgcaccactcaaaaggagcaaaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14434 - DNA, 782 bp, Glycine max
  Peptide Sequence Number=SeqID_106119
atggtgaaagttggaacctcttacgtgccgatcaacgtctcattttcgccaaaagttggcccagggcttcccggtatcaacagggacaccagtgattctttgctcttttgcgaactgagtatttccaagagtcagtgctccagtggcgtatcatggtttctatcagctgttcctcctgttcagctactgaaacggggtggtgttatccgctccaattcggcacacaagcatacacgccggaagcatcagcgcggcaaggaaacgctgtctgccattcgctgcattcaggatgaatcggccaactgttgcgcgaagggcgatcggtgcgggctttcgcgtattacgccagctggcgctaaaggcggatgtgtgcatactggcgattactatgttggcactgtaacgccagggactcactatggtccgcgaattctcgctcctgagctcgctaccgctcggtcgtcgactgcggcgacggaagctctagaactaggggcggaatttcccccggaaagctgcaggaattcgatcgtaacaaggaagtgcagagtctttgctcttgcgaacagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgg

SEQ ID NO: 14435 - DNA, 851 bp, Glycine max
  Peptide Sequence Number=SeqID_106120
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaagacctttggaatgtgcaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14436 - DNA, 261 bp, Glycine max
  Peptide Sequence Number=SeqID_106121
atggactgctttggtgtacaggaggtcttgagacttgggcccgaaatcttcacaaggcaaaggcgagagtcctccatcatggcaaagactgaactccctcctttgccttccttccatcaagtagaaacagttgacttgtgctgccgtggcctatcccagccaagtattggtcccaatctactctctctttccgatgcacgagcgataactcttgaagaccggatccacgggtgccttatgtcttgtcttcggaatgcttga

SEQ ID NO: 14437 - DNA, 242 bp, Glycine max
  Peptide Sequence Number=SeqID_106122
atgactcattggatgttggatgcccatccatacttttccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 14438 - DNA, 540 bp, Glycine max
  Peptide Sequence Number=SeqID_106123
atgactcaaaacacctctcccactgataccgtaaaaatcgccagtctggctgatgtcccgcaataccttgagactgtcaccgaatatctgcacggtgaatggtctgatttcgcccactgggcacaaaaagattttattcgtcaacgacttgaacaacgcctcctcagccgtggccgccacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14439 - DNA, 87 bp, Glycine max
  Peptide Sequence Number=SeqID_106124
atgcccaaaagaccatcttttctaatccacaatgcattgggcatcatggatcctaatggtggggatcaaaagttcgctatccggtga

SEQ ID NO: 14440 - DNA, 447 bp, Glycine max
  Peptide Sequence Number=SeqID_106125
ggcgatcggtgcgggcctcttcgctattacgccagctggcgaaagggggatgtgctgcaaggcgattaagttgggtaacgccaggctctgggacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14441 - DNA, 573 bp, Glycine max
  Peptide Sequence Number=SeqID_106126
atgaagcacttcactgacaccctcatcagtgccaacataggaacaaaagctggtaccgggccccccctcgaggtcgacggtatcgataagcttgatagtgcaattccttctgaatcggtacgaggatcagacatcaatcagattgagttggctaaaagtataatgctgcttttggtgcaattgatcgattataacggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14442 - DNA, 438 bp, Glycine max
  Peptide Sequence Number=SeqID_106127
atgctgatgcagaagccttttggtgatcactcgaaaattctgattgcttttatgcattttaaagctgaagcactagaacatacgaagaaaagagatacatgccatcaaagtgtgacattggacaatgagacaggagtttcaactatgctgaagatgggagattcagctaaagttgtgataaaacaagacatgaagggaagagagcataaatatgggtttaacaacaatgaacgtgagaagccagagaagaaaagggtggtggatgatgaaactggcgacaaacatgagctggatgaaaaaattacattagccgatgttaatcaattctccttcatcatgatcatttcgatttgcatgaacgtcgtcagcttcttcttctccgacaatgttaccagtgatttgagcggtcaaaggactaacataggtgtccatgtatga

SEQ ID NO: 14443 - DNA, 174 bp, Glycine max
  Peptide Sequence Number=SeqID_106128
atgggggtgcaaatagcacccaggcccacttgggccctccagaatattcctccagaaggctccgaggcgcttccgaatcgcttccgtaacgttttccgtgaagaatttcgcaaaggtttcgaccgttcttcgacgttcttcattcgttcttcctcgttcttcgatcttcaacgg

SEQ ID NO: 14444 - DNA, 333 bp, Glycine max
  Peptide Sequence Number=SeqID_106129
atggcatcgttcagccagatgcagtcccaatttcagtcccagatgcaatctcagggacttgcactgcctccaaagcctctggttggtccctcaggtcctcgagtaggcacaaaggagagttgtgttgatccctcaagaaatgatcctgagacgggtgactcagataggtgcggcttgtacatcgaagcaaatcatgcctgcctggttgccctgaggagagtttatgagggatcgactattgttcataacactcctttattgcctagccaagtaaaggtgggtgtggaggaggttaaagatccagatgctgcagttcctgtacccactgatgag

SEQ ID NO: 14445 - DNA, 769 bp, Glycine max
  Peptide Sequence Number=SeqID_106130
ccgctacgcgctgggccgcgattaccacaaagtattgcgcaatcgactgaaaaagctcggagaaaaaatccaggcccactgcggcgaactcaattttcgtccgtttgtcgactctgcgccgattctggagcggccgattgccgtcaaagccggactcggctggaccggcaaacattcgctggtgcttaatcgcgaagccggctcgtggtttttcctcggcgaactgctgattgatctaccgctgccggtggatgagccgcagcaagagcagtgcggccgctgcgtcgcctgcatgaccatctgcccgaccggcgccatcgtcgaaccttatgtcgtcgatgcgcgccgctgcatctcctatctcaccattgaactggaaggcgccattcccgaagcgctgcgcccgctgatcggcaaccgcatttacggctgtgacgactgccagctgatctgcccgtggaatcgctatggtcagctgaccgacgaagaggatttttcgccgcgcgcggtgctgcacgcgccgcagctggtcgaactgttcggctgggatgaagcccgttttctgcgcgtcacggaaggctccgccattcgccgcatcggccatctgcgctggctgcgtaacgtagcggtggcgctgggtaatgcgccctgggcacccgggaatctcacggcattagaacagcggcgcggtgaacatccgctgctggatgagcacattgactgggcgatagcgcagcagcggcaaaagcgcgcggcgcaggcggtagag

SEQ ID NO: 14446 - DNA, 809 bp, Glycine max
  Peptide Sequence Number=SeqID_106131
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaccacactttacgttggtgtttgtactttagcgaaaagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14447 - DNA, 426 bp, Glycine max
  Peptide Sequence Number=SeqID_106132
atgggtcaacttcaacggtatgcattccacaaagcctttggtaagatttgggacctagctacgatagaagtctccgtggaagcgattgcatcccttagccaatattatgaccaacccttgaggtgcttcacatttgaggatttccagctagtgccgactttggaagagtttgaagaaatcccgagatgcccgctgggaggaaggaaaccatatcttttctcagggttctatccctccatggctagagttgccaaggtagtgaaaatctcgacacaagagttggaccgggtaaagctaaaccgaaatagggtagtcggagtaccaaggaggtgtttggaggagacggcaaaggcctttgaaaatcaaggcgaatggacttcttttattgacatcttggcgcttttgatctttggagatgtcctctga

SEQ ID NO: 14448 - DNA, 549 bp, Glycine max
  Peptide Sequence Number=SeqID_106133
atggatgaatatttcagggtttcaaattgtaagagtgctaaggaaatgtgggacactcttcgattaacacatgtaggaactacggatgttaaaagatctaggataaatgcactaactcatgagtatgaattatttagaatgaatgcaatgaaaatattcaaagcatgcaaaagagatttacacatatcagtaaatcatctagaagccttaggaaaagaatttcagaatgaggatctcataatcagattcaacaagtttcttaaagtaagagggaatcagaggcgaccaaattttaaatcaaagagaaggacaaaaaattcatcctctactctaaaatgctttgaatgcaatcaacctggacatctgagggttgattgtcccatcttcaagaaaaagatggaaaaatctgaaaagaaaaatcatagtgaaaagaaactgaagaaagcatacatcacatgggatgaaaatgatatggaatcttctgaagattctgaaaatgaagagataaatctctgccttatggctaaaagttacgaaagtgatgaagag

SEQ ID NO: 14449 - DNA, 289 bp, Glycine max
  Peptide Sequence Number=SeqID_106134
atggtggtgagcttgttcttgactcatcttctccttgaagtggcgtctccaatcacctttcatcaggcttatcgataccgtcgacctcgagggggggcccggtaccagcttttgttccctttaatgagggttaatttcgagcttggcgtaatcatggtcatagctgtttccttcgggaaacctgtcgtgccaactgcattaatgaatcggccaacgcgcggggagaggcggtttgcgtattgggcgctagcggagtgtatactggcttactatgttggcactgatgagg

SEQ ID NO: 14450 - DNA, 306 bp, Glycine max
  Peptide Sequence Number=SeqID_106135
atgagcgaggaattcgcccggaatagtgagtcgtattcacatattctgactgacgcaccggtgcagcctttttttctgccacatgaacgcattcgtgactggaacaccctggcgttacagtgccaacatagtaatcgccagtatgcagcacatccgccctttgcgccagctggcgtaatagcgaaaggcccgcaccgatcgcccgttggccgattcattaagcagttgcgcagcctgacatggtcgactgggaaagcggcgccctgtagcggcaacgcaattaagcgcggcgggtgtggtggttag

SEQ ID NO: 14451 - DNA, 264 bp, Glycine max
  Peptide Sequence Number=SeqID_106136
atgtcaggctgcgcaactgcattaatgaatcggccaacgcgcgggcgatcgagtgcgggcctttgcgctattacgccagctggcgctaaaggcggatgtgtgcatactggcgattactatgttggcactgtaacgccagggtgttccagtcagacgtgcttcatgtggcagaaaaaaaggctgcaccggtgcggaagtgagagggccgcggcaaagccgtttttccataggctccgcccccctgacaagcatcacgaaatctga

SEQ ID NO: 14452 - DNA, 360 bp, Glycine max
  Peptide Sequence Number=SeqID_106137
atggcaaagatcttcgtacgtcttgggagtggggtgaattccggaaatggcctcggagggaagttccttgtcgtgttggaattaccagccggtcgagtcgtgttcggagttggcttggggagcttctccctctgggcgttcagtatgagccgagaaggcttgggtgatgttgcgcgtactgatgggtgcaccatgggtgtttgctggggtttgccgggtgttgaagtagacggcaaggggccaatgataagcatttttctgaggatggggacacccccatggcttgcagttgcgttagggtcataccacttcgggaaagggggttcgaggacccttccgggagttaccacggccaaatga

SEQ ID NO: 14453 - DNA, 279 bp, Glycine max
  Peptide Sequence Number=SeqID_106138
atgaaagtggcaagtgatgtccttgcagtagagcttttacagaaggatgcacggcttgctgctattggggagttgggaaaagcatgtcctggtggagcgacagtgtttatctcaacaacgtctttgaaagtagacattcaaagacgatgcttacctcagcaacgtcttagaatgcctactttcaaagatggtgttgaggtaagcatcgtctttgaatgtcagcttactaagacggtgtttatcttagcaacgtcttggaaagtaggcattctaaggtga

SEQ ID NO: 14454 - DNA, 396 bp, Glycine max
  Peptide Sequence Number=SeqID_106139
atgcctataggttttaacatttctcatttaattccttttgcaggtggagctgatattgaggaggaggaactaacagatttaaggtcaaatcctcttcaaggggaaggggatgatgcaatcctccctaggaagggaccagtgactagaaccatgagcaagaggctccaagaagattgggctagagctgctgaagaaggctcgagggttctcatgaacctcaggactcttcttctccttgaagtggcgtctcctctctctcttccttctccattccgcttccattcatcttccaagaagcaaaggaatccattgatgaagaagatcctaggcctacaagctccaatagagcttacaccagcaacagtcaagcttagcgagttcatcaaaaacccataa

SEQ ID NO: 14455 - DNA, 708 bp, Glycine max
  Peptide Sequence Number=SeqID_106140
atggctaaaaataaagtgaccataaagggaacagtggagccttatgcaatctgcaacatgattttgaagaaaacaaagataagagcccaagttatatcttcattgctagaagcaggggaaggagaacctataccttctcagcttactaagacggtgcttacctcagcaacgtctttgaaagttgctcacattctaagatgttacttacgtcaccttagaatgcctactttccaagacgttgctaagataaacaccgtcttagcactatttcttgcaagtattggtcttggcatgcttaagaaccttgtcaatcacgcatattcctccaaatacagagatgaagaagggaaaggcaaagagaatggaacaggggagaagaacacaatccataagctagccacgacacttgcgcttggaactcaaacttctccgcattgcttcggagagatctcttcgagatcaactacgcctccctttcaatcacaacaacacacgcacgcacaacaccgatcttgtcctccaccttcggtggatctacaagcttgtcagaatctccctcggcattcgcctgaaacattcagtggatcttggtcttcttcttcattgtcttcttcgtactccttggcgtcgaaaaaggcgtggaaggttgaggtcggagacttgaaggagaaggaggcatggaatttgaggggaaaaggaagggattga

SEQ ID NO: 14456 - DNA, 103 bp, Glycine max
  Peptide Sequence Number=SeqID_106141
atggcgaaacatgcgggcgttgaactccgtgaagaggactggcaggttcacggttacgatattccgctgttggccaacatacagccggccggcaaatggctcg

SEQ ID NO: 14457 - DNA, 463 bp, Glycine max
  Peptide Sequence Number=SeqID_106142
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaaccaatattcttgtccatagaaggaccaccctcggcagcaaaagaaagaaggaaactcgatctcatcgaagagagattgagagttgttgaaggctttggcgactatctgttcgcggacatggcaaatctttgcttggtaccagaacggtcggtcatccccccaaaattcaag

SEQ ID NO: 14458 - DNA, 810 bp, Glycine max
  Peptide Sequence Number=SeqID_106143
atgagatcagcggagccgttgtccatgcaggatcgcaattttgacgatattgctgaaaaatttgcgcgtaatatttacggcaccacgaaaggaaaaatccgccaggcggtggtttggcaggatctgaccgggctgctggcgcagttgccgcagcggccgctgcgcatcctcgacgccgggggcggtgaaggccatatggcctgccaactggcagaattaggacatcaggtgttgttgtgcgatctttctggtgagatgatccagcgcgccgcgcagctggcggagcagaaaggtgtgagccagaacatgcaattcgtacaaagttctgcgcaggatatcgctcaacatttggaacagccggttgatctgatattgtttcatgcagtgcttgaatggattgccgagcccgaagcggcgctgcgggcgttgtatgactgcctgacgccgggcggcgcgctgtcgctgatgtttttcaacgccaacggcctcttgatgcgcaacgtggtgttgggtaatttccaactggtggatcccgaggtcaggcggcgccgcaagcgttcgctgtcgccgcaatatccgcacgatccgctattggtctacggttggctggaacagctgggcatgcgcatcagcggcaaaaccggggtgcgggtgttccacgactatctgcagagcagacagctgcaaacacaaaaatttgaagagttactggcgcttgaacagcactattgccggcaggagccgtacgtgagtttggggcgctatattcacgtcatggcgcataaaccaaacctgaaggacgaactatga

SEQ ID NO: 14459 - DNA, 210 bp, Glycine max
  Peptide Sequence Number=SeqID_106144
atgaccctttcatcatggcagaacaagctagacaagtattttacgtgcaagacccttgtgatgaaagaagatgatgattcatacatggacacctatgttagtcctttgaccgctcaaatcactggtaacattgtgggagaagaagaagctgacgacgttcatgctaatcgaaatgatcatgatgaaggagaattgattaacatcctctaa

SEQ ID NO: 14460 - DNA, 633 bp, Glycine max
  Peptide Sequence Number=SeqID_106145
atggaggccataaaagagcaaatggccacaatgatggaggccatgatgagcgtgaagaagataatggaagccaatgcggttgcaattgccgctacccacgttgttgctaaggtgaacctgatgtccccatccggcatcaaccaaatgaatcatccaacctcagatatggtaggcaaagatttgggaagtacgggcagcccccataatgtacaaattcaaaacgagcacgccttcctgccatatggcttgcctctcaactatacgccacccaaagtggcgtacactcccaataagaatgtcaataactccactcctatacccattgagagccaacaacctcaatctgatcatgcacatgtctctcgacccatggaggagacacatgaaattccccaccatgatctagccaacttcgagccttgcctcggatatgctgctgaagggcaagcagttgggtggtatacccctacaaaaccctttggagggccctcagtatcatccccaacttacacctcttgcattccacaacaagtaaaaaccctcatgctatggcagaaatggggaaagttggatcatctagaggaaaggctcagggccattgaagaggtgaagattatgcctttgctaacctag

SEQ ID NO: 14461 - DNA, 309 bp, Glycine max
  Peptide Sequence Number=SeqID_106146
atgccgggtcggactcctgacctttgggatcgaattggcatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14462 - DNA, 358 bp, Glycine max
  Peptide Sequence Number=SeqID_106147
gacttagaagtagcagcaactccagaagaagaacctcgatcttctgaggcgtcttctagctttcctattccagggcaatctcatacagatttaattgaagaagttattatggctgaagagccaagaaaagtgaccctggaagattactcaacttccactttgatatgcacacctggagaagctaagaggtggcttcactcgttcaaaggcaacaatcttaagacttgggataaagtggttgagaaatttctgaagaagtatttcctagagtccaagactgcagaaggaaaaacaaccatctcttcttttcaccaatttccagatgaatccctgagtgaggccttagaaagatttcgtg

SEQ ID NO: 14463 - DNA, 785 bp, Glycine max
  Peptide Sequence Number=SeqID_106148
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccatccaaccaagggaagcctaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14464 - DNA, 1087 bp, Glycine max
  Peptide Sequence Number=SeqID_106149
cgccaccgattacaaagttaaatcaatcggaggtatgtgcatcttaatccaaatgtgggcatgggaacgatgcacgactttggctccaaagaggacgccacccgtaatagaaaataaaccactcagtcacaggtggttgcgacgtggaaatcaacatattggcaatgatgatcttagagttttccgtcgcaaattggatctcatgaaacgacatgagtttgtctgggagccatacacaacaactgtgatggcagcgttgcctccaatttgtgtggttggaagtgtagcctggttcgcggtggtgccactgatttgtttccatgttgttgagtggcaccaacctgatagagttttacgacaatctggtggaacaatcgagctgagtttagggttgacctttatcctcgacaggagggcctactgggttttaactccgactacatggtctgggaggaacacatggacagttgatgatcttgtgccttacgtggaaaagttggcgattatatcagaagagcaagagagagtcactgagccagtgtcacatggttcagcatcagagcgtgaattcccagcacaagagtttcacattcttcagtcaagtgttgaaactcggggcttaggcagacgaagggagcctattgaagtggagcaatattctcaacaaatgatggagcgtggtcatggaatgtattacacgccagcaacattttccgaatatccttcacagatgtatcagtatccttttgaaggtcatcacactgatacttctgcgagcgaacattcattcggtggtgttgcggaaacacaagctcatttttcatggcccactatgactccttcgcagcagcacgatgcccccatggcaacacctaacgccccatttgctccgcaatggaatgtacccggagcaatacctgatatgggcgacttattaggtgttgatttgcgtcaggagttttctgttgaggctgagcaagcagaagcggggagacaacgcggcagaagaaatcctgatcgtcaagcgcgaagatgggatcgaccatttggcacatcctcacgacatcgcggacaccataatgactga

SEQ ID NO: 14465 - DNA, 534 bp, Glycine max
  Peptide Sequence Number=SeqID_106150
atgaacttaagacgactgaaatacttcgtaaaaatcgtcgatatcggcagcctgactcaagcggcagaagtgctgcatatcgcgcagcctgcgctgagccagcaggtggctactctggaaggcgagatggatcagcaattattgattcgtaccaaacgcggcgtcacgccaacggaagccggaaaaattctttatacccatgcccgcactattctgcgccagtgcgaacaggcgcaactggcggtcaacaacgtcggccagaccctcagcgggcacgtttccattggtcttgcgccgggcactgcggcgtcttctatcaccatgccgctgctgcaggccgttcgtgctgagctgccggaagtgctggtctatctgcacgagaacagcggttcggtactcaatgacaaactgctcaatggccagctggatatggcggtcctttacgatcgttctccggtcgccgggatcaccagccagccgctgctgaaagaagatctctacctcgtgggcacccgcgactgtccggggcagagc

SEQ ID NO: 14466 - DNA, 564 bp, Glycine max
  Peptide Sequence Number=SeqID_106151
atggggctgcacatccttgccttcgtagggatacacgccctcgcctttagaggaccacacgtcctccccttcatagggctacatgccctcaccttcagaggactatgcgtcttcaccttcagagggctttacccactcgccttcaggggacttcacgtcctcccctttagaggacagcacgtcctcggcttcggaggactacatgtcctcacctttagaggactacacgtcctcggtttcagagaactacacgttctcagcattagaggactacacgacctcatcttcagaggactacacgtcctcgtcctaagagggctacacgccctcaccttcgtagggctgcacgccctcacctttagaggactacacgtcctcgaattcatagggctgcacgccctctccttcagaggactatacgtcctccagtttagaggactacatcttctcaccttcagaggactaaatgtcctcggcttcagaggactgcatatccccaccttcagaggactacacgtcctccccttcagaggactacacgtcctcacctttagaggattacag

SEQ ID NO: 14467 - DNA, 878 bp, Glycine max
  Peptide Sequence Number=SeqID_106152
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataatatctttagttcgtttcacaaatgggttgaccgaggtccagagattgtgggttgtgcccaagatcacaagctcaaattcatgtgcgatggacagagagcaagggttgccttggaatcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14468 - DNA, 378 bp, Glycine max
  Peptide Sequence Number=SeqID_106153
atggtttttcacttaaggcttgtaatgagcttcaaaacaaagaaagggggacataggctcaaaggggctatcaaaggaattaattcaaggaagcatcaacaagaattaagccaagtctattgtgcaagaaatcaatgtggcaaaacacaccaaaagaatatgatgatggatggctcaaattctcacaaagatcgggctgcacaatgcacaaggcaagataaaatgtcaaatgaagaattgaagttgcaggatccacgatgtcggatacaatgtcctgacatcctgcccgagaatactggagttgctgtacaatgcaagataaaagtcaagtgcagaagtgaagttgcaggatccacgatgtcggacacgatgtcctga

SEQ ID NO: 14469 - DNA, 482 bp, Glycine max
  Peptide Sequence Number=SeqID_106154
atggcgccccctggagttgtgcagtggagtagctctgcagaccccacccaactgacctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14470 - DNA, 432 bp, Glycine max
  Peptide Sequence Number=SeqID_106155
gggatggtgggtttatgcgcgatttgtggatgtggaaaacttgtggtgcaccatcgcccgaccgccacctagtaccacatgtgatggagtggtacctggagatatgtcgcgggggtcaggagaccttggggacgtcaggcgagctcctggtagtcaacagataaaaggaacaaagaccacaaagcaaggaggcttgtggtggctggccagctgtgaatcttgtgtgatatatgggttatggcctctggtaatcgattaccaagggcttgaaaacgaggtcaggaagctaggagatcttctggtaatcgattaccaagggaatgggtcactggtaatcgattaccagatcgtgatggcggcgcagctaatccatgatcgagtagagatggagtgcctagagggagcctgggagaccctcgaaggcaacacgag

SEQ ID NO: 14471 - DNA, 905 bp, Glycine max
  Peptide Sequence Number=SeqID_106156
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattacacaaataacgttggtggcgactcctgcgcattttcttttagggaaaacgcacctttgggttttctcctcgccctcccatcgaagggtaattacgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 14472 - DNA, 319 bp, Glycine max
  Peptide Sequence Number=SeqID_106157
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttgggtgactgcgctcctccagccagttacctcg

SEQ ID NO: 14473 - DNA, 322 bp, Glycine max
  Peptide Sequence Number=SeqID_106158
agttggggcaattaatgggtcaaacttcaacggcaagccttccgcaaagcctatggacttccagctagtgccgactgtgaaagagtttgaagaaatcctgggatgcccactgggaggaaggaagccatatcaccatctagtaccaaggaagtgttggaggaaagggcaaaggccttggaaaatcaaggcaaatgggctctcctttattgacatcttggcgcttttgatctttggagttgtcctctttccgaatattgaagggttagtggacctagcagtgattgacgctttcctcgcctttcatcatggcaaggaaagcccg

SEQ ID NO: 14474 - DNA, 630 bp, Glycine max
  Peptide Sequence Number=SeqID_106159
atgaggggagcgccaaccgcagaaagtctctcgcctttccttgcgagggatctaggcgcgcaaggtctcaaggttatacaaagaatccaagaggcgtggaggaggccgttgaggaaagacaaggagcttaggggcatccgtaatggcgtcatcggaggttatcatggatggctaagaattcacacgcgagggttagattggctctccaagttgaaagttatcgatgaggagaactttgaagctacgaaggaagatgaagaaaggaaaacgcgaccactgcaagagcccttgaacaagaaaccaaaagggcccgcaaggaggaataaggccgagagaaattccgaggagcattgtggggtccaaaaggagttcggctcaacacttggaagccacggagcaaagcatgtagctatcatagggcaatacaaggaagaattgaaccagtccatggcccatgaacaaaagctagtggaggattttgcacaagtgtatgccgaaaaagaagcaagagggagggtgattgatgcgttgcatcaagaagcggctatgtggatggataggttcgccttgaccttaaatggaagtcaagacctcccgcgtctgttagccaaagcaaaagccatggccgaa

SEQ ID NO: 14475 - DNA, 449 bp, Glycine max
  Peptide Sequence Number=SeqID_106160
atgggtgatcaagaggagacacaggaacagatgaaagccgacatgtcggctctgaaagaacaaatggcttccatgatggaggccatgttaggaatgaggcagctcatggagaaaaacgtggccgccgctgtcagttcggctgccgaagcagaaccaactctcttggctaccgcgcgccatcctccctcaaacacagtaggatggggaaggaacacgctggggcacgacggcaaccctcatctgggatacaaccgaacggcttacccttatggattgccgcctaactactcaccacccgtcatgcaagacgatgcgggccatatttcttctcccgtccttgaaggggagcctcctcaacagcccgacgaggtccacgaaaaccctcaagactatgcccgaagggatttcgagttctatcccccgatccccgaaggaccggcacccaacac

SEQ ID NO: 14476 - DNA, 117 bp, Glycine max
  Peptide Sequence Number=SeqID_106161
atgggtgttaaacattttgaggtggtcaaacgatgttcgcatgtcgataaacaatggtcctcggacgaaattaggccactagcgcaaatccaagaagtaaaacccgtgaaggcatga

SEQ ID NO: 14477 - DNA, 291 bp, Glycine max
  Peptide Sequence Number=SeqID_106162
atggctccaaagaagcttcttactaaaaaagggctagaaagaccaccacagaggagggatccagtgcaaccccacaagcggagattgagtttgatggacaccgtttccgaagcgatcaagggttggtctttcctcaaagagagacgggtccaactgagagaaggggagtacccagaattccagacggaggttgctaggaggcaatggacccagctgacaaagcccgtggctaaatatgatcctgagatagtcatagagttctatgcaaatacctggcctgtcataccctaa

SEQ ID NO: 14478 - DNA, 489 bp, Glycine max
  Peptide Sequence Number=SeqID_106163
atggcgagcgaggagccaacactccattttgaggctgagagcacttggaggcagtggatacccaatgtgatcaaagacgtggatcacttccttggaagcaaagactttgcctttgatgttttgatgatgccatatgatcatgatgatttgatgtcttatggaaatgcgcttctcaagttgaattcaagacaacaatccgagaatacaagatacaacatcaagaagatgtctagtattttaggaagggaattccaaattgatatagcaaaaggtttggccaagaaatttaagttaaaaagtctttttcaagagatttactctctgttactaaacgttattgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactctttaagtga

SEQ ID NO: 14479 - DNA, 132 bp, Glycine max
  Peptide Sequence Number=SeqID_106164
atgaaaatggataaggagatgtcatgtggcatcaactcacgtgacaaaactgatgtgaacctgagtaggagcggattgtttgatacaggctatggaggtttggatgacgccaattccggtgaaggaagataa

SEQ ID NO: 14480 - DNA, 243 bp, Glycine max
  Peptide Sequence Number=SeqID_106165
atgttttccaagaaggagggaatgatgagaatcctgaaactggccaaatacaggctaaaggcccaagtggagaagggcgaaggcccaagtggagaaggacaaagcccccagtggagaaggatgaaggcccaaattaatttgatggcccaaacttatcaaggtaatccttgtggcgtctaccctgacttatcttccttcaccggaagtggcgtcatccaaacctctgtagcctgtatcaaatga

SEQ ID NO: 14481 - DNA, 679 bp, Glycine max
  Peptide Sequence Number=SeqID_106166
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagatagcctactagcaaaccattttcctatcaaccctttatttgtctatattgcacttgccaggctttcaggctcggctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcgggagatttcctggaagatgccagggaagatacttaa

SEQ ID NO: 14482 - DNA, 803 bp, Glycine max
  Peptide Sequence Number=SeqID_106167
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaatacttccccctttctgtgcttatcttccttcattatacggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14483 - DNA, 827 bp, Glycine max
  Peptide Sequence Number=SeqID_106168
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccttggccagaccatccggctcattggcgtgaaccagcgagaagtggtcggcgtcttgctcaatggtgcgggtcatggtggcgaacaccggggtcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14484 - DNA, 1179 bp, Glycine max
  Peptide Sequence Number=SeqID_106169
atggcccagaagaagagcactccaatcactcctaccacatccagaaggagcaaggttgcaatcccctccaagaagaggaaagaaatttcctcatccgattctgatgatgatgtcgaactagatgtctcgacatcaaagagggccaagaaatctgggagaaaggtgcctggaaatgttcctgatgcaccattggacaacatctctttccactccattggcaatgttgaaaagtggaaatatgtgtatcaacgcagacttgcggttgaaagagaactgggaagagatgccttggattgcaaggagaccatggacctcatcaaggcagcaggactgctgaagactgtcaccaagttgggagattgctatgaaagtctagtcagggaattcattgtaaacattccctctgacataacaaacagaaagagtgatgagtatcaaagagtaccaactgatgggaatgtgtggatattgactgtttctgagcatcagattgccaaggaaatcactgccaaacaagtccagcattggccgaagaaagggaagctttcagcagggaagctaagtgtgaagtatgcaattctgcacaggattggagctgcaaactgggttcccaccaatcatacttccactgttgccacaggtttgggtaaatttctgtatgctgttggaaccaaatccaaatttaattttggaaactatatttttgatcaaactgttaagcattcagaatcttttgctgtcaaattacccattgccttccctactgtattgtgtggcattatgttgagtcagcatcccaatatgttaaactacactgactctgtgatgaagagagaatcgcctctatccctgcattacaaatattttgaggggacacatgtcccagacattgtcccgacatcagggaaagctgctgcttcaggtgctgtgtccaaggatgctctgattgctgaactcaaggacacatgcaaggtgctggaagcaaccatcaaagcctccacagagaagaaaatggagctggaactactgatcaaaaggctctcagagagtggcattgatgatgaagaagcagctgaggaagaaggagaagcagctgaagaagaagaagaagctgctgaggaagaggaagatgcagcagaagagacagaatcagatgatgattctgaagccaccccatga

SEQ ID NO: 14485 - DNA, 987 bp, Glycine max
  Peptide Sequence Number=SeqID_106170
atgactcctgctgaagccagaaatttaattgagaagatggcctccaactcccagctgtttagcgccagaaatgatgccatagtcattagaggagtgcatgaggtagctacaaacccatctgcatcatctgaaactaagaagcttgaaggcaaactggatgcactggttaacttggtaacccagctggccttgaatcagaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagagcaattatgacctctccagcaacagatacaaccctagatggaggaatcaccctaacctcagatggtccaaccctcagcaacaacaacagcagcctgcttcttccttccaaaatgttgctggcccaagcagaccatacattcctccactaatccaacaacagcaacaaccccagaaacagccaacaattgaggcccctccacaaccttccctcgaagaacttgtgaggcaaatgactatgcagaacatgcagtttcagcaagagaccagagcctccattcagagcttaaccaatcagataggacaattggctacccaattgaatcaacaacaatccctgaattctgacaagctgccttctcaagctgtccaaaatcccaaaaatgtcagtgccatttcattgaggtcgggaaagcagtgtcaaggacctcaacccgtagcaccttcctcatctgcaaatgaacctgccaaacttcactctactccagaaaaaggtgatgacaaaaatttacctaacaatttatgtgcagaagcagcacattccccctcttccattccctccaagagcagtttccaacaaaaaaatggaagaggcagagaaagagatcttggaaacgtttag

SEQ ID NO: 14486 - DNA, 241 bp, Glycine max
  Peptide Sequence Number=SeqID_106171
gcccacttgggccctccagaatattcctccagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaagaaattcgcaaaggtttcaaccgttcttcgacgttcttcattcgttcttcgatcttcaacgg

SEQ ID NO: 14487 - DNA, 574 bp, Glycine max
  Peptide Sequence Number=SeqID_106172
gactctgccagtcgttcggagtccctgtcgcacctagcaagggtgatgcaccacaggccgcggacgcgttgccaccacatcgggctggtccagccagatcatttgacacggagcagtatttgcggcattttgttcgccagcaggcggccaacaaccgggcacatgaccagggctttacttcttttccgtgccctactccggaccagttcagggcagaggtcgcatggcctggagattggcctgaggcccaggcaggaatcgcacccacaaagacacccagtggacccggagaagtccaacagggccctgggggtgcccgttccccccggcaaggtcacgtcatcatagggattgcgcctgcaaaacacccagtggacccgaagaagtccaacagggtcttggagttgtcaagctctaattacgggccccctactaaatcgagctttcatcaagaagtactgcgtctccaggcaggcgcagggcgaaacaccatagcagcctggggatggccggcagcgggcaacagacgcaccgccgtcacctctagagttcacctcagctcatccacaaaaag

SEQ ID NO: 14488 - DNA, 388 bp, Glycine max
  Peptide Sequence Number=SeqID_106173
atgttggtgcgcatgatccgcactcgtctctttgcagcggcacgggtgaaatcttgccccagtatgcatagtagcagtgtgatagcctccctctctagttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgtcctttcaacggtgaggtacccaaggtgagggcgtgtagccctctcaaggcgaggacatgtagtcctccggaggtaagggcgtgcagccctctgatggtgaggacgtgtagtcctctcaaggcgaggacgtgtagtcctctcaacggtgagg

SEQ ID NO: 14489 - DNA, 279 bp, Glycine max
  Peptide Sequence Number=SeqID_106174
atgaaggagctttccactaataagcggaagctcaaaggaagtgaacgaattagcatgggcataaatgtctccgcattgattggtaaatctgtcccccaaattcctgaaaaatgtaaagatccaggtcccttgcagtcaactgatgtggtaattcatttagctaatagaagtgttacctatcctgttggtttcatagaagatgtcttagttagagttggaaggattttctcaaggatcagttcccatcattctaggcagaccctttatgaaaactgctag

SEQ ID NO: 14490 - DNA, 365 bp, Glycine max
  Peptide Sequence Number=SeqID_106175
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccagccagttacctcggttcaagagtgtagctcagagaacttcgaaaaccgccctgcaaggcg

SEQ ID NO: 14491 - DNA, 609 bp, Glycine max
  Peptide Sequence Number=SeqID_106176
atgattacggaagccgagcttccggcgctgggtgccgattgcgaagcgctgcatttaggagccatcagcctcatccccgagccctgcggcagcacctatgaagcgctgatgacgcgcgagcatgaaagccgtgtcatctcgctcgatcccaatatccgccctggcttcatcaaggacaagcagtcgcatatggcccgcatccgccgcatggcccccatgtccgaaatcgtcaagttctcggatgaggaccttgcctggttcggtctggaaggggatgaggacacgcttgcccgccactggctgcaccatggcgcaaagctggtggttgtcacccgcggtgggaaaggcgccgttggctatacgaccggcgtcaaggtggaagttgcttctgaacgcgtggaggtggtggacaccgtcggtgcgggcgacacctttgatgccggcattcttgcgtcgctgaaaatgcagggcctgctgaccaaggcgcaggtggcgtcactgacggaagagcagatcagaaaggcgcttgcgctcggtgcaaaggcggcggcagtcaccgtttcgcgcgctggcgccaatccgccttttgcgcacgaaatcggcttgtga

SEQ ID NO: 14492 - DNA, 206 bp, Glycine max
  Peptide Sequence Number=SeqID_106177
atgggggtgcaaatagcaaccaggcccacttgggccctccagaagattcttccagaaggctgttgcttctggaggaagcaaccctgctcgcctgggcgagctggccgaggtgcttccgtaacgcttccgagatgtttcgtaagcaaatctgtgaaggttttcgtccgttcttcaccgttcttcatccgttcttcgttcttccacgg

SEQ ID NO: 14493 - DNA, 90 bp, Glycine max
  Peptide Sequence Number=SeqID_106178
atgggtgccaagtacctcgaagcggtcaagcaaaggttgcatgtcataaaacaatggtccccgaacgaaattaggagaatcaaaacttaa

SEQ ID NO: 14494 - DNA, 800 bp, Glycine max
  Peptide Sequence Number=SeqID_106179
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataatgctaactctaccacctggtctttccatttatcaatagctgtgtcaggagaattgagagatggcagtgtctacagagggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14495 - DNA, 486 bp, Glycine max
  Peptide Sequence Number=SeqID_106180
atgaagcacttcactgacaccctcatcagtgccaacataacactgccatctctcaattctcctgacacagctattgataaatggaaagaccaggtggtagagttagcattatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14496 - DNA, 830 bp, Glycine max
  Peptide Sequence Number=SeqID_106181
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaaagttgtatcaagaagggagcgtagtctaccggaaacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14497 - DNA, 742 bp, Glycine max
  Peptide Sequence Number=SeqID_106182
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaagtctcccatgctagtctgcagcaaccgcttcaatgcccaatgggcagactcaaccctacaaaacaatgcatgactttattcgtccatgcctttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 14498 - DNA, 123 bp, Glycine max
  Peptide Sequence Number=SeqID_106183
atggagatgacatcacaagagtacaagtatattggttcaaagtggggatgcaaggtctacaaggggagacatttggtgttgcgaggacagaaaaataaagtgttgggagatacttccgtttga

SEQ ID NO: 14499 - DNA, 240 bp, Glycine max
  Peptide Sequence Number=SeqID_106184
atgaagttggtgtgtgggctttgtttggagtcacaaagggattgtgagagggggtggctgaagagggtttgtacaagagtttctgccttctccttccagcactttcttgatcccagatctttccatatgccttgtgatgagaatcctgaaactgatcaaatacaggctaaaggcccaagtggagaaggacgaaggcccaagtggagaaggatgaaggcccagaagcagagacactattaa

SEQ ID NO: 14500 - DNA, 294 bp, Glycine max
  Peptide Sequence Number=SeqID_106185
atggccattgtcgagcatacatcgagaaatggcttaaggaatcgcgccgagagggctcattggcagctggttgttttgtgtcctacaaacaatgttgttgtgtggttttgttcaatgcgtgcatttaagacattaaagacgacttctgacgggaaaatagatcaaagtacaccccagtggattgaagtgaagtggtttggtgatggcacgccactagacatcgacaccatcacaacattacggaaaaaatgggcttttttaagagttagaagcctccaatatagaaagctttag

SEQ ID NO: 14501 - DNA, 399 bp, Glycine max
  Peptide Sequence Number=SeqID_106186
atgaagagtcgctttgaacgtcgtaggaagatggaagtgccttttgtttgcaagccaaccaaagaacaaacagtgaggttaaggactcaccatggagggatgcttatttataagccatctactatgtatgtcaatggtgagatcgttgaagaagaatggggttgggatgtggatactatgtcgtatattgacttgacaaaggtgattaagtctctcggcaacaactaccctgattgggaaaaagccatggcgcagattaaaagtcatgatgtagaagcttggaaggatctggaaaggttaaaccctgctgcttggacaagatctgcttttaagaaagtgggagttaactggaattccatgcactcattcaatagcatgcatgtggatcaatggtgctga

SEQ ID NO: 14502 - DNA, 705 bp, Glycine max
  Peptide Sequence Number=SeqID_106187
atggagaacttccctgtgatcaacttagagaatatcaatagtttcgaaaaccataatacttcactagtttttaagttaaacatagaattatgtgggcttaagaaatccaacagtttacaaccaagtttcattttgatttctcttaaacaacttgggaagctagattacttcttgggtattgaagtcaattctatggttgatggttctattcttgtaactaaaagatgtttgagagaggacttatgctcaaaggaaagaagtggaagctgttctggagagaccataaaaaggcaaaggggttttaacctagaaaggcatgctaagagaaacattttttatggcggctgtgatgaacatgaggcaggacttagctcctacactgcactagagagatgcaaaataagcagcaacaatgatgatggttatgatgaagacatggaagtggatttgactctaagcataggaggaggaagccaagttaataataacaagaatagtagtagtaagaaaccttatctgcttccgttagggtgctcagactcatccaatgggaaaactagggacctaaattattctgtctctttccaattagatagggtgggatatttcagtgaccccaccacccctatgagtagctcaagtgtgacatttgatcaagagagaaaggggccacattggctttctcaaggtttaaagcttaaatag

SEQ ID NO: 14503 - DNA, 312 bp, Glycine max
  Peptide Sequence Number=SeqID_106188
atgtcaataagatttgtgttgagtaacctgattgcaaaagcagtgtggacagcaaggtcaatgtctggagctaacaagaagatgattgaggcactaggtgctaggaagaaggaagagtatctgaagaatctgaagctttcaagagaagctgatgtgggatttatgaagaggtcgtgtctatttgttgtaagcgatgatctgaaagtgaggcaattgacaactacttctagcattcaagatatgcaagagccggggaatgtcaagtttgatgatgtgaaggaacatatggtggaaatcaggaagtcacatgag

SEQ ID NO: 14504 - DNA, 702 bp, Glycine max
  Peptide Sequence Number=SeqID_106189
atgtcttctccacttgcctcgcctcctcctcctcatcctcctccttcagacgcatcagcttcgtcgtctaccgtgaagcggacacgcaaagcctcacgtctacgatccttgtctactagaccacctggtgctgacagaccagtggtccacattgatcctactaccggcaaggtcaacgatccccacaggaagaaattaagaacatatttgaggattgtggcgcgtgataaggtggacgtcatgtacgagaactggaaggaggcggaatttgaaatctcagaggcttctgacagtaggacgaaaaagaagttgcttcagacagtcggcgagaaatggaggcagtttaaatcagacctcacaaggaaatgggtccttgcagccgatcaggacggtgtggacgacactcaagtgacacagggatccttcgtcccccatggacgtcaggatgttttcaccgccgctattggatgtccagagcaccctggacgtgtccgtgctgctagagccggtgtcaccatcaagcaatacttcggatcagctctacggacgtcccgcagctcttcctcgttgcctcctcaagaattgcagcagctgacccaacaaatcagggaccagctagtggagtcgatcacagaaaaagtgactcagcagctcatggcatcattcagccagatgcagtcccagattcagtcccagatgtaa

SEQ ID NO: 14505 - DNA, 1410 bp, Glycine max
  Peptide Sequence Number=SeqID_106190
atggaagctcattattacaatgggttcaacttgattgtggccgatattccgtcgaaatgcatggtttacatctccaacagtcccaaaggacaaccaattaccattaaagaggtctctcctggcctccatgttctttcaaacgccaagctggactctaagtggcataaggcacagcgtcttgaagtgggttttaaagaacaacttgccaaatatggggaaggcgaaatacctgtgaaggaggtagttcacaagctaatgaaggacaaaactaaagccgataacagtcatctacctcatatatgctctctcgattgggaattcaatttgagttccatatttgttgaagtagaaactccactgggtctatatggcactaggagtagtgctgctttaattgtaacatcaagtgaggaaggtccttattgttcatgttccttcttcactttgtctgattggtgtggtccgaaatggggtacttgcaaaaggtatttcgatgctcaagtaaaggaggtcgtggcgcaactgttagatcctggtttgacaccacgtctcttcaattgcccatgttggtgtcctcccaacacgtctacttcgagcacggtttctttagcttccactctagaagggaattcgtcttccactggcaatggggattctaatgacttccccgccttcttgaatcaacttctcgagagggtggccgataacataggaaaggttcttgacgtaggagttattgccaccaacaagattttgaggcttctttctccaaaagttatggaggcggaggcagattcccttgacccatttgttgaagtggtacaaaaaaaacaccaatgcgagttgatggagaagaaggtgtgccctccgattaccctttcagggatcatggctcaagctagtgccaacatggcagcattccgccttgctcgcggacatcacccctggactgccaaggagcctaagggaaaagacaaacataaaagtaagaagcagaactatgatcataagagtggctcggttgaacctttcaaccataaagatcctaggcataaagagttgaaaaggatgaagcaacaaatgttggagttcccttcggccaaaccccctgtcgtccctttcggccatggaaaatcaaggattctttatcaaggatcgagggtggaggtaattgctcaacaccttcaaggcttttcaaatactaataagttgaaggtcgacttggagaaggctaaaagctcctatgactcagctcttcaagccaatatcactttggccaaagacaattcaaatttgaaatggaagaaaagcttcagattgagcataaagcatataatgatgtttacaaagctcatgagtccaacttcaatcactacctccaacaagtactcttccattgtgaggtcctag

SEQ ID NO: 14506 - DNA, 213 bp, Glycine max
  Peptide Sequence Number=SeqID_106191
atggcgccccacctgacgtccccaaggtctcctgacccccgcgacatatctccaggaagactgactcttccacgcttcctcatatcaagcttattggattatggggcacccgtcatatgtggtactaggtggcgatcgggcgatgatgcaaatcaactatcccatttccacaagtcaggcataagcacaccatccccagttgcccacctttaa

SEQ ID NO: 14507 - DNA, 1251 bp, Glycine max
  Peptide Sequence Number=SeqID_106192
atgactctttctcacttttccgctgccattttcatctctttccttctcctcactctccaccaccacgccgaatcaactcagcctccctattcctgcgactcgtcctccaactcaccctactacccattctgcaacaccaggctccccatcagcaaaagagcccaagacctcgtctcgcggctcactctcgacgagaaactcgcccaactcgtcaacacggcaccggcgattccccggctcggcatcccgagttaccagtggtggagtgaagcgctgcacggcgtcgccgatgccggcttcggcatcagattcaacggcaccatcaaatccgccaccagtttcccccaagtcattctcaccgccgcttccttcgacccaaacctctggtaccaaatcagcaagactattgggaaggaagcgagggcggtgtacaatgcggggcaagcgacggggatgacgttctgggctccgaacataaacgttttcagggatccacggtgggggagagggcaagagactgcaggggaagaccctctgatgaatgccaagtatggtgtggcgtatgtgagagggcttcaaggggattcctttgaaggagggaaactgggtgagaggcttcaagcttcggcgtgttgcaagcacttcactgcctatgatttggaccattggaagggactagatcgctttgtctacgatgctcgtgtcacgtcgcaagatttggcagacacataccaacctccatttcaaagttgcatagagcaaggtcgagccagtgggataatgtgtgcctacaaccgtgtcaatggtgttccaaactgtgcaaatttcaatcttttaaccaaaaccgcaagacaacaatggaaattcgatgggtatattacgtcagattgtggagcagtctctatcattcacgatgagcaaggttatgcaaaaactgcagaggacgctatagccgatgtctttagggcagattattatctaaatgcaatcactatgtacacgatgagggaagctgctattggtcccaatcttcccacggaaaagtccattttacccgtcttcttcccccatcatctcacccactccccacgccccccaccttcttctcacccaaccccctgtggctccaccctccccacaccacagtcgtgcaaccataatcactaccaaccacctccacattgcgccaccaccttatcctatctcatccatgtcgcacaccaccacgagtccccaccatctgtcatgtag

SEQ ID NO: 14508 - DNA, 657 bp, Glycine max
  Peptide Sequence Number=SeqID_106193
atggagaatgctattttaaatcttccaccagaacaggaacagatggtctggttgattgactttcagggtttcaatatgtcacatatatcaataaaggtgacacgtgaaacggcccatgtattacaagaacattatccagaacggcttggtctggcaatactgtacaatgcacctaagttctttgaaccatttttcacggctagaatgagtccgaaaatgattttcgttcttgaaaaactttcaatgtttcagatggtaaagcccttattagagcccaagacttataataaagtcaagtttggttactctgatgatcagaacaccaagaagattatggaggatttgtttgattttgaccatcttgaatctgcatttggtgggaatgatgatacaggatttgacataaatagatatgctgagagaatgaaagaggatgacaagaagactccctctctctggacaagggaaaactctccatcatcagtcccaactcatgctcctttagattcgactaggttagaatcagatactgatgcttcagacaatgagaaaatagactcttcccctgaccccgtgatggatacaggtatcattaaccctgatcagaaaatcttggttaatgaaggagaaaaaaatgccagtgcagatattcattag

SEQ ID NO: 14509 - DNA, 297 bp, Glycine max
  Peptide Sequence Number=SeqID_106194
atgtatcctcttgatttcaggattgtcatcataaaaaagggggagattgtggaagcaatgccttccaagattattttgatgatgccaaagaatcaagagtcaagaaagttccaaagaatcaagaatcaagcaagtttcaagaatcaagatcaacattcaagattcaagaataatcaagatcaagattcaagattcaagattcaagattcaagtaaagaatcaagactcaagattcaagaatcaagaaaagactcaatcaagataagtattaaaagagtttttcaaaacattaaatag

SEQ ID NO: 14510 - DNA, 1905 bp, Glycine max
  Peptide Sequence Number=SeqID_106195
atggcaagtgaagaggatgagaaaaagatggaactggaacatgtgaccagcttgtcaagaagagatcatgaaagaccaaatcccttttttcgagtgagagcagttagcttgggtggttggttggttactgaaggttggatcaaaccttctctcttcgatggcattccaaacaaagacttattggatggaactagtcttcggttcaagtctgtgtcaacagggaaatatctatgtgccaagtctggagggggaaatgtcctacttgcgaacggcacaggtgcttcaacggcttgggaaacaattacattgtggaggataaacgaagatactttcagactcagggtgttcaacaaacagtttgtggggttagatgggattaacgttgttgctgtttccgatactcccatccattctgacacgtttcgaatagtaaaagaaagtgacagttcaagtcgtgttcgaatcaaagcacccaatgggcactttatgcaggcaaagacagaggagctggtgattgctgatgtttccaatgctaacggatggggagatgatgacccaaccatctttgagatgacaatcgttgcaaccttacaaggggaattccaattgacaaatggctatgggccaaataaagctccggaaattatgaaggaacattggaacacttttattgttgaagatgatttcaagttcatgaagagtcatggattagatgctgctagaattcccgttggctggtggatagcaagtgatccatatccacccccaccttatgtcgggggttccttgcacgcattagacaatgccttcaagtgggcacagaaacatggattgaaaatcattatcgatcttcatgctgcacccggctcacaaaatggctttgacagcagctctacaagagatggttctctagagtggggaaaaacatatgaaaacatcaagcaaacagtttacgttatagacttcctaactgccaggtatgcaaaaaacccgagcctttacgcagttgagctcttaaacgagcctttgtttcctaacgtgactctagagagcttgaccaagtactacaatgatgcttacaatgcagtgcgcaggcactcttccacagcttatgtggtgttatcaaataggttggatctctcaagtcaactagaaatcccaaacaccaaggaactcttccctcttgccacaggccttaggcgatgtgtgattgatgtccactactacaatctctattatgatatatttgaagacatgaatgcgcaagagaacattgatttcatctacaaagtccgttcatcacagttggataatattacaaccgtagatggtcctctcactttcgtggtgacgatagtggtagatgacagtggtaatagtgatggtaacattggtggtggtggtggtaatggcaaaggtgacattagtggtggtgacaacaatggcgatggaggtggttgtggtagcgatgacgaaggtgatattgttggtggtgatggtgatagcaatgttgtggtgatgatgatggtagtgataacaatgcctgtggtgattatgatgtcaatggtaacaatggtggtgatgataacggtgttagtggtgtcaccaagtggtagtgattgtttcgacgatgatgttggtggtaacggtgacaatgacattgatagttgtggtggtagcaatgccggtggtgatgataatatcagtggcgatagtggtggtagtagcggtgaatggactgctgagtggaaggttgaaggggctaccaaaaaggattatcaaagatttgtcaaggctgaattagatgtttttgggcgagcaacatttgggtggtgttattggacactcaagaacgtcaataatcattggagtttggaatggatgatcaagaatggctacatttaa

SEQ ID NO: 14511 - DNA, 171 bp, Glycine max
  Peptide Sequence Number=SeqID_106196
atggaggatttcatggctttggtggccaggccaggagtccaggcttcttctctgggggaagacacagattatgtagttgatatggtagcagctcacagcacctgggatccctggcctgctacagctcaggagacatctcagccagcccaggatgctccctcctcactttag

SEQ ID NO: 14512 - DNA, 412 bp, Glycine max
  Peptide Sequence Number=SeqID_106197
gccttaccaggttacatgggatgccaccgtgttcggggtctttaatccagacttcccgctctacataaagcacgaagacctctccgaaatcgcacatggtggtcaatgtctcagcatatcaatgttacagttgtggattctgcatctgactgaaacaagtatgcgagtggggaattctgatatctatggattcctcgagctacagtccattcagagtggacattggcagatggcggtcatcatgcccaaggaacacctagttgtctggttttgtttattgcatatcagtgctttaaaaggtcttgatgatgctccacagcctaaatcgaaggctcctgctaggtggattgtcatcaaggaagtactgagtgcggctattatgtcatgcactggatgtccaccatcagtttag

SEQ ID NO: 14513 - DNA, 318 bp, Glycine max
  Peptide Sequence Number=SeqID_106198
atgcacttggaagaagtaacccttgatatttttgtaagagctagtaaagggaccaatgacaactctaccaatgccaattggagaaatccaacctctttttttgttttcctttacattatagtgatgaaggaatttgagcacagtcggagttataaaaaacttgtaacacaaaatcctaaaggcacatatggctacccaggaggaattcagatgccactgggtataggtgacattcaactcttggagaatgtcaacctcaaaattgtcgaaggggacaatgaggtgcagattttgttggatcaagtggcctcagaataa

SEQ ID NO: 14514 - DNA, 246 bp, Glycine max
  Peptide Sequence Number=SeqID_106199
atgacaaaggatagtggagtgtcctgcttaatgacctggtcaattttcaggtatttgaaagggcaaagagaagaaaatctctgttattttcaagagtattttaatctatcaagagaaaatcctcttctaaggtttctccatgcgctaagcaggctgagtgcctcgcttagcggatgtcactcgctaagcgcatatgcctcgcttaacgagacaccagctgctagaacttctcttcatttgacctga

SEQ ID NO: 14515 - DNA, 261 bp, Glycine max
  Peptide Sequence Number=SeqID_106200
atgacggtgtcctcaccaccgacgttgacatactgccaaacaacgtcggtgccactgacgttgtattcttgcattacaaagacgggtcctaggatgactgatgttgttgttgtcgacatacaacgacatctggaacaaagacggtgtggggcccgtcgtagataccggttttcaaccgatgtagaagcttctttttgtagttgtgaaatcaccacaatttgtatcaccattagcttgatatttacgagtttaatgacatag

SEQ ID NO: 14516 - DNA, 966 bp, Glycine max
  Peptide Sequence Number=SeqID_106201
atgataatgatgcacccagaagagcaacaacaaccacctgttgaaggtgttattgatgttgagggttttccaagaagaccccatgacacatcagttctgagagattttcaaaatcacattgctttgagagaacgtcctgagttgaagctatcttcccatgaaaggaagatggctaagttcaggaggcctgctctagagattgaaggccttgaaactagtagtttccatttgcccatcggagaggtgactatcaccttggatgacgtcgcttcgttgctacatttgcctatcgtagggacgttccatagcttcgagcaacttcatgtcgacaacattgtcgatatgttggtggaattactcgaggtcagcgctgcaaaggcgagagctgagacgattcaatgtcatgacttttatgttcaactatcgtggctgcgagacttgtatcagatgaaaatcgaggcatgtcactggattgtaggaatgcgagcatattttttgtatttgcttggatgcacactctttgctaacaagagtgtcacatatgtgcacgtgatattcttggatacattgcgtgacttgacccaaattgggacttacgcttgggatgccgaggattatgacgagaggagaccgcgtgcatgccgatggacctctagcggggcactgcccgtgtcgacgtatcacaagggtctggacagactgacccctgacgttgtgtgttggatttcttgtggtgaccactattcatttagagaatttgagatcatctccttgtttttcgaccatctcagatggggttccttgacggtcattcaccgaccaaatagggttgtacgacagtttggtgactacgttgcacctgatccttctagagttccatcggttcaacaatatgacacatttgttgaaccagatgtgtatcagcaaccgatggcggcagcggcacctgatgaagcagacgttgat

SEQ ID NO: 14517 - DNA, 822 bp, Glycine max
  Peptide Sequence Number=SeqID_106202
atgggtgcagttactaaacgtccccatctatctatagtaacagaatatttgcctagtggcactgcctcactttactcattcacaccatctttgccttctcctgcacttcctcgccttcctcgtcccctgctcgaccaagctattcatttctctttcgccactctccttctcttctcatccctctccctcactctctgcaataaaaacgacaaccaaaaaagcaacaacgatgacattaaagatctcaacttcctcgaggaacccgatgacgtcgttgccacttctcactacaaccattttccagatcccaaccagttcgacaaggatggtgacaacgatgaggacaagttcagtgacttcgctggcttcgaccactcgttagaggaggcgtttaaagagtccaaggtggacgacaaggacgtcatcattttcaagaagcacaacttcaccatcgccgtaaaaaacaactgcttcgtcatggtcaagctctacgtgccctggtgcagccactaccaggccctcacgccaaagtacaccgtcgccaccaccgagctcaagcccaacagcgtcattctcaccaaggtcaacgctactgtcgaaaaaaattggcgagcgagtacgatgttcatggtttccccaccgtcttcttcttcatcaatggggttcacaagccctacactggccaaagaaccaagtaaaactcgctgcacagacgctataatgacatggattaagaagaagataggacctggtgtgtccaacattactacggtggaagaagctaaacgtatattgaccgcgaaaagaaaagttgttttttag

SEQ ID NO: 14518 - DNA, 513 bp, Glycine max
  Peptide Sequence Number=SeqID_106203
atgggaggtgggagcgaggttggtgtactagaggacactccagaacaaatccccacctcggaatgcatagcttggccacaatggcctggtgattgggataggtatggcaataatgggagtactccgattagcgctcccccgccgcaagaatcaccggggtctccagaaaagtattcaggtggtggcgctctagctcgtgtaagaactcatcatagtgtgagtaggctagctcaatcttcctctccagtaagatattctcgagataaacattggtatggtagcgatcccatgcctcctccgacacaaaatgagaggagtcataggattctcgaggcaccaaagcataaaagggatgaaggcactaagccacaagtatcgcaattagcgccctatggaatcagggtggatggtgcgctaagccgagaagtgaaagggtggttggctgagtgcatggggagcactaagcctgacatagctcgcaacaatgaacacaacaaggcttggcatgaatga

SEQ ID NO: 14519 - DNA, 465 bp, Glycine max
  Peptide Sequence Number=SeqID_106204
atgaagatagaatattatgtgaaggataagcaaacagctgtagttgaaaaacctgttgaggtcaaagaagttgaaaacccagaggaggctgcttctgaggaacccgttgctgagaaaactgtggaagaaacaactcctgttgcccctgcagttgctcaggaaagcagtgaagtcacccctcctcctgctgaagaaagcactgaagagcaaagtagtggaaatgttgaagaaaactctggcaatgaagatgcagctgaagagacccctgaaattaagcttgaaactgctccagcagatttccgttttccaactacaaatcaaaccaggcattgctttacccgatacgttgaatatcatcgatgcgtagctgccaagggagaaggtgcaccagaatgtgacaagtttgccaaatattatcgttctctttgccctggtgaatggataaaccatgcttcagttacatga

SEQ ID NO: 14520 - DNA, 291 bp, Glycine max
  Peptide Sequence Number=SeqID_106205
atgtgtgagtttggggaactcgtgctcactgcaaggatctttgtttgtttctgcttcaaggatttggatttggtttgtggaactcgtgctcactgcaaggtctgtttggggtgctcacagggtctcattttgagtgagataaggctagtgtttttgtacttgctaatcgctttcaggcatctagatcaagctcatccatcttctgggactgggttcctttttggtgtgaaatggcctagcaattatgctaaggatgttgtggcaatagctgtgtcacattccaatgtttag

SEQ ID NO: 14521 - DNA, 225 bp, Glycine max
  Peptide Sequence Number=SeqID_106206
atggttgttgctagtgacccagataaaggtagagttgaagaagccttgtcatgggtcatggagaagggggaagaatcacttggtgttggagccaaatatgagggggttgagtcaaaggcggtgacgaaggagaaatcgaagatgacggttgagttcgcgaaagtcctttttgtagtggccttgctttgtagcggcagaagagccaaagatggggggttgagttag

SEQ ID NO: 14522 - DNA, 183 bp, Glycine max
  Peptide Sequence Number=SeqID_106207
atggtggccatcctgcccaaggaacacctagttgtctggttttgttcattgcataacaggccagacaactaccttaaggggattattaacagtgctttaaaaggtcttgatgatgctcgacagcctaaatcaaaggctcctgctaggtggattgtcgtcaagtttaacatcagttatttataa

SEQ ID NO: 14523 - DNA, 448 bp, Glycine max
  Peptide Sequence Number=SeqID_106208
tggggttggtttcttaatgatgatgtcaaggttgatggtggatttgatgtatcgaagaagccttttaaggtgttagaggtattgcaaggctctaatgatttgacaatattgggtggcaccaatggttggtgtgttccatcatgtaacttgagagttgctgttatagataggggagtgggagatgaccatagattgcttatgaagtttgaaagcatgatcatggtgttgagagtctttgaggccaggaggttaggtcatgcatactacttcttcatggagggatccttgaaggaacatattgttgacatcaagttgatgcatatgccagctattgccaagggctatggaggagaatcattacctggtgaggacaatggtaacaagggttttgcaggcgtgattgttgagatggggaccattatggggaaggcatggtgggagttactag

SEQ ID NO: 14524 - DNA, 1833 bp, Glycine max
  Peptide Sequence Number=SeqID_106209
atgggttcttcggaaactatcaatatgccccatgccgtgtgcataccgtacccagcacaaggccacataaacccaatgctaaaactagcaaaactccttcacttcaaaggctttcacatcacttttgttaacactgagtataaccacaaacggattctcaaagctagaggtccttattcccttaatggtctcccttcatttcgctttgaaaccattcccgatggtctacccgagcctgttgtggaggccacacaggacataccttccctatgtgactccactagaagaacttgcttgcctcacttcaggaacctcctagctaaaatcaataattcagatgtccctccagtgacttgcatagtttctgatggtggcatgagcttcactcttgatgctgcagaggaattgggtgtccctcaggtgctgttttggacccctagtgcatgtgggttcatgtgttacttgcaatatgaaaaactcattgaaaagggcctaatgcccctcatagactcaagttatgttacgaatgggtatttggagactaccatcaattgggtaccaggcatcaaagaaattagattgaaggaaattcccagtttcattagaactacaaatttagatgatattatgcttgattatttgttgtcggagactaagaggactcaaagagcttctgcaatcattttgaacacatttgatgccttagagcatgacgttttggaagcattttcgtccattttacctcctgtttactccataggtcctttaaatttgctcgtagaggatgttgatgatgaagacttgaaagcaattgggtccaatctttggaaggaggagcctgagtgcatgaagtggcttgacaccaaagaacccaatagtgttgtctatgtgaattttgggagcatcacaattatgacaaatgagcaattgattgaattttcatggggtcttgctaatagcaacaaaagctttttgtgggtcgtaagaccagatcttgtggcgggtgaaaatgtagttctatctctagagtttgtgaaagaaacggaaaacagaggcatgttgtctagttggtgtccccaagagcaagtattaactcaccctgcgattggggtttttttgacacacagtggttggaattcaacattggaaagtgtgtgtggaggtgttccaatgatatgttggcctttcttcgcggagcaacaaatcaattgtagattttgttgcaaagagtgggggattgggttagagaaaatggtaagggagttgatggatggagaaaatggtaagaagatgaaagacaaagttttgcaatggaaggaattggcaaaaaatgctacttctggccctaatggatcttcgtttcttaatttggataatatgcaagaaaccaattgtatgttctattgcaaaaaatgggagattgggttagagattgaagatgttaagaaggacacaattgaaagtcttgtgagggagttgatggatggggaaaagggtaaggagacgagagacaaaggtttgcaatggaaggaattggcaaaaagtgttgcttctggccccgatggatcatcatttcttaatttggaaaacatgtttgtgaagttcttctgggcaaataaagtccagtgtgagatgatattggcattcttatcctttgccgattatttccgaccaaggcatttcttgttggagaatgtgagaaactttgtgtctttcaataaagaacagacattccgtttaactttggcttcacttcttgaaataatgagatgggttatcaggattggtgtccttgaggcaggaaaggttttaaaatactgcccgcaaccgtga

SEQ ID NO: 14525 - DNA, 699 bp, Glycine max
  Peptide Sequence Number=SeqID_106210
atgggaagcctaatagctagtaaggtgcaaagatgtgctgaagacatgtccatattgattaccacctatgaaggaactcacaatcaccctcttcctatgtcagccactgcaatggcctgcaaaacttctgctacagcttccatgctccaatctccctcattgagttcacaacatggattagttgattcagctatatcctccatcatcaactctagtgctcgttattacaaccctaataatgctctaaacttctctacacaccaagtttcaagaccgcaacaattctacttccccaactcatccatttcaaccttgaattctcaccccacaatcactttagaccttacaacacctctaacttcttcctcaaactcaagcttcacttgcatgccaaaatactcatcaacaaaccttaacttttcctccggtttctctcctctacattctcagcattctttccctaatcccattgttgctgcaactgaggcaataatcagaagcaacccaaaatttcaatcagcactagcaactgctctcacaacatatgttggcaatgaagctagtagtggtaggacaagagaaaatcatgttcttgagagtgcagaactaatgaagttaaagctgctacatagtgaaaatagtataggaaactcaagtatatttccactaccactatcggagcaaaagaacaggttttga

SEQ ID NO: 14526 - DNA, 417 bp, Glycine max
  Peptide Sequence Number=SeqID_106211
atgaaagcaccaatggtagtgcttggtattcgaggcccaagcaacctccgagaacaaagagggaaagagaaactagagctcaaggaagagaatggaacttctcacgtagtccttcagatgcatgggcatgatgctttgccttttgggccttgttgcttgcacccctgctctactattcgtatcaaatttcgttggtggatctttgaagtcatcacaaggtctggttacttgtggaggcctcctgcgagatcatcatggcagatggaaaataggatttgcgaaaaaagtgggggcttgtgtattgctagagatcaagggagaataggtgtgcttattgttagcaatcagggaacatcccaaaggcagaggcccaagagggcacacaacaagccagcacaccttaaggattttgtctga

SEQ ID NO: 14527 - DNA, 378 bp, Glycine max
  Peptide Sequence Number=SeqID_106212
atgtctgacttgaaagataaaaaagttttagggaaagtacttgcatatatttacacaattgaattccaaaagagtggattatcacatgctcatatcttgtttttttatcctgccagcaagtatccatcccctgcaaatattgatagcatcatatcagctgagatatgtgaaaagatgaagaataagaaggttgaagcagctggtgtctcgctaagcgaggcctatgcgcttagtgaacaacatccactaagcgaggcactcaactcgcttagcgagttaggagaatctggaagagaatctgccaagcatgcacacgctcagtgtgccatcagctcgcctagcgagtcatctgtctattctggcgctaagcgtgcctga

SEQ ID NO: 14528 - DNA, 234 bp, Glycine max
  Peptide Sequence Number=SeqID_106213
atggagaaagaggcatcacacataggatcatggaatgaaggcttcaatcccttctcgttctctctaacgtttgaaaaccctaacagagcaaccggaggaggagctctagagagcaccaagaatgccacaattgataacagagaacgaattaatgaaacattgagcttaatccggattttggttatggacttgaaaagggcaaataaagcagcgcttaccttagttaatttctaa

SEQ ID NO: 14529 - DNA, 222 bp, Glycine max
  Peptide Sequence Number=SeqID_106214
atgggtcacgaagatgaggacggggatgaggataacaacagtaacaacgatgacgacgacgatgatgatgatgataatgatgacaaaggtggtgatcatgccgtagatcaagaggacaacgaacacagacaaatccagtccaacaagatgagaaaccgagacgcatatctaggagaactcgttgtgggacatcgtctcattattggtttaacaaatatgtaa

SEQ ID NO: 14530 - DNA, 2157 bp, Glycine max
  Peptide Sequence Number=SeqID_106215
atgtctaggcctctgcaaagaggtgtgttaggtggggttagggtccctgagaggggctatgacttgtgggactcccaatctaaagataaaatagaaaaggaagatttggataagaggggttctgcagatcacagcccttttgctttgaggtttcctctgagggttcttttgggaaataattctgagtcaaaatatggcaatgtcaaagctgagaatggttttgcttctgatcccttcatggttggcaccccgcgaagcctgcttaagttgatgttgctttctttgaagttcagcttagtgtttatagttgttctggctcttactggatctttttggtggactttgtcgatttcatcctcatcaagaggtcacatttaccatggttatagaaggcttcaagagaagcttgtctcagaccttttggatattggcgagttttctcgtggtccgttgaggttgaaggagtcggaattctgttctgaggagtttgaaaactttgttccttgctacaatgtttctgagaatgtggaattgggagtttccgatggcaatgaagttgaccggcaatgcggccgtgagcttaggcagaattgtttagttctgccaccagtgaattacaaaattcccttaaggtggcctactggaaaagatgttatctgggttgctaatgtgaagatctcagcacaggaggttctttcttctggaagcttgacaaagaggatgatgatgctggatgaagaacaaatttcatttcgttcagcttctcatatgtttgatggtattgaagactactcgcatcaaatcgctgaaatgattggacttagaaatgaatcttacctcattcaagctggggttcgaactatactagacataggttgtggctatggtagctttggagcacatctcttcgacagtcagcttttgactatgtgcattgcaaactatgagccttctggcagtcaagttcagctcactctggagaggggtcttcctgctatgattgcttctttcacttcaaagcagttgccatatccatctctttcctttgatatgttacattgtgcaagatgtggcattgattgggaccagaaagttgactggcttctatttagttctggccctttcaactacgctaaatacctagctctttctcattccgatgagaaaaatggccttctcctgattgaagccgatagactcttaaaaccgggtggatactttgtttggacatcaccactcacaaatgctcgtaacaaagagaatcagaaaaggtggaagtttatacaggattttacattaacactttgctgggagcttctgtcacagcaagatgaaactgtcgtatggaagaaaactagtaaaaaaagttgctatgcatcaagaaagtctggttctggcccttctttgtgtggtagaggtattgatgtggagactccctattatcgagaattgctaaactgcataggtggaacacagagcagccgttgggttccaattgaaaaaagggaaagatggccttcccgggctaacttgaacaacaacgagttggcaatctacgtcttgcagcctgatgaacttaccgaggactctgacagctggaaaatagcagtccagaattattggtcactcatgtcacctttaatattttctgatcatccgaagaggcccggtgatgaggacccttcaccgccttacaacatgttcagaaatgtgctagacatgaatgctcattttggtggctttaattctgcattgttgcaagctagaaagtctgtgtgggtgatgaatgtggtcccaataagtggactcaattatcttcccttgatccaggacagaggatttgttggcgttttgcatgattggtgcgaggcttttccaacgtaccctagaacctatgacttggtgcatgcagcaggacttctgtcccttgaaactgagaagcacagatgctccatacttgacctgttcattgagatagacaggatacttcgcccagagggttgggtaataattcgcgatacagttcccttaatagaatcagctagacctctaacggcacagctgaagtgggatgcaagagtgatagaaattgaaagtgacagtgatcagagactcctgatctgccagaaacctttcttcaagagacaggcaagctaa

SEQ ID NO: 14531 - DNA, 426 bp, Glycine max
  Peptide Sequence Number=SeqID_106216
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttgactcagattcaatctactttgagagagtctgagacagtcttgttactttggttccaaaagttggggtctaagtggcatgtgcttggtgatccagactcaagctattttcatggtgatcagattcaatctacttcaggacgagaatggtga

SEQ ID NO: 14532 - DNA, 405 bp, Glycine max
  Peptide Sequence Number=SeqID_106217
atgaaaggaaacttcaggtccaccagtgaccccaattgtgttcaacacaaagacataaataagcgcacaaacaccaaagacaactcaaaatataggaaactctgccttgagtggctccaaaagcctaagtgttgtcgcaaccaccttctcctccgcaccgtcgccttcaaccactcttgcatcctttgcgtctatgtcggtgccaatctacagtgggtccccacttcgccaccaccgtgggcttctagatctccaacaccaaattcctacacgagcgtcgagggttacgatgtagtgttgttctccatgagaaggtggtcagagaagattgagaagagtgagaaagtggttggacctcttcaatccacgctggctatacccgctgtccttggcatcactatctga

SEQ ID NO: 14533 - DNA, 609 bp, Glycine max
  Peptide Sequence Number=SeqID_106218
atggaggaggggatgatggtggtggagagagtggtggtgtgtgggtctagggtgtgtatggaagagaaggatgtgaaggaagggctttttcttgttacgaatttggatgaggctgcgaatgtcttggtgccgcgaacgccagagagacttagggagcttgtagggtacacgttttttaagcctcctccgttggggtggttggcctcttgcttcctacttgatttcattgaggcacttctttacaaagtcataaagaaagtatctagcaaaccaaacggcacagacaaagtcatatcaagggcacttaagtgcaagaagaccgagattttcaatgagaggaagttccagaagaccgactatggcaccgatggcggtgggtctgacgacaccaaagcggatgaactccatctttgtcactcgaaacctttgcgtcttcggtcccgacttgaatccgaaaaagtgtctgaatcaagtttggggatagttgagaactggtttaactcagagtatgctgtgaaaataggaaaggatgagtgggatgttaagaaggttcgtgctgttctggagagagctagaggaggagttgagaaggctttgcttggcatttga

SEQ ID NO: 14534 - DNA, 129 bp, Glycine max
  Peptide Sequence Number=SeqID_106219
atgatccgtattttcaattcaaagcttgtattggcctctccagaaactgctactgatgcagattatgctgcaatattgggaaactttttaagggaaaacattgttcatcaagatttcattccatcataa

SEQ ID NO: 14535 - DNA, 306 bp, Glycine max
  Peptide Sequence Number=SeqID_106220
atgggtgagattccaaaggcattgaccaatcttcaattcctatcggtcttaaacctttcacaaaacaagatggtggggatgataccaacagggttatgtggcttgcctttgtcaaaatcttgccacaatgatgaaaaactgcctacagattcagcaacatttaagaatgatgaagaattctggtttgggttgaaacccctagctatatggtatgcatgtggaggggttttctaccatagcgataacatagatgccaaacatctgccaagcatgaatgcagacctacaacatttttcagtcacatga

SEQ ID NO: 14536 - DNA, 480 bp, Glycine max
  Peptide Sequence Number=SeqID_106221
atgtctggtagagggaaaggagtgggaggaggagttgctgttaaggatccatctgctccccttggagttcgacttttgatcgaggactatccttatgcttctgatgggctagagatatgggatgctatcaagtcttgggtggaagaatatgtctcattctactacaagtcagatgaggaacttcaaaaagaccccgagctccaagcttggtggaaagaaattgtagaggtgggtcatggggatttgaaggataagccatggtggcaaaagatgcaaactcgtgaagagttggttgaagcttcccctaccctcatatggattgcttcagctcttcataaccctgagaatgagtttttgaagactattactggcaagaaagagacccacactgaccttacagttatagaaattttatcaaggcacgcatctgatgagttctaccttcggcagagagatggtggtgactactgcgacttctga

SEQ ID NO: 14537 - DNA, 411 bp, Glycine max
  Peptide Sequence Number=SeqID_106222
atggcttctccacctgcctcgcctcctcctcctcctccttctcctcctcctcctcctccttccgacgcatcaacttcgccgtctgtcgtgaagcggacacgcaaagcctcacgtctacgatcgttgtctactagaccacctggtgctgagagactagtggtccatgttgatcctgctaccagcaaggccgacggtccccacaagaagaaattaagaacatatttggggattgtggcacatgataaggtggacgtcacctacgagaacaggaaggaggtccttactactcagaaggacttgatttgggaggatattcaggacggtgtggacgacactgtctgtgagaaatacaacctaagcaaggaaaaatgggcccagttttgccagactcgcagagacccttcttgggag

SEQ ID NO: 14538 - DNA, 198 bp, Glycine max
  Peptide Sequence Number=SeqID_106223
atgagtaagggatcgcgatctgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaagtccaaggttgttagtgggtcattactaa

SEQ ID NO: 14539 - DNA, 393 bp, Glycine max
  Peptide Sequence Number=SeqID_106224
atgacgtcatctatgcgttacaacatcgtttttggaacaccgttgttgaactgcattatccaaagacggaattacagggctaaaattaaggttagggttgcgcgagatttcgaaggtggcttgatcgtgagcgctcttgaaggagaattccttgccagagcaaatcttgttgaggacgtttcgctacttctttttcagccttcggatcttcttcacgagctgattcttgttgaaatcgagttggagcttctacttgatttggtcgcagaacaacgcggtgtcgttgtggtgcaaggatcctcactgcgatgtgtagtcgaggaacccttgcaagagctcgatgtcatcgtcatcggttcacaaccactgaaacagccgccgcgagtcatctag

SEQ ID NO: 14540 - DNA, 325 bp, Glycine max
  Peptide Sequence Number=SeqID_106225
atgaaccttagggtagaggacgccggaaaaaatggcggaagcttggtgacggtgagccttccggaagacccgttaggggttcttccggaacttccggaagaagatcttccggaagatttccggaagaagggttcttccggaggtaatgaaacgacttccggaagaacaggtcttccggaaagctctcgaaacacctcttccggaatgtctccggaagatgtacttcttccggaaacattccgaaagatggttcttccagatgacctttcagtggttccggaagcactttccgaaagacccttcttccggaatggttccggaagaa

SEQ ID NO: 14541 - DNA, 762 bp, Glycine max
  Peptide Sequence Number=SeqID_106226
gatcccccagcagctcctcctccagcacgtatgacagcaactccttctaccctacctcctgtagattttcaacgtttcgaggccatgcttcagaacatacatcaggggcagattattttactgcaaagcctacagctggtagcgcctccagactccatcccgacggtagagcaatttaatgaatgggtagcctggccagggactcaacctcctcttcacagggaagacgaagatcctgccgctcaggtatcccatcagccggaggatgagtcatcagagtcttccactcctgagcccttgatcaggaaaaggagggtagttataacccatgaagctgcagccacctctaaaaagtctcttgaagccactccagagcctctagcaccagtggcagataccacttctccacagcaggcagcagatccttccacgcctgaggatcaaaccaccctagtcctgtctctgaacacctctcatgtagctactcatgtacttcgtttgtcagaagaggagaagcgatcattcgctaagcgtgatactcagtggctaagcgcaaggaagaatccagaagaagatgagctatcaggttcgctgagcacaccgctccaggtcatcaagtgcaccgcttcagcttattcactaagagagagaagcgcactaagccaaaatccacttatgcgcgctaagcaattcagatttgcactaagcaagcctctgcatgcacaagagtctagccttggcttgaagcttttgcatgtttag

SEQ ID NO: 14542 - DNA, 267 bp, Glycine max
  Peptide Sequence Number=SeqID_106227
atgacccaccctaacaaagcatgcatctacgtgatcaaggatctcacaatcactcacaaactcatctcaagctctcagaacggcttccgcttcaagctctcgtctctgcagatcttcacacagcaaaatctctcagaactctttggaacttggacctttctctttctagaacttcctaaacatgcaaaagcttcaagccaaggccagactcttgtgcatgtagaggcttctcaagaagaaatgccaaactcccttcaaaaaatctga

SEQ ID NO: 14543 - DNA, 246 bp, Glycine max
  Peptide Sequence Number=SeqID_106228
atgctccaaccatatgggatcaacacaggcttaaaggagcactcaaatcgggtgaccccaaggcctacactccgaagagtccatcagggcctctccctcctgattcagggtcttagcattaactggtcgcccttaaagggacttagcattaactggtcgcccttaaatggtcttagcattaactcatcgccgttgaagggtcttagcattaactcgtcgctcttaaaggaacttatagtcgtgtga

SEQ ID NO: 14544 - DNA, 1487 bp, Glycine max
  Peptide Sequence Number=SeqID_106229
atggccattgagggattcgccgttgatgcttcttcagccaatggcttcaacggcaagataacactctcagttgtcatcacttgcatcgtcgcagcatccagtggtctaatttttggatatgacctcggaattacaggaggcgtgactacgatgaaaccatttcttgaaaaattcttcccagcgatattgataaaggctgctagcgcaaaaacaaacatgtattgtgtgtatgacgatcagttgttgacattatttacgtcctccctttttctcgcggggcttgtttcatctctcttggccagccacatcacgacggcgttgggtcggagaaacaccatgatcttcggtggctgcatcttttttgccggtggtgccattaatgctgctgctgtaaatattggtatgctcatattgggtcgtatcttgcttggcattggagttggtttcactaatcaagccacgccggtatatctttctgaaatagccccacccaaatggcgaggtgcgttcaacacaggcttccaattgttcaacaacattggcgtggtggcggccaattgcgtaaactacggcactgcgcggctgccatgggggtggcgcgtgtccctcggtcttgccatggtccccgcaaccatcatgacaatgggtgccctcctaatcccggacactccaagcagcttagtagagcgcaaccacatagatcaagccagaaacgccttgcgcaaagtgcggggccccactgctgatgtggaacccgaattgcaacaattgattgaatcctcacaggtttcgaaagccatggaacgggaaagttttgcagtcatttttgagcaccggtataggccccagttggtgatggcgtttgcgattccgttgtctcagcaactttcggggatcaacactgtcgccttttatgcgccaaacctgtttcagtctgtggtaatcggcaataactcggcgttgctttcggctgttatactgggactcgtcaaccttgcttccactcttgtctcaactgctgttgttgatcgatttggtcgaaggctcttattcattgtgggtggcattcaaatgctactttgcatgatttcggtggctgttgtgttggcagtggggagtggtgttcatggtacagaccaaatttcaaagggcaactccattgctgtgctggtgctattgtgcttctacgccgcaggttttgcttggtcgttgggccctctttgctggctgattccaagtgagatattcccaatgaagatcagatccacgggacaaagcatagccattgctgtgcagttcttgacaacatttgttttatcccagacattcttgacaatgctatgccactttaagtttggagcttttctcttctacgctggttggcttgtactcatcaccatctttgttatactgttcttgcccgagaccagaggcatttctttggattccatgtatgcaatatggggcaaacactggtattggcgccg

SEQ ID NO: 14545 - DNA, 567 bp, Glycine max
  Peptide Sequence Number=SeqID_106230
atgactgtgggctgcagaatagcctcaacttcattggaacaattaagccttttgttgctcatactacctctggttagttcttatcgttatgaaggagacgaggtcaacttgaacctggcaaaaactgaggcaaaattgctacatgagaagatttcaaacaaggcttataatgatgacgacttcatcaggatcttggccacaaggagcagagcacagattaatgctactttgaaccactacaaagatgcatttggaaaagacatcaacaagaacctgaaggctgatccaaaggacgagttcctgtctttactaagagcaactgtgaagtgcttgatcagtccggagaagtactttgagaaggttgttcggttggctatcaacaagcgaggaaccgatgaaggagcccttacaagagtggtggccacaagggctgaggttgatttgaaaatcatagcagatgagtgtcaaatgaggaacagtgtgcctcttgaacgtgccattgttaaggacacaactggtgactatgagaaaatgcttgtggcgcttttaggacatgatgatgcttga

SEQ ID NO: 14546 - DNA, 484 bp, Glycine max
  Peptide Sequence Number=SeqID_106231
atggtgtcaccacaagggcgaaatacatgggcagttgatgatctcgtgccatatgtggaaaagttaacgattttatcccaagagcaagagaggatcactgagcctgtggcacatggtccagcatcagagcgtccatttcccccacaacagtttcacatgcttcagtcaagtgttgaaactcgaggttttgacagacgaagggagattgttcaagcggaagatttttcccagcaaatggaccagcgtggccatggaatgtattacacgccaccaatattttctcagtatcctttcgagggtcatgacactgatatgtctgcaagcgaacattcatttggtggtgttgcggaaacacatcctcatttttcatggccgaccatgaccccttcgcagcaacatgatgccccaatggcaacacttaatgccccattaggtccgcaatgggatgtacccggagcaatacctgatacgggcgacttattag

SEQ ID NO: 14547 - DNA, 920 bp, Glycine max
  Peptide Sequence Number=SeqID_106232
acaaaattgaagctatggacgtaggaatcgacgagttcgggttgtgtgattctccaacatcagacgcaaccgttgatagcagcaacagcaagggtttgcttggtggacaaggattctctgagatcacatacattcacattcatgaatcaggaaaagtgtttccacttcatgatcacccgggaatgacagtgttgagtaagctcttgtatggctctgcctatgtcaaagcttatgactggatcgcattggattgtgctggaagccaaacaataggattggctgggagggtagtggatgaagtattcaaagcaccacatgagccatccatattatttccaagaagtggtggcaacattcattctttcacagcgttgacgccatgtgcaatactagacgtgctatctccaccatactctgaagagtttggaaggccttccacttacttctcagatatccctatcccttctcttaatggttatgccatacttgaagagaaaccaatgcctagtgatctagttgttcaaggagcaccataccttggaccttcaattgtaaccgtggacgattatgtggggaggggaactctcttcaccaaggttgcaaaggagaagatgaatgaagaccgcgctagaaacactgccagaccagtgcagagtataagagatgctcctcaagaagaagggctacgatgggtgcaaggctcttctttctgggtatttgccctttcaaggcccattgctttttccacgaaggagtctttcgttgaagataacattgatttcaacggggaagatgctcttaatgtgaattgtaataacagcaataacgataataggaaaatgattatggtgcatcattgtgggaaatcgtcttcgataacctgtggcagagtaacgggagagaagaagagaggtagctaa

SEQ ID NO: 14548 - DNA, 1290 bp, Glycine max
  Peptide Sequence Number=SeqID_106233
atggattctggcaacagtggaagtatctcttcaagtggtgatgaagaatacgattcacgagctgatcacacagtactcccttccactttcatcaataaccaccaccaccaccctccttcccaatttggctccatctcacaacaccctcttgttgcttcttctcattaccaacaacaccaacctcacccttctttgtttgatctctctccaagctacctccacgccctctctcaaccaaactcattcctcaacttggacaccaccacatcctcgtcgcaacctcgaagatctgaacccgattgcacccttaatgttacctcatcaccacctccaccaacaacaacaaacatagaccaatgtttgttgggttctcaaggaggcctcaacgtggacaatgcaagacgagacacaattctgttcgagtcaggtaagaccagtaaccttggtcgcaactcgaagaagcgaaccagggcttcgaggagggcaccaaccacggttttaaccaccgacacatcgaatttcagggccatggttcaagagttcaccggaatccctgcaccaccgttctcagcttcttcctcgtactctcgaaggctcgatcttctcactggctcatcctccttaagaagcttctctcacttagacacaacaacgggtcctttctaccctttgcgtccttccccacaaaaggtacaccatcatcatcatcatcatcaaaacccattgcttttatcttcctcatcatcaccttataataacatggttgatgctatagcttccactaccaccaccaacaattcttcatctaataacaacaacaacaacaacaaccccattaacttccaacaacaacaacttcctcctgatttgggtttaccctatcatcataacccacagaacatcatgttgagcatgcaagatcaccctactcttgcatttcaccctcctccaccacctcttcatccttttgggttcagtgcaaagttaccatcaattgaggatctgggtatgagccatggccaagtcaataataataatccaaattttgttgcaagtgggcatgtaacttctgaaggggtgccactgaggagtgtgaacaatgatggaggaggagcaagagatgtttcgttaaggtcattggatggtggtagctgcaagttgaacttttctgtggcttctgcgtccactagcttgaaccatgagaagagcaccttacaaaataataataacgcttctactggtactagaggggaaggtaccgtggattcatggatttgttcttctgaatag

SEQ ID NO: 14549 - DNA, 207 bp, Glycine max
  Peptide Sequence Number=SeqID_106234
atgagtgcgactgacggaggcgacgatgtcgataagtcagggcttagaatcggacgcaagctaagcgatgaagaggacgacccatgcacgtgggatgggaggaagaaaagatcttcaaattgccaaatgcaggcacaagggagctcgaaagtgaaaggtgaggggaccgaaaatgggagagcagaagggatgaagatgagggagtga

SEQ ID NO: 14550 - DNA, 105 bp, Glycine max
  Peptide Sequence Number=SeqID_106235
atggcctttactctggagtggagagatgcaaaagaagaggaaaatgatggtgaaggggaagaagaagaggagttagaggaagaaaactcgcattcttcctcgtag

SEQ ID NO: 14551 - DNA, 321 bp, Glycine max
  Peptide Sequence Number=SeqID_106236
atgattcttgccaaatttcaagtagaaaaaaagaaccaaataaccttaacctcgaagcattcaacatgccactcaatctcaacatttcaaaactacaaccttagccttaactcttccattggaaacaccaaacttgtctctacttctaaactaggaagagtcgatcctgaccgtgataagatagatatcgaatacttcttcaacattctagagcttgagaagaaagggttaagattgaacaagaaccttgaactctatggcatacgggcatatttcgatgatcctcaaaaagtatatcttgaactcatcaggaccttatag

SEQ ID NO: 14552 - DNA, 492 bp, Glycine max
  Peptide Sequence Number=SeqID_106237
atgactctgaaattgacttattaccctgaattggttcgagtgttttataacaacctggaaattcatgatggagtgatattttttgaagtgaacaaaagaccaattgttgttgattactctttgttttactccttaaccaaactaagcagtcaaggtctgccttttgagggaaccttagttgatgattggaaaccaatttattctagtcatgatgctagtgaaatggtttgtgttgcaaatgttgatatgactggtcgcttacttactggttcctttacttttgaatgtcgtatcatgcattacattcattgtcgggtgttgcttcctcgttctactaaccttgctcaagcctctgaggaagatttaattaagatgtgggcactgcaaactggatgccaaattgactgggcacatcttgttcgttaccgtatgcataaggcattatgggcaaatgccccctaccatatccccatctggtcactctatttttga

SEQ ID NO: 14553 - DNA, 813 bp, Glycine max
  Peptide Sequence Number=SeqID_106238
atgaggtcctgggtgaggggtcagtggatcccgtttgatgcagatgctatcggccagctcctgggatatcctttagtgctggaagagggtcaggagtacgagtatggccagaggaggaaccggtccgatgggttcgatgaggaggccatcgcccagttgctatgtataccggggcaggattttgcccggactgctgccgggagacgggtgcggatcatgcgcaccaacatgaccaccctgactcagatatggatgactttgctgctcagcaacatcctgcccagtgatcataattccgacctccccctgccgaagtgtcagctggtatggcgcctaccaggcaccctctggacccggataagtccaacagggccctgggatttccccgtcgcacctagcaaggtgattcggccgcccatcacccgagcttttattgagaagtactgcacgcagagacaggtccagggtgatgctccgcaggccgcagacgcgccgccacctcatcaggctggtccagccagatcgtttgatacggagcagtatttacggcatttggttcgccagcaggcggccaaccaccgagcacatgtacagacccatgattgtctttatcagatgagtctcagcctgcagagccagggccctacttcttttccgtgccctactccggaccagttcagggcagaggtcgcatggcctggagattggcctgaggcccaggcaggagaggcaccagcagaggctcccgacgaggcagatgaggcccgcgaggacgaggagatgaccgatttacttgatttcttaggaggaagc

SEQ ID NO: 14554 - DNA, 441 bp, Glycine max
  Peptide Sequence Number=SeqID_106239
atgaccatgattacgccaagctcgaaattaaccctcactaaagggaacaaaagctgcttacataaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14555 - DNA, 213 bp, Glycine max
  Peptide Sequence Number=SeqID_106240
gagaagtggaagatgaggaaggatccatgagtggaggactggttgaagaagaacgaggatcacgagaagaggcttcaggtactagagatccaatctgtcttatcctggttggatcggtaaccgaaggtggagagataacttcaggacaaggagaagagataggaagaacctcctggagagacgaagagtggtccacggaggatgagaagaagg

SEQ ID NO: 14556 - DNA, 108 bp, Glycine max
  Peptide Sequence Number=SeqID_106241
atggttgtcatatatatgctattttctttaactagtgcaatgaagacaataaccagttcttttgaaggcatgtctaatcaaggtgcacctcggtgggttgaacccaag

SEQ ID NO: 14557 - DNA, 237 bp, Glycine max
  Peptide Sequence Number=SeqID_106242
atggctacatgtcctcaccttcaaaggactgcacgtccttgccttcagaggactgcacgtcctcgtcttcagtggactacacgtcctcgccttcagagggctgcacggatcgcgcccacaagacacccagtggacccggaggagcccaatagggccctggggtttccagctctggttacgggcctctgtcaatcctacagggtgtccgtcccccccagcaaggtcatgccatcgtga

SEQ ID NO: 14558 - DNA, 321 bp, Glycine max
  Peptide Sequence Number=SeqID_106243
atgatggtagacaccttgccagtgttttactatgagaagttggtaggctacatgccttccagtttcacggacttggtgttcgccgggcaaagaatcgaagtagggttgaaaagagggaagttcgattatgtctcttccacaagtgccaatgctagaagaatcggagcaactggggcaaaaaggaaggaaggagatacccatgccatcacttcggcgcccgcatgggtcaagcctccacagacctctcatggtacccatcaatacgcgcaacatcatctgagcttttcagctcacgctgggaactcctccaattcagcaccc

SEQ ID NO: 14559 - DNA, 435 bp, Glycine max
  Peptide Sequence Number=SeqID_106244
atgaaaagagaaaaacatgtctcatatagtagtcataactcttgcaagagcctaagtgaagaacttcgtgactattacgaaggaaggcataggtcacatcttagacctcaatcccataggagagaaaaggaaagaaagcctcaagaggctaacattaacctcctatacttccatgggaaggacaatgtagaggctaacttagattgggaaataagggtagaacaacaacttaaaaagaagtctactttaaaatcttatggctctcactcttatccaaagaaagaccaaggtcaaggcatattaggggtgaaaccttctaagcccaaagatgataaggggaagacaatagaaaacaagcccctaaggctaaggacacgttacttcttaatgccctaccacgaaaaccatgattatgaggggccaagaaatttatag

SEQ ID NO: 14560 - DNA, 189 bp, Glycine max
  Peptide Sequence Number=SeqID_106245
atggagaagtctgaaaagaaaaatatcaatgaaaagaaattgaagaaaacatacattacatgggatgaaaacgatatggaatcttctgaagattcagaaaatgaagaaataaacctctgctttatggctaaaagttatgaaagtgatgaagaggaaaacaaagacatatctctaataaggctggactag

SEQ ID NO: 14561 - DNA, 402 bp, Glycine max
  Peptide Sequence Number=SeqID_106246
atgactcaggactcccttgcccgcgatggcattgtcgcgggcaacgataaccttttgctgaatgccgcagccccgattctgaatgccgtcgtgcgtatacggcaggcggcgacgcacgacgatcccgccggcctgcgtcagctgctgattgaagagatccgccagttcgagcaacgctgcaagcaggcgggtttaccgtttgagatgatcatcggtgcacgctactgcctgtgtagcgtgctggacgaagcggcggcgcaaaccccctggggcacgcgcggcgtctggtccggcaatggcatgctggtgacctttcataacgaaagctggggcggcgaaaaagtgttccagctactgtcgcgcgtgtcgcaaagcccgcagcagcatttagggatcctctag

SEQ ID NO: 14562 - DNA, 651 bp, Glycine max
  Peptide Sequence Number=SeqID_106247
atggtattgccgctgccggcgttcatccttgacctgctgtttaccttcaacattgcgctgtccatcatggtgctgctggtggcgatgttcacccagcgcacgctggaattcgctgccttcccgaccattttgctgttctcaacgctgctgcgtctggcgctgaacgtcgcctcaacgcgtatcatcctgctggaagggcatacgggtgctgatgccgccgggcgcgtggttgaagcctttggtcacttcctcgtgggcggtaatttcgccattggtatcgtggtattcatcatcctcgtgatcatcaacttcatggtcatcaccaaaggtgccggacgtatcgccgaagtgggcgcgcgtttcgtgctggatggtatgcccggcaagcagatggcgatcgatgccgatttgaacgccggcctgattggtgaagacgaagccaaacgccggcgcaccgaggtgacccaggaagcagatttctacggctcaatggatggtgccagtaagtttgtgcgcggcgacgccatcgccggcatcctgatcatggtgatcaacgtgatcggcggcctgctggtgggcgtggtgcagcacggtatggatctcggccacgccggggaaacctatacgctgctgaccatcggtgacggcctg

SEQ ID NO: 14563 - DNA, 828 bp, Glycine max
  Peptide Sequence Number=SeqID_106248
gggctacacgccctcgccttcagaggactacacgtccttgccatcagaggggtgcacgccctcaccttcataggactacatgtcctttccttcagagggctacacgtccttagcttcagagggttggacgccctaaccttcaaaagactacacgtcctcgccttcagagggttgcatgccctcaccatcagaggactacacgtccttgcctacagaggactacacgtcctcaccttccgagggctacacgccctcgccttcagaggactacacgtcctcgcctttagagggcatcacactctcaccttcagaggactacacgtcttcgccttcagaggcctgcacgtcctcgccttcaaagggctgcacgcccttcccatcagagggctgcatgccctcaccttccgagaattacacgtcctcgccttcagaggactacacctcctcgcctttagaggactgcacgttcttaccttcagaggacttcacgtcctcactatcagaggattgcatgtcctcgcctttagagggctacacgtcctcaccttcagagggttgcacgccctcgccttcagaagagggctgcacgccctcaccttgagaggactacacgtcctcgccatcagagggctgcacgccctcaccttcagaggactagacgtccccaccttcagaggactaaacttcctcgccttcaaagggctgcactcactcagctttagaggattacacgttctcgccttccgagagctgcacgccctcaccttcagaggagtacatgtcctcgccttcagaggagtacacgccctcaccttcagaggactacac

SEQ ID NO: 14564 - DNA, 449 bp, Glycine max
  Peptide Sequence Number=SeqID_106249
acaaacgcggccataacagcggaatgacaccggtaaaccgaaaggcaggaacaggagagcgcacgagggagccgccagggggaaacgcctgtatgatcgaattccgccccgttggggataagccactagttctagagcgtcgccgcatcacgaccgagcgaacacgttcgactgggacaccctggcatcagttacccaacatagtaatcgccagtatgcagcacatccccctttcgccagctggcgtaatagcgaaacgcctcgcaccgatcgcccttcccatacagttgcgcagcctgacatggttcgaatggaaagcgcgccctgtagcggcgcaattaagcgcggcgggtggtgagttacgcgtcagctgtgcaccccaggctttacacttgccgctgatgtccggctggtgcttttgccgttacgcaccaccccgtcagtactga

SEQ ID NO: 14565 - DNA, 240 bp, Glycine max
  Peptide Sequence Number=SeqID_106250
atgctgagcagtaagggagatctggtgggaaatgaggtaccccacattcatatcgatcttcataataatgccatagatgagtctggccctgtcaagtgtgacatcggaagtgtgggaggtgggaatcaggggttgcccatcaacattaagctggaatcccctccttgggatacagagcttagtagccaactcctaaggatcaggcctctggagtgcaaatctggaataagcacagagtga

SEQ ID NO: 14566 - DNA, 869 bp, Glycine max
  Peptide Sequence Number=SeqID_106251
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgcacaacattagcaactcagccaactaaccgagtacgcatcgactctgccataggggattcaaatgaccagaaggcacaatgttcgagtgatctcttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14567 - DNA, 348 bp, Glycine max
  Peptide Sequence Number=SeqID_106252
atggataccttagagccctacactggggcaatgaaaggcaccatgcataaacctcaaacgaacctaggggtcatgacaaaaaacaatgattggtacctcaaagccttaccctggggcaatgaaaggcaccatgcaaaaacctcaagcgaacctaaggggcagattcaagaagttctcaccttgtcgatgtttttaaacaaaaaaaagggggacaaaccctggaatttcaatggattgattaaacatcaaacggctccattgccgtcactccaaaatggtcaagtgactaaatcaaacagaacaaacactctgagggagttcccggagagatttgcaaagataggataa

SEQ ID NO: 14568 - DNA, 426 bp, Glycine max
  Peptide Sequence Number=SeqID_106253
atgactaggggaaatccatgcgatttacaaccctttgatcctgaaatagatagaacctttcatagattagttaggcatagtgtgcatcccgatcaacctggtcattttgagcattttgagcattctgagtattctgttgttggtgattctgaatattctgattttgagcatttgactactaattttcatactgagaacatggctcaatctccaccttatgagaggactcttagggagatggctacaccttatttcacttatgaaagcttgtgcattcaatatcctgatgaaggtgttccatatgttctcaagactggactaatacatttgctgcccaagtttcatggtcttgcaggtgaagatcctcataagcatcttaaggagttccatattgtttgttccaccatgaagccccctgatgcctag

SEQ ID NO: 14569 - DNA, 1082 bp, Glycine max
  Peptide Sequence Number=SeqID_106254
ggagaaacatcatacctgagaggaaggtggagctctaccacaccgagttggatgattttaagactgagttggagaggcgtaatttccataaacgcttcaccaatttggtcgatgggagcacaaacttggctttggtgaaagagttctatgcaaacctatacaactctgacgacccttcaccaaagcaagccagagtcagagaccatctagtgaagattgatgctgacagcctcaacacatttttagagacacctgtggtgttggtagaggagtacagagagattgaggctgccttatgcataccaggccgagggttcatcttgaacgctgagggctatcctgggaggattctcaggaaagatttgactactttagcccagtctcatggacatgaacgtagaagctcttatttctggctagataacttgtatttcccagttaacacttctagtcttgggtttcctgctctcatcaccgccctatgtagagccagaggggttgtctctgatagcctaacttttgagcgcttgagcccggtcattaacttggcctacatcaggaagaactgggctaaaagggcgagggcgaggccaactgagcttccttccacatctgcagctcctactgcagcatccactttagtaagtgtcagaggaaatcacgggaaatttgggttaggctataaacctacacaggctgacgtaaggaaaaacatctcggaaaggaggaacaaaggccaaggcccgcggtcaggacaacaagccaaagaggttccaccgtgccacatcagtagaagcttcatgagtgcgggtttaagacgtgaaggacaagtcaccacgatatgcgatgaggactccccgaggaggtcaaatttggtacagccaagccctcctatcttccaactagggaattggtgggtagcagaatgcctggagcaagaagcgagtcagacggaggatgaagaagatgaagatgtaggacttcccccagagctagagaggataattgctcaggaggatcgagagatgaggccgcatcaagaagagacaaagctcatagacttaggtgtcgatagtgaatag

SEQ ID NO: 14570 - DNA, 797 bp, Glycine max
  Peptide Sequence Number=SeqID_106255
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatagtaaaaaggagcataagattcctaatagatatctcatgattctcttaactgcactcaaatgtgattgtttgggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14571 - DNA, 411 bp, Glycine max
  Peptide Sequence Number=SeqID_106256
acttatcaaggtaatccttgtggcgtctaccctgacttatcttccttcactggaagtggcgtctacccagacttatcttccttcaccggaagtggcatctacccagacttatcttccttcactggaagtggcgtctaccgtgacttatcttccttcattggaagtggcgtctacccagacttatcttccttaactggaagtggcgtctaccccgacttatcttccttcaccggaagtggcgtctaccctgacttatcttccttcacaggaagtggcatcatccaaaccttcgtagcctgtgtcaaacgatccgccccgaaagattcacatcaaaaagtgtcggctctaattttattggctgagaaaacattgccaaaccttggcgaaaaaatatgcctgatgcgagattga

SEQ ID NO: 14572 - DNA, 456 bp, Glycine max
  Peptide Sequence Number=SeqID_106257
atgaagctattagactcagcctattctcattctcattggcaggagaggccaagatggtttcactcatttaagggtaatagtctgaaaacctggggagaagttgttgaaaagtttctaaagaaatacttcatagagtccaagactatggaagggaaagctacaatctgttcatttcatcaattccctgatgaatctttgagtgaagcattggaaaggttacaggttgtaccatttgtggtgaggctcatgaaacaggccagtgtattcccattgaagaaaacactcaagaaattcattatatgggaaatcaaaagtgacaagggacaatggaggtcacaccctagtaatcagttcaacaaagaccagggtggaccttcgaataggccaatccaacaagggcctaacatctttcaaaggactactaagctggaggagactttgaatcagtttttgcag

SEQ ID NO: 14573 - DNA, 330 bp, Glycine max
  Peptide Sequence Number=SeqID_106258
atgtccgtttgcaactttgggctctatggccctgatcacatctattccccacatgggaaagggccacggtgcggacaatacattcaaaggcaggggcggagcgttgacattgtctacaaacgtctagcatttgtgacacttccttacatggaggcaacaatcgctctccatggtgagccaataatagcccgccctcaagatcttcctagccatggcgtgcccgttagcgtgcgtaccgaaaaagccctcatggacctcccccagcatgcgctcagcttccttagcgttcacgcatcagagcaaaaccatgtcatggtttctcttgtatag

SEQ ID NO: 14574 - DNA, 195 bp, Glycine max
  Peptide Sequence Number=SeqID_106259
atgtcttcaaattttttgaactcttgtcacgactgcttgaaaagtctatcacataaatatataaaattgatggtgatgcaatcctatcccgcaagggcattgggtagaagactccaagtagattgggctagagatccaagggaaggccctaaggttctcatgagccttagggtagatttcgagcccatgggctaa

SEQ ID NO: 14575 - DNA, 716 bp, Glycine max
  Peptide Sequence Number=SeqID_106260
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcatgtgatccacctgccttggcctcccaaagtgctgagattacaggcgtgagccaccgtgcccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 14576 - DNA, 433 bp, Glycine max
  Peptide Sequence Number=SeqID_106261
gaaatttagcattgacaaatgtactgtttccttggaacttgatagagtagggctagataattgtagtgctagacaaagtgtgcaaggttccctgagttcgatactcggatcattcccttttcattatttacttgacgatccggtgcacttgccggtagatttcgcacccacacaaacaagaagtattcctaggggtggaaacaagaaaaggaacgcagaaagaaatataaagtttttgcaggacattaaggcagcagcaattcaggaagaacctctatcttctgaggcatcttctagttttccaaaacaaagggaatctcacacagtattaattgaagccaatatcatggctgatgagccaagacgagtgaccctggaagattactcaagtacttttgtgccgcaattcttcacaagcattgtgtggctagag

SEQ ID NO: 14577 - DNA, 453 bp, Glycine max
  Peptide Sequence Number=SeqID_106262
atgaccatgattacgccaagctcgaaattaaccctcactaaagggaacaaaagctggtaccgggccccccctcgagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14578 - DNA, 370 bp, Glycine max
  Peptide Sequence Number=SeqID_106263
atgaaaagagaaaagcaagcctcctatagtaatcataactcttgcaagagcctaagtgaagaacttcatgactattacgaagaaagacataggtcacatcttagacctcactcccataggagagaaaaggaaagaaagcctcatgaggctaatattaacctctcatacttccatgggaaggacaatgtagaggctaacttatattgggaaataaggatagagcaacaacttaaaaggaactctatttcaaaatcttatggctctaactcttatccaaagaaagaccaaggtcaaggcatcttaggggtgactccttctaagcccaaagattataaggggaagacaatagaaaagcaaccccttaaggcta

SEQ ID NO: 14579 - DNA, 483 bp, Glycine max
  Peptide Sequence Number=SeqID_106264
atggtgaaagttggaacctcttacgtgccgatcaacgtctcattttcgccaaaagttggcccagggcttcccgtgcgttgggttgaagctgctcgtaaacgcgatcaagcttatcgataccgtcgacctcgagggggggcccggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcgctccctcgtgcgctctctgtcctgcctttcggtttaccggtgtcatccgctgtatggccgcgtttgtctcattccaccgcctga

SEQ ID NO: 14580 - DNA, 522 bp, Glycine max
  Peptide Sequence Number=SeqID_106265
atggcttccatgatggaggccatgttaggaatgagacaacttatggagaaaaatgtggccactgctgccgctgttagttcgactaccgaagtagacccaactctcctagctaccgcacaccatcctccttcaaacacggtaggacgagaaaggagcacactggggcacaacagcaacccccatttgggatacaaccgggtggcttacccttatggattaccgcctaattacatgccgccagtcatgcatgatgatgcaggtcatgtctcttcccccatccttgaaggggagcctcctcaacagcccgacgaggtccatgaagatcatcaagagtatgcccaaggggatgtcgatttctaccccccgatccccattgaggggccggcgcccaacacattgcctcagcccaacctcacagtacatccaatattcttgtccacagaaggaccacccccggcggctgaagaaagaaggaaactcgatctcttcgaggagagattgagagttgttgaagacacaata

SEQ ID NO: 14581 - DNA, 396 bp, Glycine max
  Peptide Sequence Number=SeqID_106266
atgggatcgaaatctaccctaaggctcataagaaccctagggccttcccttggatctctagcccaatctacttggagtcttctacccaatgcccttgtggggctagacaactacgttaaaggaataattaacagtgctttgaaaggacttgatgatactccacaacctaaatccaaggttggtgctaggtggattgttgttaagtgtaatagacaaaaaggaagcactgagtgtggctattacgtcatttactggatgtccactataatcttaggaagtttcaggaataattgggaaacatattttaatgatgttagaccattggaagcagagagattgaaggcacttcgaatccagtgggcacaacattatctcaaagttagaaatcaaacttag

SEQ ID NO: 14582 - DNA, 228 bp, Glycine max
  Peptide Sequence Number=SeqID_106267
atgaaacaaaaaggaaaaagaaagaaagaccgcgaaggtcgacatgttatagttaagaagtataaatcattcgtaaagagcaaacccatgactaattttgcacgttgttttcaaatcgtcattgtcacgcgtgccttatggagtgatatgggagttcggcccgagaccgacaccttgacacccaaatttgttttgccccagaatatcaagattgggttcccacgataa

SEQ ID NO: 14583 - DNA, 595 bp, Glycine max
  Peptide Sequence Number=SeqID_106268
cagagcgaattcaaggttatcgaacagctcaacaaaactccggccagggtctcgctgttggagttactcatgagctccgagcctcatcgggctctgctagtaaaagttctgaacgaggcccatgtggcccaagtacatctcggtagaaggtttcgggagggctggctttacacgtatcagtcaagtgtatggacccatatcgtagccaaggtgctcatcgataatggttccagtttaaacgtgatgcctaagagcactttggagaaatttaccattcaatgcttcccacttaaagccgagttcaatggtggttcgtcccttcgacggcactcgccgagagtgggagttgtgccctctacactccaccaaaagttgaaattcgtagtggaggggcacttggtcatcgtgtcaggcgaggaagacatcttggtgagctgcccatcctctatgccttatgtggaagccgcagaagaatcgttagaaaccgctttccagtcttttgaggtggtcagcatttcctccgtggactccttctctgggcagccttgtctgtccgatgcagcagtaatgatggcccgagttatgttggggaatg

SEQ ID NO: 14584 - DNA, 477 bp, Glycine max
  Peptide Sequence Number=SeqID_106269
atgaccatgattacgccaagctcgaaattaaccctcactaaagggaacaaaagctggaaacggccattcatagagaaaccctgctacttggaagcctgtcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14585 - DNA, 150 bp, Glycine max
  Peptide Sequence Number=SeqID_106270
gtttccgtcccttttgacgaacgtgttgatgcaatcctccctaagaagggaccagtcactagagccatgagcaagaggctccaagaggattgggctagagctgctgaagaaggccctagggttctcatgaacctcagggtagatttctga

SEQ ID NO: 14586 - DNA, 882 bp, Glycine max
  Peptide Sequence Number=SeqID_106271
atggcttccatgatggatgccatgctaggaatgaggcaacttatggagaataacgtggccaccgctgccgctgttagttcagctgccgaagcaaacctaactctcccagctaccgtgcaccatcctctcccaaatgtggttggacgagaaagaagcacattggggcacctcagcaacccccatctgggatacaaccgagtggcttacccttataaattgccacctaattacacgccaccagtcatgcgtgatgacgcggatcatgtcccatcccccatccttgaaggggagcctcctcgacagtctgatgaggttcacgaggatcgtagagagtatgcccaaggagacatcgatttctaccccggggtccctgtcgaggggctggtgcccaacacgctacctcaacccaatctcacgggagaacctcgaagcctcccagcacagccagtactcttgcccgcagaaggaccacccccggcagcggaagaaaataggaaactcgatctcatcaaagagagattgagaaccgttaaaggctttggcgactatccgttcgcggatctttgcttagtaccggacgtcgtcatccccccaaaattcaagacctctcatggtacccatcagtacgcacaacatcacccaagcttctcagctcacgccggggactcatccaactcgacacccgtacaagctagggcgtctgcgcccatccagagggagaccccccaagccacggctccaaccccgactcgctcggctggcaatgcccactttggcgccggttccaatgcgataaggaactttcctccaaggccaatccaagacttcaccccgatccccatgacgtatgaagacctcttaccatccctcgtcgccaactag

SEQ ID NO: 14587 - DNA, 546 bp, Glycine max
  Peptide Sequence Number=SeqID_106272
gatcatggcttctccacctacctgccctcctcctcctcctcttgttccttccgacgcatcagcttcgccgtctgccgtgaagcgacacgcaaagccttatgcctacgatcattgtctactagaccacctggtgctgagagaccaatggtgcatgttgatcctgctaccggcaaggctgacggtccccacaagaagaaattaagaacatttttggggattgtggcggaatttgaaatcccagaggcttctgacagtaggacgaaaaggaagttacttcagaccgcccttgcagccgatcaagacggtgtggaggacactgtctgtgagaaatacgacatcaacaaggaaaaatggctccagttttgccagactcgcaaagacccttcttgggaggatgtgtgcaaaaaggcacaggccatccagaaacaaaacactaccccccacgttttgtctcgtgaaggttatgaatatttggagcaaaggctcctgattgagaagacgaagaagaagctggaggaagctgcacagtcaagaagcgttgatggc

SEQ ID NO: 14588 - DNA, 515 bp, Glycine max
  Peptide Sequence Number=SeqID_106273
acaaacgcggccataacagcggaatgacaccggtaaaccgaaaggcaggaacaggagagcgcacgagggagccgccagggggaaacgcctggggggcggagcctatggaaaaacggctttgccgcggccctctcacttcccgtgttaagtatcttcggaagtcatcatcaggaaatctgactcatcaattccgccccgagctcagcaattcgccctatagtgagtcgtattacaattcagctggccgtcagcttttttgccacgaagcattcgactggaacaccctggcatcagttacgccaacattaatgccacctgacaggtcgaatgggaaagcgcgccctgtagcggcaacgcaattaagcgcggcgggtggtggaggaacagctgatgaaaccagatacgccatagctcaaattaaccctcactacaagggaacaaaagcttccgggcctcccccgaggtcgacggtatcgaataagcttgatgtgataggaaaagggcttcagataccg

SEQ ID NO: 14589 - DNA, 774 bp, Glycine max
  Peptide Sequence Number=SeqID_106274
atgaagaccgattaccaggacgtggtcaaaggcattcaggaaggctacaagcgtttcgccaccggcacttacgcgctgtggtacccggtggtgatgcgccagcagatcaaacgcatgctgcgcgatctggaagccaccggcattcgccgtattctgcagatcgaactggcggtgaaacccgacagcgatcagcgcggcatgaccgcctccggcatgatcgtcatcaacccgccgtggaaactggaacagcagatgaaaaacgtgctgccgtggctgcacaaggtgctggtgccgtcgggcatcggccaccatctggtgaactgggtgggcgcggttcgccgcgccctgcgtccacctatcgcagccatcgacgcaatctttgcgacaaaccccggtcaggcgttaaactcttaccctcttcaaattcacaactcatggaaatcccagatgacgaaacattacgattatctagcaattggcggcggcagcggcggtatcgcatcgatcaaccgggcagccatgtacggccaaaagtgtgcgctgattgaagccaaagagctgggcggcacctgtgtaaacgtgggttgtgtaccgaaaaaagtcatgtggcacgcggcgcagatcgccgaggccatccatcagtacggcccggactacggcttcgacaccaccgtcaacgccttcgactggaagaagctggtcgccaaccgtaccgcctatatcgaccgcatccacaactcctacgacaacgtgctgggcaagaacaaggtcgac

SEQ ID NO: 14590 - DNA, 558 bp, Glycine max
  Peptide Sequence Number=SeqID_106275
atgaagcacttcactgacaccctcatcagtgccaacataggaacaaaagctggtaccgggccccccctcgaggtcgacggtatcgataagcttgatctccgcctcctgggttcgagcaattctcctgccttggcctctcgaatagctgggactacaggtacgtgccaccacgcccggctaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14591 - DNA, 237 bp, Glycine max
  Peptide Sequence Number=SeqID_106276
atgccatgtacaactgtgtcttttctatgcaagattcctttgaggagcaggcaacacagggatccttcgtccaccatggatgttaggatgttctcaccgctgctattggacgtccagagcaccctggatgtgtccgtgctgctgcagccagtgtcaccatcaagcaatacttcgaatcagctccacggacgtcctgcagctcttcctcactggctcttgaagaattgcagcagctga

SEQ ID NO: 14592 - DNA, 301 bp, Glycine max
  Peptide Sequence Number=SeqID_106277
atgcccttgcggggtaggattgtatcattaggtcacattattggtagaggtgtgggcagaggagattgtgatgattccgatgatgctccgaagcgtcgacggcctaccgcatccgcacggaggcagcgagtacctatgattgtggcgcaagatgagccaatggtccctgcgccagatgtagaggctgacgtatttcccgttgacccgatggcactagctgatgtagaagacactagggcagacattcctgcagacacaggcacgcaggttgctgaggatgagcatgagggatttccgggtg

SEQ ID NO: 14593 - DNA, 423 bp, Glycine max
  Peptide Sequence Number=SeqID_106278
atgaggcttcccgagcaaaggacaatctttctgatcaagcttgatcgataccgtcactcgaggttttgggcaaaggcctcgggctccagtggcgtatcatgtgtctatcagctgtttcctgttcagctactgacggggattggttatccgctcacaattcgcacacaagcataccgagccggaagcatcagcgcggcaagtgtaaagcctggggtgcctaatgacgctgacgctaactcaccacacccgcccttaattgcttgccgctacagggctgcccgctttccatgtcagggaacctgtcgtgccaactgcattaatggaatcggccacgcgatcggtggaggccggtcttcgcgtattacgccagctggcgtaaaggcggatgtgctgcatactggcgattatatgttgggtaactga

SEQ ID NO: 14594 - DNA, 354 bp, Glycine max
  Peptide Sequence Number=SeqID_106279
atggtgaaagttggaacctcttacgtgccgatcaacgtctcattgtcaattcgccaaaagttggcccagggcttcccgctgtcttcctgttcagctactgaaattcggggtggtatccgcgtcacaattcggcacacaagcactacagccggaagcatcagcgctggcaagtgtagcctggggtgccaagacgctgcagctaactcaccacacccgccgcgcttaattgcttgccgctacagggcgcgtccgcatttcgccatgtcagggaaacctgcggcaactgcattgaatgaatcggccaacgcgatcggtgcgaggcggctcttgcgctattacgccagctggcgctaa

SEQ ID NO: 14595 - DNA, 132 bp, Glycine max
  Peptide Sequence Number=SeqID_106280
atgcctcaaaatgttctttacgatgccattgggatatatcaacggtgctgtccttcctgttcagctactgacggggtggtgtccgtcaacggcacaaagcataccagccggaacatcagcgggcaagtgtaa

SEQ ID NO: 14596 - DNA, 249 bp, Glycine max
  Peptide Sequence Number=SeqID_106281
atggcgtcgagcagttcttgcaatttgcttcagaaagagtctttccagcaagcacacacccctgtgtatgaaggattgcagagtgattctaagaagcctttgtatgcagggtgcaataattccttaaccctgttgtctgttgtgttaagtctgtattttaacgatcctaaaccattggagctagagagattaaaggcgttgcaaatccagggggcacagtattatctccgagttagagctcagagctag

SEQ ID NO: 14597 - DNA, 752 bp, Glycine max
  Peptide Sequence Number=SeqID_106282
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagcaggcggtctcctcgccctggggcgggccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14598 - DNA, 108 bp, Glycine max
  Peptide Sequence Number=SeqID_106283
atgtcttgcctagcgaccacaactctgacctccctctgcgtatggcgcctaccaggcaccctctggacccgtagaagtccaacagggccctggggtttccggctctga

SEQ ID NO: 14599 - DNA, 316 bp, Glycine max
  Peptide Sequence Number=SeqID_106284
atgtcttatagaaaccttcataccagttccttgacaaccagcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 14600 - DNA, 201 bp, Glycine max
  Peptide Sequence Number=SeqID_106285
atgacaccggggggcggagcctatggaaaaacggctttgccgcggccctctcacttccctgttaagtatcttcctagatcttccaggaatctccgcaacccgaattctacaccattccgtccgcagatcgaattccgagcccgagcgaggatccaagttctgagcgagccgccaaccgcggggctccaattcgccctatag

SEQ ID NO: 14601 - DNA, 776 bp, Glycine max
  Peptide Sequence Number=SeqID_106286
ctgaacggtctggttataggtacattgagcaactgactgaaatgcctcaaaatgttctttacgatgccattgggatatatcaacggtggagtccgatcacaggtacttattgcgcaataccgtgcgctcggggtgatgctccgaagcttactgatttagtgtatgatggtgtttttcgaggtgctccagtggcgtatcatggtttctatcagctgttccctcctgttcagctactgaaagtcggaacgctgtcgccattcgctgcattcaatgatcgctgcgcaactttgcgcgaagggcgatcggtgcgggcctttgcgtattacgccagctggcgcaaagggcggatgtgtgcatactggcgattactatgttgggtaactgtgccagggtgttccagtcagaatgcgttcgtggagaaaaaaagctgcacggtgcgtcagcatgaatatgtaatgactcactatagggcgaatatggagctcccgcggttggcggctcgctctagaactggactcgctacgctcgggctgcaggaattcgatgaccggggagcggaaatcccggcctgtacggccccgaacgcgggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttcccgggtaggcagttcgctccaagctggact

SEQ ID NO: 14602 - DNA, 480 bp, Glycine max
  Peptide Sequence Number=SeqID_106287
atgggtgtcaagttcctcgaagcggtcaagcgaaggttgcatgccatcaaacaatggtccccaggagaaattagggtggactccgggggagacggtggtgcatcggctacctgtggctggccgtctctaggctgctgtggtgcctcgccctacgcctacatggtggtgcaatacttctcggatgttgctgagcaacaacgtcatccatatctgggtcagggtggtcatgctagtgcacatgatcctcacccgtctccctgcagcaatttgggcgaaatcttgccctggaatgcacaaaagctgagcaatggcctcctcatcaaaaccagagacctgactcctcctctagctgaattcatactgctgaccctcttccaaaatcagcgggtggcccaagaactggctaagggcgtctgcatccaaggggatccactagccccttgttcgttcgccggcaagtacaccggatcgcgcaactag

SEQ ID NO: 14603 - DNA, 217 bp, Glycine max
  Peptide Sequence Number=SeqID_106288
atgtcaggcgaaatattgaccgccattcgccgtcattgtggaaccggtgataaagccagcctcgtccgagacgagaaacaggacgcaacgcgcgatctcctccggttccccaagccgtccgatggggatttgtggcacgatccgctcggccagaaccttctccgggatcgctctcaccatttccgtgccgatatagccggggcagatggcgttgacg

SEQ ID NO: 14604 - DNA, 393 bp, Glycine max
  Peptide Sequence Number=SeqID_106289
atgcataaggcattgcgattaaatgctcctttaccatatccacatttagtcactcttttccttcaacattttaacatccctcttgattctgaaccttatgttccaatcaagagatctttcttggtcggtgctgttgtggttgcgtcctttggttaccgtaaagagcgtgatggctcttgggtaaaaaagggtactcaaccaaatgatgatgaaggacaattaacggttgaaggagactcttctctccttcaaagtattttggacaggtttgatgctttggaacaacaagtggacatgcaatttgatgcaatggactcaaggatcacaaaggttgaagaagatgtcaccatcattcgcgactgtcttaatttacctccaccaccatcagtttag

SEQ ID NO: 14605 - DNA, 405 bp, Glycine max
  Peptide Sequence Number=SeqID_106290
atggagagaagtatgatagatgctgccagtggtggagcccttggagacatgacccctgctgaagccatgaatttaattgagaagatggcttccaactcccaacagtttagcgccatgctatatttgcttgtggggcttctatggaggctggatcttagagcttcaatgaggtcctttaatggtgattttccaccatggagatgcaacggaagacaaagaagaagaggtgagaagaggcgccatccacaagggaataagccatggaagaaggagcttcaccaccaagatgagccttggataagaagcttggagatgatgcttcaatggaggaaaagaaagagggagagaaagagagaggggagcatgaaattgaaggaagaaaaagggagagaagttgaactttga

SEQ ID NO: 14606 - DNA, 374 bp, Glycine max
  Peptide Sequence Number=SeqID_106291
tgagagcaacagcttctccagatgatgaatcagaaagatcggcaattcctccaattggggaagtaggagggtcagctgtttcttcagctggtgaatcaggaggggcagcagcttcatctgatgatgcatcggagatgataatcagaggtggagatgggggaacttcttcaaacacaggagaaggaggtggattcactactggagatcatggctcagctggaattggttcaacccgtgctgttgagcttcaggccatgctacctgctcaagaaaatgctccaaagggtctaatgtttgtgagtgttggagatctagtcctatggcaactgactgaggagctgggatggatgatgaagggatgtcatcggttctag

SEQ ID NO: 14607 - DNA, 279 bp, Glycine max
  Peptide Sequence Number=SeqID_106292
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtattccgctgttatggccgcgtttgtctcattccacgcctga

SEQ ID NO: 14608 - DNA, 236 bp, Glycine max
  Peptide Sequence Number=SeqID_106293
ctgctgtggatgctcttgactttctagagggtgatgaggacccaccccttgaggtggattctcccgaggacgtcatgtcggcatttgaggcagactctacggaggagagcggccctggagagatggcgactaaatttgatgattgtatacatgtggctgaggctactacagtggatactttggctcaggatgacactatgtattttgcaaaactcccatattttggacagctttaa

SEQ ID NO: 14609 - DNA, 1029 bp, Glycine max
  Peptide Sequence Number=SeqID_106294
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctctgtccaaacatcacatgccagcagatgtggtcaccatcatagtggatgagatcggtcgagtggtctccgttggagatgggattgcacgtgtttatggattgaacgagattcaagctggggaaatggttgaatttgccagcggtgtgaaaggaatagcgttgaatcttgagaatgagaatgtcggaattgttgtctttggtagtgataccgctataaaagaaggagatcttgtcaaacgaactggatctattgtggatgttcctgcgggaaaggctatgctagggcgtgtggtcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacaattagttcaaattctttcagaagcgaatgctttagaatattccattcttgtagcagccaccgcttcggatcctgcacctctgcaatttctggccccatattctgggccgtggcatatcgacaaatgtcattattgttacgccgaacaccaggccgtgaggctttcccaggcgatgttctctatttacattcccgtctcttag

SEQ ID NO: 14610 - DNA, 377 bp, Glycine max
  Peptide Sequence Number=SeqID_106295
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaagtctcacacgtgaaccacgttagtctgaacgtgggtggtctagtgcccccacattgttccttaaaatcggttgtctcggatgacgcttgccctggcgcttgctttgttcaacgcgatgctactactcttagttag

SEQ ID NO: 14611 - DNA, 324 bp, Glycine max
  Peptide Sequence Number=SeqID_106296
atggcggccaatgattatgtcattctacgtgaccaagagcccagcccacaagaagaaagcactaggctagaagaattgctggtacaattcatgcaggaaacaaggtcacatcagaagagcactgatgcagcaatcagaaatctggaagtacaattagctaagctagttcctgaaaggcccaccgaaacctttgcggtaaatactaagatgaagcccaaaaaggagtgcaaggtgtttccagtatacatgagtttcatggcgtctctagctaagaggcgaaaatgcaaggaagatgtgttctacgtgaccttcatgccaccttga

SEQ ID NO: 14612 - DNA, 205 bp, Glycine max
  Peptide Sequence Number=SeqID_106297
atgggacaattggctacacagttaaatcaacaacaatcccagaattctgatagattaccttctcaatctgtccagaatcctaaaaatgtgagtgtcattgcattgaggtcgggaaagcagtgtcaaggacctcaaccagtatccgcaaatgaacctgctcaacttcactctactccagaaaaagatgatgacaaaaatttaaaaa

SEQ ID NO: 14613 - DNA, 459 bp, Glycine max
  Peptide Sequence Number=SeqID_106298
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgctggttaaggctaaactgaaaggacaagttttggtgactgcgctcctccaagcccagttacctcggttcaaagagttggtagctcagagaactttcgaaaaaccgccttgcaaggcggttttttcgttttcagagcaagagattacgcgcagaccaaaacgatctcaagaagatcatcttattaatcagataaaatatttctag

SEQ ID NO: 14614 - DNA, 603 bp, Glycine max
  Peptide Sequence Number=SeqID_106299
atggaagggttagtggacctaacatcgattgacgctttcctcgcctttcatcatgcaaggaaagcccggtcgtcgcgattttttccatgtatgacacgttcgaccggggatgtgaaaagagcagcgcaagaattgtttgttgtgcactggctctctatgtgtggctggtttcacacctttttctccaagaaggaaggaagaatcaggattctatcttcatgcgaaggatgtccaaatgttcccttgatgggaacaaggggttgtattaattataatcccgtcctctccataagacagcttgactaccccatgagaggagtgccatcagacgaaagcatcacgcctttcatcgcacggggtttcagtgaccacaacgcgagggacagagagcttaggggaagcagtaatgggatcatcggaggctatcataagtggttgagaatccggacacaaggattggattggctcccaaatctaaagactgtgagagacaatgaggttaaagcttcagaagaaagtgatgaggtacaagccctaaaggcaaagcttgaaagagcccgggtagtcaaagagaagttcaaatccatagccatcaaagtctga

SEQ ID NO: 14615 - DNA, 307 bp, Glycine max
  Peptide Sequence Number=SeqID_106300
atggaaaaatctgaaaagaaaaatcatagtgagaagaaactaaagaaagcatacatcacatgggatgaaaatgatttggaatcctctgaagattctgaaaatgaagagataaatctttgccttatggccaaaagttacgaaagtgatgaagaggtatctttgagaaagaagtggtacatagatagcggatgctcaaaacatatgactggagatgcatcaaattttacacacatatctccaaagaaaagcgggcatgtaacatatggtgacaacaacaaaggtagaattcttggagtgggtaaaatag

SEQ ID NO: 14616 - DNA, 213 bp, Glycine max
  Peptide Sequence Number=SeqID_106301
atggctttgattcgtagcaagacaaagaggatctcttcagttcataacgaagatgatatcttaactagtgtttctgatatagagcatgaagtgatgcaatcctaccccgcaagggcattggatagaagactccaagtagattgggccaaagatgcaaaagaaagccttagggttctcatgaaccttagggtagatttcgggcccatgggctaa

SEQ ID NO: 14617 - DNA, 366 bp, Glycine max
  Peptide Sequence Number=SeqID_106302
atgtggatgttggtggtgatgaagagagagatgttggtggtggtgaagagaaagatgatggtggtggagagtaaggtattaatgtggacattggtggtggtgaagagaaacatattggtggttgtcgcaacctacccttcggcgggagggcgacgcgagactcgcgggatgcgtgttccacaaaaggaatacgcgcggagtcgccaccaacgtttatttgaggaaaatgttggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 14618 - DNA, 321 bp, Glycine max
  Peptide Sequence Number=SeqID_106303
atgtacaaagatgattggacccaactttggcccatgggctcagaaatctaccctgaggttcatgataaccctagggccttcttcagcagatctagcccaatccttttagagcctcttgctcatggctctagtgactgtcctttcgctaagctcaagcctcgcgctaagcgcatcattgttcatgtgctaagtcgctattctaaagcgcttagagataaaccctggcatctgaggctgatttggtccgctaagctggccaaggttgagctaagacaatttcaactcgatctgaattcggctaagcaacggtctaaccgctaa

SEQ ID NO: 14619 - DNA, 942 bp, Glycine max
  Peptide Sequence Number=SeqID_106304
gactacacgtcctcgccttcagaagggctacacgcctcgccttcaaagggctacacaccctggccagccctcgccttcagagggctacacgccctcgccttcaaagggctacacgccctcaccttcagaggactacacgtcctccacttcagagggctacacgtcctcgccttcaaaggactatacatcctcgccttcagagggctacacgccctcgcctttggaggactacacgtcctcgccttcagagggctacacgctctcgccttcagaggactacacgtcctcacctttagagggctgcacgccctcgccatcagaggactacatgccctcgccttcagaggactacacgtcctcgccttcagagggctgcacgccctcgccttcagaggactacatgccctcgcctcagagggttacacgtcctcgccttcagagggctacacgtcctcctccttagaggactacacgtcctcccctttagagggctacacgccctcacctttagaggactacacgtcttccaattcagagggctacacgtccacttcaagacacccagtatttgctgggatcgcacccacaagacacccagtggactcggaggagcccaacaggtccctggggtttctagctttggttatgggcctctgtcagtcctacaagatgcctgttcccccagcaaggtcatgccatcgtgacatagtgtccgtcgcccccagcaaggtcatcaagcctcctactaaccgagctttcatcaagaagtactgcgcccccaggcaggcgcagggcgagacaccacagcagcttggggatggccggcagcgagcaatagacgcatcgccgccacctccagaacccctcagctcatctacaaaggctggagctttgcctacgacccgtggccgaccatcaggcgaccaagtccaaagccaaagg

SEQ ID NO: 14620 - DNA, 451 bp, Glycine max
  Peptide Sequence Number=SeqID_106305
gagggcgagggcgagggcgaggacgaggccaactgagcttccttccacatctgcagctcctactccagctttcacttcagcagctccttcagtcctagttcaaattgattctcagtgctttgaagctatgcttcagagcattcatcaaggacatatcattttacttcaaagtttacaggtggtggcccctccaggatccattccttcctttgagcagtttctagagagagtatcctggcttggggcccaaccttctcttcacagggaagatgaaggtcccacagcccagcatgcagcagacccttccactcctatactcgagataccaaaggacctgactacaccagtcctgactctgaacacttctcctccagctactccagtacttcatctgacaaatgaggagggtgatcagactcaagatactcaagaccaatcacaggaattttaa

SEQ ID NO: 14621 - DNA, 276 bp, Glycine max
  Peptide Sequence Number=SeqID_106306
atgacacattatgcccattctgtgggaattctgaggagaatgaagcacataaaccgtggcagcacttttcccagcatgcgttctgtttgcctagtagaattcgtcttaaccgatggagaagttggtggctggccctcacatggacagtgtggcagcaccggaataaaatcatcttctcaaatgaaacttttgatgaactttgagaaggactttgccttcacctacagctattggtcgtctaacatagcatcaggatttgtcttttcaggggggtag

SEQ ID NO: 14622 - DNA, 409 bp, Glycine max
  Peptide Sequence Number=SeqID_106307
atgtcattgcctaacgctgttcatgtgtcctccattatcaagcgtggagcctctggtgactgggaaatatgttcttctgttgtgttccggatcggttccttcgccaaacataagaaaaaagaaggagtagagacgagagttgtcatcacggaaagggcaggacggacgaaatcagtgacttatctttgctttccacttatctccgatgagagatacttggtaccctatgttgcacaatatgtgaagtcccgagacgtgccgaaaatcaaaaggaagcaggcttacgcgatccgtgaaaattccgtaatgggggtacaaatagcaatcaggcccgcttggccttccagattcttcctccagaaggctgttgcttctagaggaagcaacattgctcgcctaggcgagctgg

SEQ ID NO: 14623 - DNA, 1398 bp, Glycine max
  Peptide Sequence Number=SeqID_106308
atggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattcctgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggag

SEQ ID NO: 14624 - DNA, 345 bp, Glycine max
  Peptide Sequence Number=SeqID_106309
atgactcgctgcgcaacggtcgttcgggaagggcgatcggtgcggtatcagctcacttcgctaatacggttatccagctggcagaatcagggggatgaacgcaaggcgattaagaatgtgaggcaaaaggccagcaaaaggccagtcagaccgaggctccgcccccgacacattcaaggtcaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatag

SEQ ID NO: 14625 - DNA, 321 bp, Glycine max
  Peptide Sequence Number=SeqID_106310
atgtttgacactgttaagacgacctcaagccaagctcgacctgtatttactcatgccatccgtaaagcggactcggtggttactcatagtgacctgagaggagtccacatctaccagcaaggcccatctgtgcgcaccatgacgctaggtctcatcatggagttatcaatcggttctgatttagcgtgttggtcgattgctgattataaaactgcgggtccacataccgttctctatcacgtcagttattcactcctcgataacccggttgctcacgagattaccattgagttgaacgcaaaagaggagggcgctctgtga

SEQ ID NO: 14626 - DNA, 1830 bp, Glycine max
  Peptide Sequence Number=SeqID_106311
tcgtatggaccggtccggagaaggaagctttcctcagcaggtcagccggcgagttaccggccagtaaaaacctcgaaattgccgccttgcctggcgtaaaaccgctattgattagcggcggtgaagatgaggacgaacatgagcacggtcacgatcacgaccatgactcagacaattctgagaaccaggacccgtctcatactcatcaccaccacggcgagtttaatatgcacctgtggatgtcgccggagattgcgaaacaatctgctgttgcaatccacggaaaattattggaacttatgccgcaaagcaaagccaaacttgacgccaacctgcagcagtttgaggcacaattggcggacacagacaaacggattggcgcacaactcgcgccggtacggaacaagggttatttcgtttttcacgacgcttacagctactttgagaaacattacggtttatcaccattaggtcattttaccgtcaatcctgagatccagccgggcgcccagcgtttacatcaaatacgaacacagttggttgagcagaaagcagtctgcgtttttgctgaaccacaattcaggccggcggtcatcgatgccgtgtctcgcggaaccagcgtgcgtaaaggcaccctcgacccgttaggcatgggaatcagcttaaccaaagacagctaccagatagcccgctctgtcgccctcgcatttaataatttgccgcgcccccaccgcgttatgctggggtcactcaccgttgttacactggccgtcgctgtctggcggccttacgtctatcatccccgcgatgttgcgcccatcgtgaaagacatcacgctggacaaaaacgaactgcgcacgctgctgccggaagccagtgaaccgatcgatcaaaccacggcggaaccggaagacgagatcccgtcggatgacatcgacaaagacgtaccggtcaatcccgatcagcatgactacaccgtttcctcaggcgatacgctgagcagcgcgcttaatcagtacggtatcgatctcggtgacatcaatgcgctggtcagcagcgacaagagtttgcgtaatctgcgcgtgggacagcagctgagctggacgctggatgctgatggcgcgctgcaggatttcacctgggagatcgatcggcgtgaaacccgcacctatgcgcgtcagccgaatggcagctttaagatgcagcaggagatgcagaagggtgaatggcagaacagcgtcctgaaaggcgaagtgcgcggcagtttcgccgccagcgcccagcgcgccggcctgaccagcgccgaaaccagcagcgtgattaaagctatgcagtggcagatggatttccgcaaactgcgcgccggtgacgactttagcgtgctgatgtcgcgcgagatgctggacggtaaaagtgcgcagagccagctgctcggcgtgcgcctgcgcaccggcggcaaagattactacgcattccgcgcggaagacggcaagttctacgatcgcaacggctcaggcctcgcgcgtggcttcatgcgcttcccgacagtgaagcagtatcgcgtctcatctaacttcaatccgcgccgcctcaatccggtaaccggccgcatcgcgccgcataaaggcgtcgattttgcgctgccgattggtacgccggtgctggccgtcggcgatggcgaagtggtgatcgcgaaaaacggcggagccgccggtaactacgtcgcgattcgtcacggtcgccagtacatgacccgctacatgcatctgagcaaagcgctggtgaaaccgggacagaaagtgaaacgcggcgatcgcatcgcgctttccg

SEQ ID NO: 14627 - DNA, 255 bp, Glycine max
  Peptide Sequence Number=SeqID_106312
atgaccacatattcacctccactcctttatgttcccatggactcggatatagggccctttttcaactcaccgaaaccgacaaaagaggaagtcatcatattgcacgagattagaaggcctaactctctaaaaacggtccccaatggagtcgccaactatcacaacctacctttcggcgggagggcgacgcgagggctcacgggtgcgtcttccatgaaaggaaaatgcgcggagtcaccaccatcgtttatttga

SEQ ID NO: 14628 - DNA, 114 bp, Glycine max
  Peptide Sequence Number=SeqID_106313
atggggagaccagtcaaggtgatcacactattttgcgagaatgctccaaccatatgggatcgacacgggcttaaaggagcacccaaaccgggtgtatttacccccatggcctaa

SEQ ID NO: 14629 - DNA, 360 bp, Glycine max
  Peptide Sequence Number=SeqID_106314
atggctcaactggtctctgatgccatctactatttgcaaggatcatgcccgcaagacacccagtggacccgaagaagtccaacaaggccatggggttctagctctgattacgggcctctgtcggttctacggagtgaccaccacttcgatctctccctgccgaaggatcgcgcctacaagacacttagtgagcccggagaagtccaacaaggtcttggggtttccaactctgattatgagcctccgtcagttctacggagtgcccgtcacccccagcagggtcatcaggcccctattaacagggctttcatcgagaagtattgcgaccccaggcaggcgcagggcgaggcatcacagtag

SEQ ID NO: 14630 - DNA, 393 bp, Glycine max
  Peptide Sequence Number=SeqID_106315
atgaatttttatagaaaattctcgatgcctcctaaggtgtccggctcctccgggagaggaggaagaaccagtagtaacaggaaagatgttttattggctctaccagagccagtaactaagaaaacaaccgcatcatcttctgggtcacctacccagactgggtcatcaacccagaaaggaaaatttgaaggttcattgacccaaatagaatcccccaaaccaacaacaaaaaagcagaccgtggctgactatgcctggtcaatccaaactctcctggccctagaagacataggcctcaccaagttaccaaaattagccaagaaaacctggacagaaatggcctcagaatcagacgatgattctgaaatagatcttcaaaaacaaattcaataa

SEQ ID NO: 14631 - DNA, 363 bp, Glycine max
  Peptide Sequence Number=SeqID_106316
atgagggatggcaagaagacttcgtacgtcattgggatcgaggtgaattccggagtgggcctcgggggaaagttccttatcgcattggaatcggcgccaaagtgggcgttgctggccgggcgagtcggggttggagccggagcttggggggcctccctctggatgggcgcgggcgctctaggttgtacgggtgctgagttggaagagtcctcggcgcgagctgagaagctcggttactttgatcctcctagcgttggtacatgtggaggagacgtgtctaccatcatggtaatcatttcccttttgaccatgggaggggccacttgggctgccagtccctccaacgctgagcatactccttaa

SEQ ID NO: 14632 - DNA, 306 bp, Glycine max
  Peptide Sequence Number=SeqID_106317
tgagaggaagggatcagaagagaatgggaatggaaaagggtgaacgaagtgagaatgaggatggaatggcaatgggaaaagaagagatgggaaaacccgggcaggacacatggagggaggggcaaaataatgggaagaggaaaagaaataaaagcaaacacgggcataacacttggattgaagcgggaaaaatcataaaacccaaaaaaagacaaaagccaaaactttttgatgaatatgaaattttaatcatgaaccaaaaaatcaaacctggactcgtggagtttccagataaaaactgcacat

SEQ ID NO: 14633 - DNA, 517 bp, Glycine max
  Peptide Sequence Number=SeqID_106318
atggctatgggggatttcatcagcagactctccttccctgaaaacaccgagacttttccaagtctcacaagttatccagaactacgtaggtctgagttcctcattggaggatacgtaggagcaaaagccttgcttttgtcgaccacactgctttctgttaccatgacccaagagctggtagcccgcggagacaccttacagttatccgcacccttgtgtcatccagaggcggcgggcctgatgacacgcggagataccttacggttatccgcacccttttgtcatccagaggcggtgggcctgatgacacgcagagacaaaatttggtcattctgcacccttgtgtcatctagaggcggcgggcccgatgacatgcggagataccttacggttatccgcacccttttgtcatccagaggcggcgggcccgatgacacgcagagacaaaatttggtcattatgcacccttgtgtcatccagaggcggcgggcccgatggcacacggagataccttacg

SEQ ID NO: 14634 - DNA, 231 bp, Glycine max
  Peptide Sequence Number=SeqID_106319
atggagctccgaaaaaaagtggagaaatggagaattggcgaacagcgcgacgcaataacttcgcggggctccagactgtgcaggatgcctgcaggtcgtctagaggaccccaacattcatggggctccgaaaaaaagtggagaatggagaattggcgaacagcgcgacgcaataacttcgcggggctccggactcgttggtggaggatgcatgaacaacactaggcaataa

SEQ ID NO: 14635 - DNA, 584 bp, Glycine max
  Peptide Sequence Number=SeqID_106320
atggtgacacctccagactctattcctttagtagagcagtttaacgagtgggtagcctggcccgaaactcagtcttctcttcacaaggaagataaaggcccacagcctaggtcccacagcctaggtaccacagcagatggagggaagaaggcaaatcaaacacaagaagctgcagccacttctgagaaatctcttgaggccacttctgagccttcaaaaccagtggcagatacagcttcacttttacaggcaacagacccttccacccctgaggatcagactacaccagtcctgtctccgaacacttctcctacagctacccctgagcttcacttaacagacgaggaggacataataacaaaagatgatgacaaaggtgatgacaaaaagctcaaaggtcaatcaaagaatgagttcaagatagaatcaagaacacttcaagattcaagaggaaagttgatttcaagaatcaacaatcaagattcaagagatcaagatttcaagaatcaagattcaagagatcaagattcaagactcaagattcaagaattaagagaaggcttagtcaagataagtatgaaaag

SEQ ID NO: 14636 - DNA, 599 bp, Glycine max
  Peptide Sequence Number=SeqID_106321
atgaagctttacttctacaagatagtcctggagttctatgctaatgcttggcccacaaaggagggtgtgcgagacatgcattcatgggtgaggggtcagtggattccctttgacgcagatgccctcagccagttcttgggtgactcgctagttttggaggaaggccatcagtgtgagttcggcaagaggaggaacagggccgatgaattcaacgaggaggccattgcccaactgttatgcacaccggatgagcgtccacgtggcccaagtatgccacccaccaggcaccctctggactcggataagtctaacagggccctggggtttccgccgttgatcacgggcctctgccagtcattcggggttcccgtcacccccagtaaggtgatccgaccaccgatcactcgggccttcatcgagaagtactacacgcctaggcaggtgcagggtgatgcacatcatgccgcagacgcaccgccaccccctcatcaggccgatcccgctggatcactaggcatggagcgttatctacagcacttggtttgccaggaggcggccaaccaccgagggcaagtgcagatacatgagtgtctctaccg

SEQ ID NO: 14637 - DNA, 387 bp, Glycine max
  Peptide Sequence Number=SeqID_106322
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctcactcaactgcagcagcgtctcacgcgcaagcgcctcgggcgtcgggggatcctctag

SEQ ID NO: 14638 - DNA, 462 bp, Glycine max
  Peptide Sequence Number=SeqID_106323
atgttggtggcgactccgcgcattttcctttcttggaagacgcacatgcgagccccgcgtcgccctcccgctgaagggcagctatcacccatggtggaagaatttgaagagatccttggatgtcgtctagggggaaggaagccatacctcttctcaggattctatccctctttagctagaatttctaagatagtccaaatctcggcgcaggaattagaccacagaaagcaagtcaaaaatggggtggttggagtaccgagaaaatgtttagaggcaaaagcaagaatcttggcaggtagaggtgaatgggccccgttcatagacatcctcgcacttttgatcttcggaggattcctctttccaaatgtggatgggttggtggacctagcggcaatcgacgcttttctcgcctttcatgaccgcatggaaagctcggtcgtcgctatcctagccgatctataa

SEQ ID NO: 14639 - DNA, 975 bp, Glycine max
  Peptide Sequence Number=SeqID_106324
atgtaccagagtaggtgccgggctaggcagtgggttgctgcagctcggatgtacctacttcatttggcattcagagacctgggccaggtaggggcattctcttggggagtggccgctttggtccacttgtatgatcagcttaacgaggcgttgcatgcccctacacggcagatggctggttacatttcactacttcagtgctggatttacgagcactttccatcagtccataggtctgttgttgacgatggttatgctgaggctagcccacgtccctgtaggtggcttacaggtaaggcccagatgatcgggattaagggagccccttacagagcacgtattgatgccctgacagtgaccgacgtctgttggatgccgtatgctgagcatcggggagttcggggctatgacttgatctcctcgtacacggggcaagtcagatggggtccgatcatcgtctaccttcgaccagagagggtggttcggcagatggggtacattcagatcattcctccgccaccggttcgtgattcgttgacagatcatgtggcgcctacaggggagctctgtgtagttcctgggcaggtggccccagactacatggagtggttttttcagatttcgtacccctttgtgacgtcgacggaggacactactgagccaagacctgcgcctccccctcccactgatgatgacttcgtcgagccacctgtcgccgaggttctagtcgcatcagatccccctacgcattctgtggttgattgcacaacatgtgtcaggatgggaaggattgctgagcatttggagcgcgtcatcaacctcaggatggtgactgcagggactgacttatatgatatcatggatctttgcctaaggatagctagagatgatgacccagatgatagtcttaggccacgacagagaccccacatatattatgatttatcttttttatttatttgtttatgtatgtga

SEQ ID NO: 14640 - DNA, 720 bp, Glycine max
  Peptide Sequence Number=SeqID_106325
atggcgcgggaaagggggggggggggcaccgccacgaagggtggtgctcaccagcaagatgaaacaaaccaaatagcaaacccaaaaacaaacaacgaaaaagaagaagagagggaaggaggagtgaaggagaggagaagggagaaaggaagagaggaaagggaaggaatgaggggatacctaggagacccatcctccttctctagctatagtgccaaatggcgtgatgctactggtatagctgatttagatgatgaggcgtctgcagatttaaggacaaatcctcttcaagaggaaggggatgatgcaatcctcccaaggaagggacccatcaccagagctatggctaggagactccaggaagattgggccagggatgcaagagaaggccctagggttctcataagccttaggaaattcaaatctcctggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 14641 - DNA, 454 bp, Glycine max
  Peptide Sequence Number=SeqID_106326
taaaaagtctagggcaaatggagagaatgagaaggaggaaggaaaccatgttcgggctgccattcctacatggccaaatttccctcctgctcaacaatgtcattattcagccgatgtcagcccttctcattacccaccacccaatcatccacaaagaccatcactaagtcagccacaaagcctgcctaccacacaaccaatgccaaacaccacctttagcacaaaccaaaacaccaaccaaggaaggaattttacagcaaaaaagcctgtagaattcaccccaattctggtgtcatatgctgacttgctcccatatctacttgataattcaatggtagctataaccctagccaaagttcctcaacctccattttttcgatcatacgacttgaagcaacatgttcttatcatggaggagttctggggcattccattgagcattgtagggccctga

SEQ ID NO: 14642 - DNA, 337 bp, Glycine max
  Peptide Sequence Number=SeqID_106327
cccaagcagtcttgaaaaacccttgaaccggagctctaataaccaaaatgatgtaaacccatttgcacaagggttaaggttggatcttcaaagggctgaatggaagggatttggttcaaagtccgaatgtgtttggatggagaatgatgaagataatgatggtgttcaagtgggactaaaggctgggtacatctacttgggtttgactgagaacaagagagggtacatctcttgtggattagttctaatggagggtacatccactaggttcaaagagaacaagggagggtacatcccttgtggatctttgcttgtaaaaggatttttacaaggttga

SEQ ID NO: 14643 - DNA, 387 bp, Glycine max
  Peptide Sequence Number=SeqID_106328
atgaagatcgcgaattcctatcgcgaacagatgagcattcgctgtcacaatgtctatcaggagacgggcacgctttcgggcggcaaccagcagaaggtggtgctatcgaagtggctcttcaccggacccgacgtgctgatcctcgatgaaccgacgcgcggcatcgatgtcggcgcgaaatatgacatctacacaattatcaattcactggcggatagcggcaagggcgtggtcgtcatttcttcggaaatgccggagctgatcggcatctgcgaccgcatcgtcgtcatgcatgaaggagcctttgtcggcgaagtcgctggcgaggaagcaacgcaggaaaacatcatgcgcgccatcatgcagaacaagggaaaacggccatga

SEQ ID NO: 14644 - DNA, 162 bp, Glycine max
  Peptide Sequence Number=SeqID_106329
atggtgcacgcaagatgcttagcaaccatgtcagcttcagtgcagctgctttacgtgcattttcgggagggacttcccctagtgaaaggtgtgtgtttcagggctccatcattcaaccaatgcaatgatcaatgcaagatcaattctacactgtttgattag

SEQ ID NO: 14645 - DNA, 285 bp, Glycine max
  Peptide Sequence Number=SeqID_106330
atggataagcactccaaagtgaggggccaatggattccttatgacatagatgccatcaaccaatttttagggaattcattgatcctagaggaatggcaacaatgtgagtacattgcaaggagaagtcggactacaggttttgatgaagaggctatagcctcccaggcacccaatggacccagaaaaatccaacaaggtactgggatttcatgccttaattacaggtctctgccagttctatggagtaccggtcacaccaacaaaacacatccggcctctgattaa

SEQ ID NO: 14646 - DNA, 474 bp, Glycine max
  Peptide Sequence Number=SeqID_106331
gcagctcccggagacggtcacagcttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccattgccggaaattgcgactgaaaaaggtgaccaatgtgtcgcaacacatcggaagagcttctggcactgccaatgctgtttggctcgcctaggaaacgcacgtgagagcgcatctgatgtcaaatggggatgctgtcgacagggttgggcagatcagggagagatggcggccgctggaacagtagcggtggctggccggaaaatgaagcaaagtttgccggaaaagtga

SEQ ID NO: 14647 - DNA, 351 bp, Glycine max
  Peptide Sequence Number=SeqID_106332
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggcgccctcaactatggctggacatgatcaacaatccacatatataaactcagctggtgttgatgtggctgaaaatggaggtgccgaagatgggaatcagcagtctgtgtaa

SEQ ID NO: 14648 - DNA, 519 bp, Glycine max
  Peptide Sequence Number=SeqID_106333
atgttggtaagctgcccctcctcagcaccatatgtagaggcagcggaggaatcattggaaacaactttccaatccttcgaggtggtgagttgtgcctctgtggagacgagtccgttgctaccttgtctctctaatgcgaccctaatggtggcgcgggtaatgctcaggcacggttatgagcccggaatgggtctgtgcaaggacagccacgggaatgccgatgtggttgacattaggggtaacccgcacaaatatgggttggggtatgagcccgggaaacctggaagaaggaatgcaccatcaagactccgggcagatagggcatggcccggtcatgttagccagtgtttcacaagtgtcaggataatgttcgaggaagaggtggcggatcctaacaacgagggtttgataatcgattttgaccgagaagtaagtccaacaataaacgaagaagaggaagaggacgtcctttcaccagagtttgagagattgatcgctacaggaagaagcgcgaaatga

SEQ ID NO: 14649 - DNA, 390 bp, Glycine max
  Peptide Sequence Number=SeqID_106334
atgttttccaagaaggagggaatgatgagaatcatgaaactggccaaatacaggctaaaggcccaagtggagaaggacgaaggcccaagtggagaaggacaaagcccccaagtggagaaggatgaaggcccagaggcagagacactatcaagactattaattttgaaccaatctcagacttatcaaggtaatccttgtggcgtctgtccagacttatcttccttcaccggaagtggcgtctaccctgacttatcttccttcaccggaagtggcgtctacccagacttatcttccttcaccggaagtggcgtctatcctgacttatcttccttcactggaagtggcgtcatccaaaccttcgtagcctgtatcaaacgatccgccccgtaa

SEQ ID NO: 14650 - DNA, 372 bp, Glycine max
  Peptide Sequence Number=SeqID_106335
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtatctcagttcggtgtaggtcgttcgctccaagctgggctgtgtgcacgaaccccccgttcagcccgaccgctgcgccttatcggtaactatcgtcttgaagtcaacccg

SEQ ID NO: 14651 - DNA, 555 bp, Glycine max
  Peptide Sequence Number=SeqID_106336
atggcagagaagctgttacagcaaatgatggacctaggccggttcgaaatcagtgatgagaacaagggagaacaacacgtatgcatacagtcggcgaacaaagaaagccccagaaaacctaagcctcttgtgatacacttcactagagatgctgcatcccgaggataccgaggccttcgccctatttcaggttgcaaacctattttgttcccttatggaagcaacaagatggtcccatggaaatatgctcctcagaagccaagcaaaaagaaagagaaggccaccagcattgacataccttctgccaaagttaccaacattatcggcctaagtggtgtgacccatagcggtcgcgtcttcacagcacctgacttgtcagtgcgacccacggatgccaaaggaaaggtgaaggtgatcgtggaagagaccaatgaagcgagccctactctagatgaggatgtttcagccaggaggtttgctgagaaaagaggagactttggcagaaagaaagtgtccatggaagaagccaacgagttcctccggatcattcaatag

SEQ ID NO: 14652 - DNA, 480 bp, Glycine max
  Peptide Sequence Number=SeqID_106337
atgactggcgaaaccgccggccgtcgaacgccgcccccacaccgtcgactcagacgccgagacccgcatccagcagggcacaccggccttccgccgcaccgcgctggcgctgttcctggccggcttctccaccttcggcctgctgtacacggtgcagccgctgctgcccgaattcagccgccacttcggcgtgtccgccgccggcagcgcgatgtcgctgtcgctgaccaccggcacgctggcggtggccatgctgctggccggcctgctgtccgacgcggtcggccgtcgcccgttgatgatcgctgcgctgctggcctcggccatgctgtcgctgagcaccgcgctggtggacgactggaccacgctgctggtgctgcgcaccctgctcggcctggcgctgagcggcgtgccggcggtagcgatgacctacctggtcgaggaaatggacagccgcgcgctgggcctggcgatgggcct

SEQ ID NO: 14653 - DNA, 327 bp, Glycine max
  Peptide Sequence Number=SeqID_106338
atgaaaagaggaaaacaggtctcctatagtagtcatgactctggcaatagtttaagtgaagaacttaacgactattatagagggcgccatagttcacatactgaacatcattcccaaagaagagaaaaggatagaaggcctcaagaggttaatattagtctcccatatttccatggaaaagataatgttgaggcctacttagattgggaaataaaggttgcacaactcttggcttgccatcatattagcgaagagagaaaagttccattggctacccttagctttcaagggtatgccctgttagacaaatggcctcagttatcttaa

SEQ ID NO: 14654 - DNA, 240 bp, Glycine max
  Peptide Sequence Number=SeqID_106339
atggctcgcctgggcgagctggcaggcaagcacctcccctattttgctataaataggggaggaagtgaagaagaaaagggaaaatctaagccgaggcgcttccgaaacgtttccgtaacgttttctgtgaggaatttcgcgaaggttttcgaccgttcttcgacgttcttcatcgttcttcgatcttcaacgggtaagtacctcgaaccaagcttttcgattcattctatgtactcgtag

SEQ ID NO: 14655 - DNA, 302 bp, Glycine max
  Peptide Sequence Number=SeqID_106340
atgggtgaccaagaggagacacaagaacagatgaaagtcaacatgtcggctttgaaagaacaaatggcttctatgatggaggccatgctagggatgaggcaactcatggaaaagaacgtggccaccgctgccgctgtcagttcggctgccgaagcagatccgactctccaagccaccgcgcaccatcctcccccaaatacgctaggacgaggaacgaacacactggggcacaacaacaacccccatttgggatacaaccgagcggcttacccttatggattgccgcctaatacacactgcca

SEQ ID NO: 14656 - DNA, 622 bp, Glycine max
  Peptide Sequence Number=SeqID_106341
atggccggacagaatgttccagataatccctacatcgccgcgcgcaacgaatggaacgagcgttatggctcgtacgtcaaagcggcagccgcctggcgcgtcgtcggcattgccggcatgtccatggcggtgattggctttggctacgcgctctaccagagcacgcaggtcaagctgatcccttatatcgttgaagtcgacaagctcggcacatcagtcaatgcgggcttcccgcagcagatcgaatatgccgatccacgagtggtgcgcgcgacactcggcagcttcgtgtcgaacttccggtctgtcacgccggacgcggtcgtgcagaagcagtatatcgaccggacctatgggctgctccgcacctccgatcccgcgaccgaaaaggtcaatgcctggtttcggtcgaactcaccgtttgagaaggcgaagaccgcgacggtcgcgatcgaggtcaacaatatcgtcgccctgtcgaaccagagctaccagatcgactggaccgagttcgagcgggatcgccgcggcaaggaaacgggcacccgccgcttccgcggcatcgccacggtgacactgacgccggcccaggatgagggtgtcatccgcctcaatcccatcg

SEQ ID NO: 14657 - DNA, 288 bp, Glycine max
  Peptide Sequence Number=SeqID_106342
atgtcgaagtataaggtttccatcttgttcttcttctatcaagcagcagtgtgcaggctttccacgacaccagaatttgatgtacggaaaatccccgtgtggggtgagttggaacatggatgccagcgtggcaagggcatcggccatctgattctcctctctaggaatgtggtgaaaggatatgtcatcgaagtactctatcagtttcctgatgtaggcctagtagggtatcaacttatgatccctgatctcccattcccttctcaactggtggattaccaaggctga

SEQ ID NO: 14658 - DNA, 294 bp, Glycine max
  Peptide Sequence Number=SeqID_106343
atggagtggaatgagatgttgtccaatggtgcatcagggacattttcaggcacctttttccctgatttcttggccctctttgatgtcgagacatctagttcgacatcatcatcagaatcagatgaggaaatttctttcctcttctatggaagggattgcaactttgctccgtctggatgtggtgccaacctgttggcaatgggttcctcatcagattctacttcttcaaggtcaatgaggtcacctggagcagattctggtgcccgtggtgccagggtctcttctgtggcttga

SEQ ID NO: 14659 - DNA, 483 bp, Glycine max
  Peptide Sequence Number=SeqID_106344
atggagggtgaagctccggaagaagacaaagaggtacatgccattaagacagagcttgagaaagcccaaacagtcaaagaaaagttcaagtcagcaactgttaggattcgaaaggaggatgccgaactgagagacatcaatatagccaccaccaaggccttggagcaagagaccaagaggccccgtaaggaagaacatggccggaacaaactccgaggggctctgtggggcagtaacagtgagcttaagctccgaagagaggaaagagaccaatcgcgagtagacggcttgatcctgaaggatgaattgagggtttgcctaaggtcaaagaggagtttgtctcagcagttatgcgagattgaaacagacatgttagccatcatcagcaagtaccaagaagaattaaatctagccatgacccacgagcacaaagtggcggacgaatacgctcgagtgtacgcggaaaaggagactagaggaagg

SEQ ID NO: 14660 - DNA, 321 bp, Glycine max
  Peptide Sequence Number=SeqID_106345
atgccgcaacaccccatacctttaccggctccacttaccattggtgtcgtccagctccctgttgatagcaagccccagacgtccttccccagccaccacatcctcctctccgacctcgacttattcccttccgtcatgttcattgccatagccacggacatgaagctcgaccaccatttccttccctccgtcgttactatcgacgatgccgaatggctccacttctgcagcactcatcttcactccctcattccttcacccattttaatttgggatcccggttcaaattttggagccatggttgtagccccaacaccttga

SEQ ID NO: 14661 - DNA, 306 bp, Glycine max
  Peptide Sequence Number=SeqID_106346
atgtacattgtggacgaagccaaaggtgttctcagaagatatgtggaggaacaggatgcgtgggaagaaattcttgagaatcatagactcaaaggagttgaacaaatcttcgctcagagaggaaaattgtgtgtcattttgccttcttccgggatctctgtcgtcgatgtggctgcaaaattccatggagttttagagaatccaacagagacaattgccaataatttgacagagtacatgaataagaagggtttgccaaagagattagttattgggagctctagcattcttgagactgctggttaa

SEQ ID NO: 14662 - DNA, 407 bp, Glycine max
  Peptide Sequence Number=SeqID_106347
atgaagctcctcagcggcaaaggcctacaacacctatacgtaggcaacgggaagctacccttgttactaaggatgttcatcacgtggatgacgcagctgatgaggtccacgaacagcctcaagaagcaactgttgatgatgaagttgttgatgcccagggtttttcaggcaggccgcatgacacatcagttctaacagtctatgttgatcatgttgcagtcattgtttggaatggagaggaatgtcctgaattgaagctatcgtcccatgaaaggaaggttcagaaatccggcaggcctactacaatgattgaaaaattagttgttgtcgtaggattaagtcctataatcgcatgttccttggacactggagatcggggacttatatcggcttttgtagaaaggtga

SEQ ID NO: 14663 - DNA, 618 bp, Glycine max
  Peptide Sequence Number=SeqID_106348
atgaccatgattacgaattcgagctcggtacccatcgagcacctggctgcgcgtctgctccgacaggccgggctggcccttcagcgcgcgcgacacggtgccgatgggggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagaagcaactcggtcgccgcatacactattctcagaatga

SEQ ID NO: 14664 - DNA, 207 bp, Glycine max
  Peptide Sequence Number=SeqID_106349
atgcagctcccgggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 14665 - DNA, 251 bp, Glycine max
  misc_feature (75)..(75): n is a, c, g, or t
  misc_feature (153)..(153): n is a, c, g, or t
  Peptide Sequence Number=SeqID_106350
aacgacttacacccgaactgagaaacctacagcgtgagctaagagaaagcgccacgcttcccgaagggagaaagncggacaggtatccggtaagcggcagggtcggaacaggagagcgcacgagggagcttccagggggaaacgcctgggggncggagcctatggaaaaacgccagcaacgcggcctttttacggttcctggccttttgctggccttttgctcacatgttctttcctgcgttatcccctga

SEQ ID NO: 14666 - DNA, 336 bp, Glycine max
  Peptide Sequence Number=SeqID_106351
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagcattgaggaagcttgcctgtcaagttattgtgagacaagtcgagcatctgaaggaagcttgcattgcaaaatag

SEQ ID NO: 14667 - DNA, 384 bp, Glycine max
  Peptide Sequence Number=SeqID_106352
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctcaaagtggaggttgttatttcttgcatcttcaagttgcttcctgcactcattttttggctttcggattgatggcagattttggcttctga

SEQ ID NO: 14668 - DNA, 384 bp, Glycine max
  Peptide Sequence Number=SeqID_106353
aagtggttcttccggaaacattccggaagaaagggttcttccggaaaggtcttccggaagagtgcgtcttccggaattcttccggatgaaccacttcttccggaaagttcccggaagaggttttccgggagtcttccggaagaagggttcttccggaagacgtttggttacttccggaagaacacttcttccggaaactttccggaaaatgttcttccggaacttccggaagaacccctaacggtgcataacaaaaccaaagctaagaagaaggccacctacctcgaaagcaaatgggtccaagggctgtcggagaagctcgcggagaagaagcttgtcggggaagagagaagagaagaagcttttgcggaagagactcagtga

SEQ ID NO: 14669 - DNA, 94 bp, Glycine max
  Peptide Sequence Number=SeqID_106354
atggagattatgactttaccaggctcaagtttcagctcaatcaatcaaaaacaagctcaacatgggtgccaaggatttactattcatgaaccgg

SEQ ID NO: 14670 - DNA, 758 bp, Glycine max
  Peptide Sequence Number=SeqID_106355
gagagcgcacgagggagcttccaggggaaacgcctggtatctttatagtcctgtcggttttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccggcaaacaggcggtcctgcggcttactgaaaaccagtttgctgtcgagcagcacttcacgcaggatgacattggcttcgtccgtatcaagacgcgtaccaatgtaagcgagcagtccattctcttcttttacgtcttcaatcttgagctgccagccgtcatggctggtcacggtgtcacccggattgaacatcacgcgggttacaggggagtcattgcgagcgtacaggcggttttcaccggtggcagggaagaggagggtaaccatacgcgcatcgacggcaacgacggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14671 - DNA, 330 bp, Glycine max
  Peptide Sequence Number=SeqID_106356
atggcacagaagaagagtactccaatcactcctgccacatccagaagaagcaagcattctcccaatagctttctgattcaacaaatattgggccaagacgctactgcttttccatggctacctcaccaaaagataactgcatccgtttcacccgctgtaccatcaaatctccgcaccaggaaaactgccaaacaacatccacagcccataagaaattcctggtcaagctttcagcagggaactggttcccagaagtatgcaattctacacaggattggtgctgcaaacgtacccacaatctacttccacgttgcaacaaggttagggtaa

SEQ ID NO: 14672 - DNA, 207 bp, Glycine max
  Peptide Sequence Number=SeqID_106357
atggagaaaagccatctcatggatgttggtctgaaattcctccctcaacatttcaactccgtggtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 14673 - DNA, 243 bp, Glycine max
  Peptide Sequence Number=SeqID_106358
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggtttgtcacatagtgaacccaacattgccactgcatttggttggcgtagtgggagaaaggtcattgttgaacagaggacagctagttcaaggtgggtatgcataa

SEQ ID NO: 14674 - DNA, 189 bp, Glycine max
  Peptide Sequence Number=SeqID_106359
atggagttctacgctaatgcctggcctaccaaggagggggtccgagatatgccctcctgggtgagtgtgcatgtggcccagctcatatctgacgctatttatcagtttgtagggattgcacctacgagaggtggagacaaagcccaagaggatgaggacatggccgacatgttagacttcctcctgtga

SEQ ID NO: 14675 - DNA, 252 bp, Glycine max
  Peptide Sequence Number=SeqID_106360
atgggaagagatcccaagaagtttctcctacacttaaattctataagtgtaatcaacccggtcacaaaggcaaactgcccctcaaatgagtcatggcccgagaagaatgagaagaaaagctataaagaaagaagatccaagaaggagtatattgcttgggatgacaatgactcatccgatggttcggagaaggagatcaaccttctatccaaggactatgaaagtgatgaaaacatctctcaagaagtttaa

SEQ ID NO: 14676 - DNA, 195 bp, Glycine max
  Peptide Sequence Number=SeqID_106361
atgagtatcgttgcgaaattcgtaaagttctgtaacgtgatgcaatcctaccccgcaagggcattggatagaaaactccaagtagattgggccagagatgcaagagaaggccctagggttcttatgagccttagggtagggtaccctagaaatataggatttttcagcccttgtattttagggcacctagactag

SEQ ID NO: 14677 - DNA, 528 bp, Glycine max
  Peptide Sequence Number=SeqID_106362
gcggaatttgatatcccagaggcttctgacaccgatcaggatggtgtcaaggacactgtctgtgacaaatacggcatcagcaaggaaaagtgggccttgttttgccagactcgcagagacccttcttgggaggatgtgcgcatcaaggcacaggccatccagaagcagaatactgccccccacgttttgtctcgtgggggttatgattatttggagcagaagctcctggctgagaagaccaagaagaagctgcaggaagatgcacattcaggaagcgttgatggcgtcatcgaccctccatccccagtcagacaccacgtgaagtggaagatggcccgcacgaagaagacaggggagatgacgattgaggccgcaaaggaaatcactgagaagattgattcgtttgaggagcagaccacacagggatcgttcgtcccccatggacgtcaggatgttctggccgctgctattggacgtccagagcaccctggacgtgtccctattgctggagccggtgtcaccatctag

SEQ ID NO: 14678 - DNA, 486 bp, Glycine max
  Peptide Sequence Number=SeqID_106363
atggcctcctcagatcccttgtttcatgaaggaaattccattcacagaccacccagtttcaatggtgagggttaccattattggaaaacccgcatgcagatattcattgaagccatagatctaaatatatgggacagaatagaattaggaccacatatacccactatagtagatgcaagcacaagcactacaacccaaaaacctagagatcaatgggtagaagaagataggagaaaaatccagcaatggcagcccaaggtaactgctatttctgaaagcaaagatctctcttccatgtctcttgccactttatttggtaaattgcaggaacacgagatggaacttcaacgcctcaatcagaatgaagaaaatgacaaaaagaagagaagcatagcccttaaagcctcatcttcaatacaagaagaaaacgaagaagaagattcagatgatgaagaacatttttctttctttgttaagaaattttag

SEQ ID NO: 14679 - DNA, 1599 bp, Glycine max
  Peptide Sequence Number=SeqID_106364
tgttccttggcctgtcgctgatgggcgtggtggcgcaggcgggttcctttaacctgaacgccatcgttgagagccagacgcacctgtggaacatcatcccgcagttctttggcttcgtgaccttctgtattgccggcgtcgcggtgtgccaccgtcatccgtttgaccagccggaagcggaacaggagctggccgacggttaccacatcgaatatgccgggatgaagttcggcctgttctttgtcggtgagtacgtggccattactaccgtttcggcgctgatcgtcaccctgttcttcggtggctggcacggtccgttcctgccgccgttcatctggttcgccctgaaaacggcgttctttatggtgatgtttatcctgattcgtgctgcgctgccgcgtccacgctatgaccaggtgctgtcgttcggctggaaagtatgtctgccgttgacgttattgaacctgctggccactgccgcagtgattctgtacaacgcgcatatctggatgattggcatgcatgccttcgccaaacgcgaaacccagatgtatccggaagagccggtttatctgccgccgcgctaccgtggccgtatcgtgctgacgcgcgatccggacggcgaagagcgctgcgtggcctgtaacctgtgcgccgttgcctgcccggtcggctgtatttcgctgcagaaagcggagatgcaggatggccgctggtatccggaatttttccgcatcaacttctcgcgctgcatcttctgtggtttatgtgaagaagcgtgcccgaccaccgcgattcagctgacgccggacttcgaactcggtgagttcaagcgtcaggatctggtgtatgagaaggaagacctgctgatttccggcccgggtaaatatccggagtacaacttctaccgcatggcaggtatggaatttgcgttttatctttgcggactggtggcggtgctgacgacattgcgcgtcatcacccacaccaatccggtacatgcgctgctgtacctgattgtttcgctgctgtcgattgccggcgtgttcttctcaatgggtgcctatttggccggtgcgctggagatcatcgtctatgccggtgccatcatggtgctgtttgtgttcgtggtgatgatgctcaacctgggtaaaacccagcaggatcaggagcgcgaatggctgaagccgtcgctgtggatcggtccgggcattgtctcgctgctgctgctggttgtgatgatctacgccatcctgaccgcaaccgaccagggtattgatggcaccgtcatcgatgccaaagcggtgggcatcagtctgtttggcccgtatgttctggcggttgagctggcgtcaatgctgctgctggccggagcacgcatgatcccgttacaacacggcctgattctggctgctgtgctgtttgttctcggcctgacctcgctggtactgcgccgcaacctgctgtttttgctgatcggtctggagatcatgatcaacgccgcagcgctggcgctggtggtggctggcagctactggggacaagccgacggccaggtgatgtacatcctggcaatcagcctcacggcggctgaagcca

SEQ ID NO: 14680 - DNA, 879 bp, Glycine max
  Peptide Sequence Number=SeqID_106365
atgagctggattgaacgcatactgaataaaagcactaccacgccttcgcgcaaagccagcatcccggaaggggtgtggaccaaatgcgatagctgtggtcaggtgctgtaccgcgccgagctggagcgcaaccttgaagtctgcccgaagtgcgaccaccacatgcgtatgcacgcgcgcgagcgtctgcatagcctgatggatgaaggttcgatgacagagctgggtagcgagctggaaccgaaagacctgctcaagttccgcgactcgaagaagtacctctatcgtctggttgttgcacttaaagagaccggccagctgcacggtatgccggtggtggccgccgcgtttgagttctcctttatgggcggctcaatgggctcggtggtcggcgcccgtttcgtgcgtgcggttgagcaggcgctggaagacaactgcccactgatctgcttctccgcctctggtggtgcgcgtatgcaggaagcgctgcagtcgctgatgcagatggcgaaaaccagtgcggcgctggcaaaaatgcaggagcgcggtctgccgtatatttcggtactgaccgacccgaccatgggtggcgtctccgccagcttcgcgatgctgggcgatttgaacgtcgcagagccaaaagcgctgatcggctttgccggcccacgcgtaattgaacagacggtacgtgaaaagctgccgccgggcttccagcgcagtgagttcctgatcgaaaaaggcgcgatcgacatgatcatccgtcgtccggaaatgcgctttaagctggccagcctgctggcgaaaatgatgaacctgccggcaccgctgcaggatggtgatcgcccgactgcggctgagccggagagcaacgaagcctga

SEQ ID NO: 14681 - DNA, 878 bp, Glycine max
  Peptide Sequence Number=SeqID_106366
atgagcactattttggccgcagctggcgttcaacctgctgccgcagcaggcggacagtgccggcagcgtggcgagcgagcgccggctggtcgatcagttctggtcggtggccgacaacatccgcttcggcggcgcgctgatggcggtgaaaactgcagagaagctggtgcaggagtatctgtattaatgctggaagacgcgaccccgtttaagctggcgctcggcattgagtatgacggcagccgttactacggctggcagcgccagaatgaagtacgcagcgtgcaggaaaagctggaaaaagcgctggccaaagtggccaatcacccggtgaacgtgttctgcgccggacgcaccgacgcgggcgtgcacggcaccggccaggtggtgcattttgagaccacctcctcgcgtgccgacagcgcctggacgctgggcgtgaacgccaacctgccggacgatattgcggtgcgctgggtgaaagcggtgccggaaagctttcacgcgcgcttcagcgctaccgcgcgccgttatcgctacgtgatctacaaccagcggctgcgcccggcaattctcggtaaaggcattacccatttttaccatccgctggatgcggaaaaaatgcaccgagccgcccaggctttactgggtgagaacgattttacctcgttccgtgcagtgcagtgccagtcgcgcacgccgtggcgcaacgtgatgcatctcaacgtcacgcgcctggggccgtacgtgattgtggatatcaaagccaacgccttcgtgcatcacatggtgcgcaatatcgtcggcagtctgctggagattggctgcggcaatcagccggaaacgtggatggccacgctgctaggcggcaaaagatc

SEQ ID NO: 14682 - DNA, 1020 bp, Glycine max
  Peptide Sequence Number=SeqID_106367
atgaacgatcagctgttctatcaggtgatttcgcccgaaggtcgcacgctgtccggctacccggatttaccgctggtgccgggcaacgcgccgctgtccgatgtctatccggcgctggtgcatttctacgatgcgcactaccgcaagcagccgattcgcgtggccgcgctgtggcagccggtgaatgaggaaggggtgcagggcatggcgctgtctgctgcgcaccgcgctgatcagccagagttttctggtgctgatcacgctgctgctggccgggctgctgctgcggaaagtgctgcgcccgctgcgccggctgtcacgcatgatgctgcgccgcgcgccgggcgaactgacaccgctgccgtcgctgctgccgtggagcgttttagcgccgatgtgtcgcatcagctgcgcacgccgctcaccatcctgaaaacccaggtcggcgtcgcgctcagcagcgacgatccgcagcagtggcgcgaaagcctgcagggcatgcgccacacgctggacgacaccgtccagctcaccgatcgcctgctgcagctggcgcaaatcaaggcgcgccacggcgaagacaagcctttcagtgaggttaacctgagcgacatcgtgcagcaggcctgttttagcggttatgcggcggcgcggcgtaaacagatcgacctggggtttgaagagcaggcggcgagccaggtgcagggcgatgcgctgttgctggccgagctgtgcgccaatctgctggacaacgctatcaaatacacgccacacggcggcacggtcaccgcacggctgcggcaaaaggtgctggagattgaagacagcgggccgggcatcgcggcggatcagcagcggcaggcgctgcagccgtttggccggctcgatcacgccagccagcccggcgcgggcattggactggcgctggtgcaggatatctgcgcctggcacggcgcccagctgcagctggaccgcagcccgcagctgggtggcctgcgggtgacggttagctttcgctga

SEQ ID NO: 14683 - DNA, 603 bp, Glycine max
  Peptide Sequence Number=SeqID_106368
atgcgctatgtggcgtttgaaggcggcggcgaaccggttaccgcgctgctcggcaaccacatccaggtggtatcaggcgacatgagtgaaatggtgccgcacctgcagggtggcaagatgcgcgtgctggcggtgatgagcgacaaacgcctgccgggtgaactggctgacatcccgaccgccaaagagcagggctttaacgttgagtggccgatcattcgcggctattacctcggccccaaagtcagcgatgccgattatcagtggtgggaacagacgtttaaaaaactgactaccgtgaacaggcgaaatcgttcggcctggcgaaataacggaggcacagatgagcgatcgtatctttgcggcggtgtggctggtgctctgcatcgtcgggatggttatcgcctggcagattcaaagcgagtacagctacgagccggttggtccacgccctttcccgctgctgctgctcggtctgatggcgatctgcgcggtgatgatgctgctgcgcaagccggacgccgtacagtggccggtggcggcaacgctgaaaaagctgctggcgctgtgcgtgatgctgatggtgtacggctggctgtttga

SEQ ID NO: 14684 - DNA, 1611 bp, Glycine max
  Peptide Sequence Number=SeqID_106369
atgcggcagcgacaacgcgccgcagagatgtccggcctgatacgcctcgcggctgcgggcatcaatcaccacaatctgcgtgacgccctgcgccaaatccgccgccagatcccaggcatcggtgtagtagctgatgtacggcaaagtggtctgcatcctgataccactttgactgtagcgataagaccattatgcagcacgcctttttgccactgtttcgccatcagacgcagggcggtttacgtcagcggctgtgcgccacgctgcgccaaggccattgtcagcggccatttgcgcttcgggcagaagctgccttcgagccgccagctggctgccgatctggcgctgtcacgcgtgacggttgaagccgcttacagccagctggagagcgaaggctacgtgcagcggcacagcggacgcggcaccttcgtcgctatcgccctgccgccaccggcggaaaaggcgacagcgcagcgcgcaccgcgcttttcgcagcgcggcacgcaggtgctggcgaccggtggctgccaggatcccccttttccccttgcctttgccgccggatcaccggaactgcgcgcgtttccgcaccgccagtggcagcggctgagccacagcgtacagcgcgcgctgggcagtcaggtgatgggctatggcgatccgctcggttatgcgccgctgcgccaggcggtggcggattatctggcgctgtcgcgcggcgtgcgctgtacggctgagcaggtcatcatgctcaccagttcacagcaggcgctgcagctgctggcgctgatgtttctggatgcagaggatgaagtgtggctggaggagccgggctaccgtggcgcgcggaacgcctttctcgccgccggtgcccgttgccgcgccatgccgctggacgatcagggcgcgctaccactcagcggccgggcgcaactggtgtatctgacgcccggccaccagtatccgaccggcacaccgatgagcctcgcgcggcggctgcagtggctggcgtgggcacgtcagcacgatagctggctgatcgaggatgactacgacagtgaatttcattatgacggtcgcccggcgccggcgctgcagggcatggaagccgatagccgggttatcagcctggggaccttttccaaaaccctgtttccatcgctgcgactggcgtggatggtggtgcccgcggcgctggtgacggcgctgggtcgcgcacgcagcgtacttgacggccatagcgccctgctgccgcaggcgatcaccgccgaatttatccagcaaggctatttcgccagccacctgcggctgatgcgtcagctctatcatagccggcgcgatcggctgctggtgcagctggaacagcatctgcagccgtggctgcggccgctgccagcgacaggcgggttgcaattgacagttgagttattacagggagatgaggcgcggctcacacacctggcgcaggcagacggtctgctgctgccgccgctgtcacccctttacgccggcgcatcgccacagcagggctggatactcggctttgcggcgttgacgcccggcgaaattgaccgcgcctgcgcgaagctggtaaggctgctggcaacctga

SEQ ID NO: 14685 - DNA, 918 bp, Glycine max
  Peptide Sequence Number=SeqID_106370
atgagcctttcccgtgaaggtacacctgtttcccgagcgttcgacgacgtctatttctccaacgacaacggactggaggagacgcgctatgtgttcctcgacggtaaccatcttccgcagcgatttgccgcacatccgcgcgatctgttcatcgttgccgagagcggcgttcgatcgcttccgcgccgcccatccgcaagccagcttgcgccgcctgcacttcatcagctgcgaaaaatacccgctgacccacgccgatctggtgagcgcgcacgcgcgctggccggaactggccccgtgggccggacagctacagcagctgtggccgctggccctgcccggctgtcagcgcctgctgttcaatggcggcgaggtgacgctggatctgtggctggtctcaacggccaggttgacgcgtggtttttagatggcttcgcgccggcgaaaaacccggagatgtggacgccttcgctgttcgccgccatggcgcggctggcgcgtcccggcggcaccttcgccacctttacctcggcgggctttgtgcggcggggcttacagcaggccgggttcagcgtggcgaagcgcaaaggcttcggccacaagcgtgaaatgctgaccggcgtactggacagcgcacccgggcagcggccggctcagccgtggtatgcgcgtccgcaggccaccagccgcgaggtggcgctgattggcggcggcgtggccagcgcggtgctggcgctggcgctgctgcggcgtggctggcaggttacgctgtactgcgccgatgccgccccggcgctcggcgcatcgggtaaccgtcagggcgcgctctatccgctgctcaaccagcacgatccggcgctcgccacgtttttcccggcggcattcagctttgcccgccgcctgtacgatgcgctgccg

SEQ ID NO: 14686 - DNA, 2320 bp, Glycine max
  Peptide Sequence Number=SeqID_106371
atggctacaatccatgtagacggtaaagaatatgatgtgaacggagcggacaacctgctgcaggcgtgtctgtctctgggccttgatattccttatttttgctggcatccggcgctgggaagcgtgggagcctgccgccagtgcgcggtgaagcaattccagaatgccgaagatacccgtggtcgcctcgtcatgtcctgcatgacgcctgcgtctgacggcacctttatctccatcgacgatggcgaagcgaaagagtttcgtgaaagcgtggtggagtggctgatgaccaaccacccgcacgactgtccggtgtgcgaagagggcggtaactgtcacctgcaggatatgacggtaatgacgggacacagcttccgtcgctaccgttttaccaagcgtacccatcagaatcaggatctcgggccgtttatctcgcatgagatgaaccgctgtatcgcctgttaccgctgcgtgcgctactacaaagattacgccgatggcaaagatcttggcgtgtacggcgcgcatgacaacgtctactttggacgtccggaagatggcacgctggagagcgaattctccggtaacctggtagaaatctgcccgaccggcgtgttcaccgataaaacccactctgaacgctataaccgtaagtgggatatgcagtttgcgcccagcatctgccagcagtgcagcgtgggttgtaacaccagcccgggcgagcgctatggcgagctgcgtcgtatcgaaaaccgctacaacggatcggtgaaccactacttcctgtgcgaccgtggccgtttcggctatggctacgtaaaccgtaaagatcgtccgcgtcatccggaacagctgcgcggtagcgaccgcatcacgctgaacgcagagcaggcggttaatgccgccgcggatatcctgcgtcaggcgaagaaggtgatcggtatcggttcacctcgcgccagtattgaaagcaacttcgcgctgcgtgaactggtgggcgcggaaaacttctcaaccggtatgccggcagctgagcaggcgcgggttgagctgatgctgaaagtgctgcagcagggcggtatctatacgccatcgctgcgtgaaattgaaagctatgacgccgtgctggtgctgggtgaagacctgactcaggttggtgcccgcgtggcgctgtcggtgcgtcaggccgttaaaggcaaagcacgcgaaatggccgccgctcagaaagtcgcggactggcagatcgccgccatcctcaacattggtcagcacgccaaacatccgctgtttgtcactaacgttgatgaaacccgtctcgatgatatcgccgcgtggagctatcgcgcaccggtggaagatcaggcccgcctgggcttcgccatcgcacacgcgctggatgacagcgcaccggcggttagcgactttgacagcagcctgaacggcaagctggacgtggtggtccaggcgctggccggcgcgaaaaaaccgctgatcatttccggcacccactcgggcagcacggcaatgattgaagcggcagccaacgtggctaaagcgctgaaagcgcgcggtgctgacgtcggtattaccttcctcgccggtgccgctaacagcttcggtctcggcctgatgggcggccagtcgctggacagcgcgctggagcagctggataaaggcgaagcggaagcgctggtggtgctggagaacgatctctaccgtcacgcgccgaaagccaccgtcgatgcggcactgcataacaccgcgcacgtgatcgtggttgatcatcaacgcacggccacgctggagaaagccggtctggtgctctccaccgccagctttgccgagagcgacggcacctccatcaaccatgaaggtcgcgcccagcgcttcttccaggtttacgatccggcctattacgacgatagcgtggtgatgctggagagctggcgctggctgcattcgctgcacagcgccgtcgagagccgccagattgactggacacaactcgatcacgtgattgatgccgcgattgtggcgctgccgcagctgaaagggattaaggacgcggcgccggacgccagcttccgtattcgtggccagaaactggcgcgttcaccgcatcgtgccagtggccgtaccgccgcgcgcgccaacatcagcgtgcacgaaccgcgtcagccgcaggataaagacaccatgtttgccttctccatggaaggtaacaaccagccgtcggcaccgcgttcgcagattccttttgcctgggcaccaggctggaactcaccgcaggcgtggaacaagttccaggcggaagtgggcg

SEQ ID NO: 14687 - DNA, 879 bp, Glycine max
  Peptide Sequence Number=SeqID_106372
atgctgcgctgggcagtaagccgcttttcggcggcgggcatctggtacggccacggcacggacaatccctgggacgaagcggtccaactggtgctgccgacgctgtggctgccgctggatattccggaagacatgcgccacgcgcgcctgaccgccagcgaacgtcaccgcatcgtggaacgcgtaatccgtcgcgttaacgagcgcattccggtggcctacctcaccaacaaagcctggttctgcggccatgaattctacgtcgatgagcgcgtgctggtgccgcgttcaccgattggcgagctgatcgaaaaccgctttgccggcctgatcgacggcgcgccgcgccatattctcgacatgtgcaccggcagcggctgcatcgccatcgcctgtgcgtacgccttcccggaagcggaagtggatgctgtcgatatctccaccgacgcgctggccgtggctgaacagaatattgaagagcacggtctgctgcatcacgtcacgccgattcgcgccgacctgttccgcaatctgccgcaggttaaatatgatctgatcgtcaccaatccgccctacgtcgatgccgaagacatggacgacctgccgaacgaatatcgccacgagccggaactcggtctggccgcgggcagcgacggcctgaagctggtgcgccgcatcctggcctgcgcgccggactacctcagcgagcagggcgtgctgatttgcgaagtcggtaacagcatggtgcacatgatggagcagtatccggacgtgccttttacctggctggagtttgataacggcggtgacggcgtgttcatgctgacgcgcgatcaaatcgtcgcagcgcagtcgcacttctcattctataaagactaa

SEQ ID NO: 14688 - DNA, 1311 bp, Glycine max
  Peptide Sequence Number=SeqID_106373
atgagcaaagcgcagccgctgctgacgcgtcagggcgaacgtatcgccattacccacggattacgcaccccgtttgcccgccaggcaagcgactttcatggcattccggcgctggagctggggcgcatggtggtcagcgaattaatggcgcgcagcgaattgccggtggaggtgatcgatcagctggtgttcggccaggtggtgcagatgccggaagcccccaacatcgcgcgtgaaatcgtgctgagcagcggactgagcgtgcacaccgatgcctacagcgtgagccgcgcctgcgccaccagctttcaggcagtggccaacgtggcggaaagcctgatggccgggaccattgatgcaggtattgccggtggcgctgactcctcctcggtgctgccgattggcgtcagcaaaacgctggcgcgcgcgctggttgacctcaataaagcccgcaccctgagcaaaaaattacacatcttacgccgcctgcgcccacgcgatctgttgccggtgccgccggccgtggcggaatactccaccggtttacgcatgggcgacaccgccgagcagatggccaaaacgcacggcatcacgcgtgagcagcaggacgcgctggcgctgcgctcgcaccatcgtgcagcacaggcctggcaatccggcgtgctggcgcaggaagtgatgccggcgtttgtgccgccgtggaaagcaccgattgagcaggacaacaacattcgctttaacgccagtgcggcggattatgcaaagctgcgtccggcgtttgaccgtcgccacggctcggtcaccgcggccaacagcacgccgctgaccgatggcgcggcggcgctgattctgatgcgcgaagggcgcgcgcgtgagctgggcattacaccgctcggttacctgcgcagctatgcgtttgccgcgattgatgtctggcaggacatgttgctcggaccggcttacgcatcaccgctggcgctggatcgcgccggcattaccctcggcgatctgacgctgatcgacatgcatgaagcctttgccgcgcaaacgctggccaacctcaggctgtttaacgatgaacgctttgcgcgcgaggtgctgaagcgcgatcgcgcgctgggcgaagtcgacgagacgcgtttcaacgtgctgggcggttccatcgcctacggtcatccgttcgccgccaccggcgcgcgcatgatcacgcaaacgctgcatgagctgcggcggcgcggcggcggcttagggctggtgaccgcctgtgccgctggcggattaggcagcgcgatggttctggaggccaaataa

SEQ ID NO: 14689 - DNA, 1229 bp, Glycine max
  Peptide Sequence Number=SeqID_106374
atgtcaatgtggaaatggttacaccagtgggcaaagcctgagcggctttaccagctatgcggtcgcttgattccctggttcgcaatcctgggcgtcggtgcgctgctgctcggctggatttggggattcggctttgcgccggcggattatcagcagggcaacagcttccgcatcatgtacattcacgtgccggcggcgatgtggtcgatgggcgtctatgcctcgatggccatcgccgccttcatcggcctggtgtggcagatgaaaatggccgatctggcggctgcggcgatggcgccgattggtgcggtgtttacctttatcgcactggtgaccggctcggcgtggggcaagccgatgtggggcacctggtggatttgggatgcgcgactgacttctgaactggtgctgctgttcctctatatgggcgtgattgcgctctatcactctttcgacgatcgccgcaccgccggacgcgcggccggcatcctgattctggtcggcgtggttaacctgccgattattcacttctccgtgcagtggtggaacacgctgcatcagggctcgtcgggcattctgcaacaggcgatcgatcccagcatgcgcacgccgctgcgctggtcgattctcggctatctgctggtggaggacgcaaagcatgacgcctgccttctcatcgtggagcgagtttttcgccatgggcggctatgccttttacgtctggctggccgtgtgttttacgctgattccgctgatcggtctggtgctgcacaccgtgttgttccgtcgccgcctgctggcagagattcgccagcgagagtccgtgtgaatatccgtcgtcgtaaccgcctgtatgtggtggtggcggtgctggtgggcttaggccttgccacgtcgctggtgatgtacgcgctgcgttccaacatcgacctgttctacaccccgagtgaaattctgtacggcaaaggtgaggatcaccagaagccggaggccggacagcgcctgcgcgtcggcggcatggtgatgcccggtagcgtcaaacgcgatccgaaaacgctggcggtgtcgttcaaactggcagggcgtggtggcgcagggcgtgctggaagacggaacctggtcaacgccaaagaggtgctggcgaagcacgatgagaagtacacgccgccggaaattcaggacgcaatgaagagatcatacggaccgggcagcggcctatcagcaggcgg

SEQ ID NO: 14690 - DNA, 1278 bp, Glycine max
  Peptide Sequence Number=SeqID_106375
atgtcaacaaccacagaagtcatcgctcatcactgggcgtttattgttttcattgttatcgcgtttggcctgtgtgcctttatgttaaccggtggctggttgttaggtggacgtgcacgcgcgcgccataaaaacacgccgtttgaatccggtatcgaatccgtcggtgatacccatatccgcctctcggcaaaattctatctggttgcgatgtttttcgtcattttcgacgtcgaagccctctatctatacgcatggtcgacctccattcgcgaaagcggctgggtcggctttgtcgaagccgcaattttcattttggtgctcctggcaggcctggtttatctggtgcgcatcggtgcgctggattgggcgcctgcgcgtcgtcgcgtagtcgtcaaatcgagcccggagattgttaccgatcctctggagcagcacgttcatcgcagcgtctatatgggcaagcttgagcacgccctgcatgacatggtgaactggggtcgtaaaaactctctctggccgtataacttcggcctttcctgttgctacgtggaaatgaccacgtcattcaccgcagtacatgatgtggcgcgtttcggtgcggaagtaatgcgcgcctcgccacgtcaggctgactttatggtgatcgccggtacgccgtttaccaaaatggcgccggtgattcagcgtttgtatgaccagatgctggaaccaaaatgggtgatttcgatgggggcctgcgccaattccggcggcatgtatgacatctattcggtggtacagggtgtggataaattcctgccggttgatgtgtatatcccgggttgtccgccacgtccggaagcttacatgcaggcgctgctgctgctgcgtgagtccatcggcaaagaacgtcgtccactctcgtgggtggttggcgatcagggcgtgtatcgcgccaatatgcagtctgagcgtgaaagaaagcgtgatttaaccacgcaagatctcgctcagcctgcatggcaaacccgggatcacctggatgatccggtgatcggcgagctgcgtaaccgttttgggccggatgcctttaccgttcaggccacccgcaccggcattccggtcgtttgggtgaagcgtgaacagctactggaaatcattgaattcctgcgtaagctgccgaagccgtacgtcatgctctatgacctgcacggtttcgatgagcgtttacgtacccaccgcgccggtctgcccgccgcggatttttccgttttctatcactctgctgtcgattga

SEQ ID NO: 14691 - DNA, 600 bp, Glycine max
  Peptide Sequence Number=SeqID_106376
atgacccgtagccactttttcgcccacctctcccgcctgaaactcatcaaccgctggccgctgatgcgcaatgtgcgcacggaaaatgtctccgagcacagtctgcaggtcgccatggtggcgcacgcgctggccatcatcaaaaacaaaaaatttaacggcaatctgaatgccgatcgcatcgccatgctggcgctgtatcacgatgccagcgaagtgctgaccggcgatctgcccacgccggtgaagtactacaacgcgcagattgcccatgaatacaagaagatcgaaaagattgcgcagcacaagctgattgagatgctgccacctgagttgcaggacgcgtatcgtccgctgctggatgagcacctgcatagcgagagcgagcaggcggtggtgaaacaggctgatgcgctgtgcgcctaccttaagtgccttgaagaactgtcggccggcaacaacgagtttctgctggccaaagcccgtctggagaagacgctggcgcagcggcgatcgccggagatggattacttcgttgaagtcttcatccccagcttcagcctgtcgctggatgaaatttcccaggatacgccgctgtaa

SEQ ID NO: 14692 - DNA, 660 bp, Glycine max
  Peptide Sequence Number=SeqID_106377
tccagcactgctgcgcagccaggccgtggcgtgcgccccagcttgaccaggcgcgattcacggccggcagtgaatccaccagcgtcccgtctaaatcaaacagaaaccccctgtacttcacacgttgctccttattcaggcattgaggatttgcgcgatttcattctcgctgaggtgatactgacgcggacaagtgtgccacaccgccagcatgcgttggtatttttcccacatcggggtttgcgcattgaagccgtgggtgccggaatcgaaatgggtatagcgcccttccacgttaaccataaagcgtacgtagccgaggtaacgcgcttcggtggccgcgtcgaagccgagaaacgccaggcgacgctcttcaatgttgcacggcgccttgtgattggaccaggaaacatgcagcgcatgatgcatttccataatgtcgatcagcgtacggcaggtcgcctcgctcagctcgccgaactctttgtccagctcgcgcaattgcagtccatagccgcgttcaataatggtctgatagcggcgatagcgctcggcgttatccggctcaagcatcgccatcatctggtattgattagaaagaatcagtcgctgtgcatgggtcatttccatggtttactcccgggccgcagggccgcttaa

SEQ ID NO: 14693 - DNA, 438 bp, Glycine max
  Peptide Sequence Number=SeqID_106378
atgtcggcggtgagcggccgcgccgaggtgatggatgcaccggagccgggcggtatgggcggcacttatgctggccatccgccagcaatggccgccgcgcatgcggtgctggatattatcagagaagaaaacctgtgcgagcgtgcgcaatggctcggtacgcagctggcagaagcgttgaacggcgccggctgccgtgcgctggccgaggtgcgcggctatggctcgatgatggcggcggagtttcatgacgccagcggccgaccctcagcggagatcgccaaagcgattcagcagcaggcgctggccgaaggattgatcctgctgacctgcggcgtgcacagcaacgtgatccgctttctttatccgctaaccattccggacgcccagttcagtacggcgctgaacattctcacccgcattctcagccagcattaa

SEQ ID NO: 14694 - DNA, 2394 bp, Glycine max
  Peptide Sequence Number=SeqID_106379
atgtatctcggcattgatattggcacctctgaactcaaagcgctgatcgttaacccgcagggcgagattgtggcgtcgaatcacgccacgctcagcgtgcagcgtccgcatccgcactgggcggagcaggatcccgagcgctggtggcaggcgtgtggtcaggcgatcgccgggctgcgccagcaggcgccggacgcgtgggccgcgattcgcgccatcggtctctccggtcagatgcacggcgccgtgctgctggatgccgccggtgaggtgctgcggccgtgcatattgtggaacgacacgcgcagcgcggcgcagtgtgatgcgctgcgccagcatcatccgcagatgatggaaatcgccgccaatctgattatgcccggctttaccgcgccgaaactgcactgggtggcggaacatgagcccgaaatcttccgccgcatcgacaaggtgttgctgcccaaggattacctgcgctggcgtctgaccgggcgctttgtcagcgagccgtcggacgccgccggtacgctgtggctcgacgtggcgcagcgcgactggtctgacgcactgctagcgattagcgggctgacgcgcgcacagatgcccgaactggttgagggctgcgcggtcagcgccccgctgcgcgccgatttggccagcgaatggggcttagccgccacggtgagcgtggccggcggcggcggtgataacgccgcatcggcggtgggcgttggcgcggttaatgcgggcgatgcctttatctcgctcggcacgtcgggcgtgatttttgtggttaacgatcggctgcgcgccgatccgcaatccggcgtgcacgctttctgccatgcgctgccgggacgctggcaccagatgagcgtgatgctcagcgccgccagctgtctgcgctggctgtgcaatctgctgtcggtcaccgaaagccagctgatggacgagatagcacagctcagcgcggaacagctgcgtcaggcaccgctgtttctgccgtatctctctgggcgtagcgtttggcctggcggatggcctggcagtgctgggcgatacgcaacagcagattcagcagtgcagcctgaccggcggcggtgcgcgcagcacgctgtgggcgcagctgattgccgacgtgctgcagctgccgatagtgacccatccggccagcgcctccggcgcgctgggtgcggcgcgactggcgtggctggccgacggcggcagcgaagccgacgtgtgcctgaagccgccagtgcaggcgcgctatcagcccgatgcggcgcgcggggccgtgctgcagcagcggctgcgcctgttccgaagattgtcatgcaatcgaacgcatactggtttggcttaccgaaaaagatgttctggggctttctggccatcgccattttcatggccggcgacggcttcgaaatggcgttcctgtcgcgccacatcactgacatgggcttttcgccggcccagtcggcggtggtgtttacgttttatggtctggccgccgcgctggcggcgtgggcctccggcgtggtggcggagctgattacgccgcagcgcgctatgatgattggctttgtgctgtggatcgtcatgcatgcgctgtttatgtcgctggggcttgggctgcgtaactatccgctgatggtgctgttttacggcattcgcggcctggcctatccgctgtttatctactcgttcatgatgatgctggtgcaggtgctgccgcgtgacaagctggccgccgccaccggctggttctgggcgatgtactccgtagggattggcgtggtgggcagctacctgccgagcctgaccatcccgatgctgggcgaaaccggcaccttatggctggcaattgtctgggtggcgtgcggcggcgtgctggcctacttcagcctgcgcaacgtgccggtggatcgttcccgcgttaatctgccgctgcgcgataagatgacggagatgtcgcgtgccgtgaccattctgttcaccaaccagcatgtgttttatgcctgcctgattcgcatcatcaatacgctgtcgctgtttggttttgccattatcatgccgctgctgtttgtcgatcggctcggctttaccatctccgaatggctgcagatttgggcggtgttcttcttcgtcaccatctttaccaatattttctggggcattaccggtgagaagctgggctggatccgtcaggtgcgctggttcggctgtctcggtatggcgatctccagcctggcgttttactacctgccgctgtatgccgggcataacttctgggtggcgctgattccggcgattatgctggggatctttgtcgctgcctttgtgccgatgaccgcggtgttcccgacgctggaaccgcatcataagggcgcagcg

SEQ ID NO: 14695 - DNA, 512 bp, Glycine max
  Peptide Sequence Number=SeqID_106380
tgtcaggcggagaagatatgttggtatgctgccccacctccgcaccatatgtagaagcagcggaagaatcattggaaacaactttccaatccttcgaggtggtgagttgtgcctctgtggaaacgggtccgttgctaccttgtctctctagtgcggccctaatggtggcacgggtaatactcaggcacggttatgagcccgggatgggtctgggcaaggagagcctcgggaatgtcgatgtggtcgacattagggggaacccgtacaaatatgggttggggtatgaacccgggaaaccgggaagaaggaatgcgttgtcaagactctgggcagataggaaatggcccggccatgttagccagtgtttcacaagtgtcgggataatgttcgaggaagaggatcctaccaacgagggtttgataatcgattttgaccgagaagtaagtcaaataataaacgaagaagaggaagaggacgtcctttcaccagagttggagaggttgatcgcttag

SEQ ID NO: 14696 - DNA, 366 bp, Glycine max
  Peptide Sequence Number=SeqID_106381
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatccccgacaaagattaattctggacatagcttacgtgcaatgaagccaggcatggcagctcgaaacccaaatttccgtgcctatgtaaagaccaaatga

SEQ ID NO: 14697 - DNA, 255 bp, Glycine max
  Peptide Sequence Number=SeqID_106382
atgtcagtgaaaaaccaccctggggcgcttaggagtacacaacaagacacaccacacaatgggtttgtcaggtcactcatcactaattttgcgagaatgctccaaccatatgagatcagcataggcttaaaggagcactcaaacccggtgacccccaaggcctacactccgaagagtccgtcagggcctctccctcctgattcagacactgctcatgaattatacaatacccacgaccttacactcgtgttttaa

SEQ ID NO: 14698 - DNA, 954 bp, Glycine max
  Peptide Sequence Number=SeqID_106383
atgcaattaggaggattcgatgaaaggacatcaattcaaatcctggattttcgaattgagagagatattgagagaaatcaagaattctcgctatttcttagattcatggacccaattcaattcagcgggatttttcattcatatttttttccatcaagagagttttataaaactcttggactcccgaatttggagtatcctactttcacgcaattcacagggttcaacaagcaatcgatatttcacgatcaagttgattgttccgctcctgtatctccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaag

SEQ ID NO: 14699 - DNA, 480 bp, Glycine max
  Peptide Sequence Number=SeqID_106384
gatcccccagctcactcaaaggcggtatacggttatccacagaatcaggggataacgcaggaaagaacatgtgagcaaaaggccagcaaaaggccaggaaccgtggcgaaacccgacaggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 14700 - DNA, 276 bp, Glycine max
  Peptide Sequence Number=SeqID_106385
ccgaacgaccgagcgcagcgagcaagtgagcgaggaagcggaagagcgcccaatacgcaaaccgcctctccccggcgcgttggccgattcattaatgcagctggcacgacaggtttcccgactggaaagcgggcagtgagcgcaacgcaattaatagcaatgcatgctgaaacagttccaattcaccctcttgtgattgcaggctggtgtggcttaaccatacaagcttttaacatgcttccagtggggtgccttgatggtggaagagcagtgcag

SEQ ID NO: 14701 - DNA, 180 bp, Glycine max
  misc_feature (48)..(48): n is a, c, g, or t
  Peptide Sequence Number=SeqID_106386
atgagaaagcgccacgccttcccgaagggagaaaggcggacagggggncggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 14702 - DNA, 438 bp, Glycine max
  Peptide Sequence Number=SeqID_106387
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgtttcatttgtcacttggggtgggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 14703 - DNA, 296 bp, Glycine max
  Peptide Sequence Number=SeqID_106388
gtgctggtgcagtcacttcttttggttaccgtaaggatcgtaatggtcaatggctgaagaaggacgtgttacaagacgagcgtactccctctcctcctcctaagcatgatgattcctcagcccttatgactgaagttctttcggagttacggggtctccgcacatatgttggtgaacgattcgattccttggatggtcgctttgaaggcatggatacccgtatcacccagtttgaagaagatgtgacttatatttgtcagagcttcgatcttccaccatcaccaccaccttcttag

SEQ ID NO: 14704 - DNA, 372 bp, Glycine max
  Peptide Sequence Number=SeqID_106389
atgtccaaatcttgtggatttgggatgaccggccctctcgatgagtcgatctcttgctttctcataagggtggacccttgggtacttgtacctatcacctttagaggactacacgtcctcgccttgagagggctacacgccctcaccttggagggctgcacgccctcacctccagaggactatcatgtcctcgccttgagagggctacacgccctcaccttgggtactagttaccctcaccgtcagaggactacacgtcccgccttgagaggactacacgtcctcaccatcagagggctgcacgcccttacctccagaggactacatgtcctcgccttgagagggctacacgccctcatctttgggtactag

SEQ ID NO: 14705 - DNA, 852 bp, Glycine max
  Peptide Sequence Number=SeqID_106390
atgcttcaactatttctcgtccttggaaaattctttttgcaagaatcaaccgcttctttcattctcctttgctacaaggtcatgacgaaagatagcaattggtacctcaaagcccttcactggggcaatgaggggcacctacctattgccttcagagggctacacgcccacaccttcagaggactacacgtcctcgccatcaaagggttacacgccctcaccttcaggggactgcacgtcctcacctttagaggactacacgtcctcgcctttagagggctacatgtcctcgcctttagaggactacacatcctcaccttcagaggactacacgtcctcaccctcagagggctgcacgccctcgcctttagaggactacacgccctcgccttcgtggggctacacatcctcacctttagagggctacacaccttcgccttcgtaggacttcacgtcctcaccttcagagggctacacgccttcgccttcgtaggacttcacgtcctcaccttcagaaggctacacgcctttgccttcgtaggactacacgtcctcactgtcagaggactacacgtcctcgcctttagaggacttcacgtcctcaccttcagagggctacacaccttcgccttcgtaggactacacgtcctcacctttagaggactacacgtcctcgctttcagagggctgcacgccctcgcctttagaggactacacgtcctcaccttcagaggactacacgtcttcgccttcagaggacttcacgttctcatcttcagagggctacatgccctcagaggactgcacttcctcgccttgagagggctggacgccctcgccttcaaagggtga

SEQ ID NO: 14706 - DNA, 255 bp, Glycine max
  Peptide Sequence Number=SeqID_106391
atgtaccaaatatcatgcttggcgtgcgaagaaaggtacgtttcttactttgattctggtgccactgctaacatcagtgtttcaatgcaaggttgcttaagctaccgaaaaccaattgattctgaaagatggatatatgttggagatgttaaatcggtggagcttcctatggtgaatcctttaatgcggaattgcgtggtactaagtgtagaattgataatacaaactcaggagcattatggcataagcgcttag

SEQ ID NO: 14707 - DNA, 411 bp, Glycine max
  Peptide Sequence Number=SeqID_106392
atggatatgaacttggggtacattatctcaagtcagatttctatgatcgcacagcatgactcctcatggcttggttttgctgccctcatcactgccctatgcaaggccagaggagtcacttctgattcgttatcttttgagagccttaacccaaccattaatttggcttatgggtcccacaaggctaagggcaagaggtctgaggctccaccatcttctgctttccctacctcagctctttctacttctactgtagctccatatgctccagcttcatctgtaccagctccagctttagccccagtttcttccagaccctccacattcagctccgagactttatttgccatgttgcaaagcctgcataaaggccagattataatcatgcagagcttgcagatctcaggctag

SEQ ID NO: 14708 - DNA, 219 bp, Glycine max
  Peptide Sequence Number=SeqID_106393
atggtccctccaccgttgagcgtactctttaaaggtctcactgtccgttgtaaccatgttctgcagctgagtgcgattgggagccatatcgaaattgtactgatattgcctaaggaaggcaataatcagatccttccaagtgaggatgcgggaagcttccagattagtgtaccaaatgaccgcggctccagccgagctatcttggaaaaagtgcattaa

SEQ ID NO: 14709 - DNA, 618 bp, Glycine max
  Peptide Sequence Number=SeqID_106394
atgggtgatcaagaggagacgcaggaacagatgaaagccgacatgtcggctctgaaagaacaaatggcctccatgatggaggccatgttaagtatgaagcagctcatagagaagaacgcggccaccgccgccgctgccagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattatgctcggagggatgtcgagttctatcccccgatccccgaagggccggcaccaggcacgttgcctcaacccaacatcgcagtaccaccaatagttctgtccacggaagggccgcccccagcaactgaagaaaggaggaagctcgatctccttgaggaaagattgagggccgtagaacgatttggggactatccgttcgcagacatgacggatctttgctta

SEQ ID NO: 14710 - DNA, 219 bp, Glycine max
  Peptide Sequence Number=SeqID_106395
atgttgctaagtagcaacgtcatttatatctgtgtaagagtggtcatgctgatgcgcatgatccatacttgtctctttgcagcagcacgggtgaaatattgccccggtatgcatagtagctgcgtgatagcctccctctctggttgtgcttgcacagtcggtcgccctccagtatcagggggtcgcccagaaacaccctctgatggcaaggacgtgtag

SEQ ID NO: 14711 - DNA, 471 bp, Glycine max
  Peptide Sequence Number=SeqID_106396
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgcatcagcatttcctttctgaggataggtgctccaatccataa

SEQ ID NO: 14712 - DNA, 603 bp, Glycine max
  Peptide Sequence Number=SeqID_106397
atggcgttagcaattatctgggccacgcgaacagtcatccgtgtcaagatgcgtcatccatatctgagtcagagtagtcatgctggtgcgcataatccacacccgcctccccgcagcggtctgggcaaagtcttgcacaacagctgggcgatcgcctcctcgtcaaagccggaggcctggtccctcctctggctgaattcgcaccgttggttctcctccaagatcagtgggtggcctaggaactggctgagggcatctaactctaggactatctcagggtcgaacttggccatgggagtcactagagtactcatcctctacgtgctatctccggtgactgttgaactccgtagaggcgctggagctttccccatgggcgtccctcctgtacctctttgtggagagcttcttcggagccatctcttgttggggatgaataacaacgcaaaatggaatcaaaaaacgttgagaaatgggggtgctcgcccaggcgagctaacctcgcccaggcaagctaaccctggcctcctcaacatgcgaagccagtcacaggatgatgatctactgaccatcagcctagtgcctgctcgtacccgtccctga

SEQ ID NO: 14713 - DNA, 441 bp, Glycine max
  Peptide Sequence Number=SeqID_106398
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcatagtggatgagatcggtcgagtggtctccgttggagatgggattgcacgtgtttatggattgaacgagattcaagctggggaaatggttgaatttgccagcggtgtgaaaggaatagcgttgaatcttgagaatgagaatgtcggacttgttgtctttggtagtgataccgctataaaagaaggagatctt

SEQ ID NO: 14714 - DNA, 309 bp, Glycine max
  Peptide Sequence Number=SeqID_106399
atgaagaagctgcctgcggctctacgcagcctgtggctgatcgtgaccatggtgctgggcgtggtgttcgtgtggatgatgcgattcgccgccgggtgctgccgggttgggcctgattcggcttcgctgatggcctggcgctgtcgttccggtgtcggtcgcgagcatttgggtattgaaagtgcgctgattacccgcagctggtaccacgtaaccgcgctgacgcctgctggcagcctttgtactatcgtgggcctggctgggcaactgattggccgtggggtattctacggatgcgtgctgccatga

SEQ ID NO: 14715 - DNA, 645 bp, Glycine max
  Peptide Sequence Number=SeqID_106400
atggacctcatcaaggctgctggactgttgaaaactgtcaccaagttgggagattgctatgaaagtctagtcagggaattcattgtcaacattccctctgacataacaaacagaaagagtgatgattatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacagggaaagctgctgcttcaggtgctgtatccaaggatgccttgattgctgaactcaaggacacatgcaaggtgctgggggcaaccatcaaagccaccacagagaagaaaatggagctggaacggctgattgaaagactctcagaaagtggcattgatgatggtgaagcagctgaggaagaagaagcagctgagcaagaagaagatgcagcagaggatacaaaatcagatgatgatgattctgatgccaccccatga

SEQ ID NO: 14716 - DNA, 240 bp, Glycine max
  Peptide Sequence Number=SeqID_106401
atggctctatttgacacaggggctgattcaaactgtattttagaaggattaattcctaagaaattctttgaaaaaacctcagaaaaactcagtacaacaaatggatctaaattaaagatcaattacaaactatctaatgcaatcattgaaaatcaagaaagaaacatattgtcgatctcccttatgagaaagactttagggaaaaacaaattcccacaaaagccaggccgattcaaatga

SEQ ID NO: 14717 - DNA, 792 bp, Glycine max
  Peptide Sequence Number=SeqID_106402
atgatcatgagggatcaagacatttatagtagtcacgaggagactacttcttgcccttcctctagtggaagtgaatttgaaataaggggtgaagagtctagtgaggaagtctacccccatgaagaaggtgacctcttaatgaaaaacaaaaagaaaaagaaggatagtaaggccttgtcttcaaaggccaaggggaaggaaaaggaggaaaaggattcctccaagaagattgttaagaaggaaaatcattttgcaacacaaggtgatattaaaagggcactccttcttaaacaatctttctaccttctcctatcaagggaaacatcccttagcaccgccatacctcttgagcttgaggttattcctcaagtaaaggagtttttggatgagggtttggttcgcaagagtttaaatcctcgtgctttgttggtgcctaaaataggtattattaggcaccaaatccctatgataggtggtataatgaatgtgttgagtggtgcaacactcttttgtaaaatcactcatgcacccaacatcttcatgatttgtgtacatagggactcattagatagtgatcaagggtttcccatgaaccctaagagaataaaggtcattcttgagtggcctactccatcaagtataagggaaatttggggcttcaatatcttaaaaaacttttacaaaagtgttgaggaaggaatccatgagtttcaagaacctctggatttgaggtcaaatccttttcaagggagagggaatgatgcaatcataccccccaaggacattggatag

SEQ ID NO: 14718 - DNA, 138 bp, Glycine max
  Peptide Sequence Number=SeqID_106403
atggaggttgaggaatctttgatgggctcacaactaccatttcattatcgagcagatacgggaggatggtgtttggtcttggatgtgcatcaggtggattttgtggctgatctaggggtggcctttgaggatgattag

SEQ ID NO: 14719 - DNA, 243 bp, Glycine max
  Peptide Sequence Number=SeqID_106404
atgggtgccgagtacctcgaagtggtcaaacgagggtcgcatcccaacaaacagatggcacagaatgaccataatttgtctctacgtgccctcgggcacaatcgagcctgggtggcaaggcggagaatgaccataatttgtctctgcgtgccaccgggcactatcgcctctggatggcgaaaaggtgtggggaatgaccataatttgtcttcgcccacctctcgactcactgtccctaaatga

SEQ ID NO: 14720 - DNA, 117 bp, Glycine max
  Peptide Sequence Number=SeqID_106405
atggaacataggctcaaaggggctatcaaagggattaattcaaggaagcatcaacaagaatcaagccaaggctattgtgaaagcaatcaatggggcaaaacacaccgaataaaatag

SEQ ID NO: 14721 - DNA, 229 bp, Glycine max
  Peptide Sequence Number=SeqID_106406
gatctactgtgtcgcaacgtgccctttcgcgggcgagcgaaggcgaggctcacgggtgcgctttccaaaggaggaaagatgcgcggagtcgccaccaacgaaggtattagcacctctcacgtcgacaaaagcggggcttttgctcctacgtaccctccatcgaagaggaaatcaaacctacgtagttctttcataagagtgaatcaagtgattctttttactttggaag

SEQ ID NO: 14722 - DNA, 411 bp, Glycine max
  Peptide Sequence Number=SeqID_106407
atgatacgcggagataccttacggttattcgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggaaatacccgagtgagactgacatagtcttctgcaccttttgttcctccaggaacaacaagtcatttacatgcggaaatttcatggtcgcccgcgactctcgtcaaccgggaggagccaaactagtgtcatacactaattttcggggacctttgcttgatgacatgcgaccattctttggtccttgtgaggtgcttggcacccatcattag

SEQ ID NO: 14723 - DNA, 339 bp, Glycine max
  Peptide Sequence Number=SeqID_106408
atggcctgcccccaatggatgctctggagcatggaatgcagcatctgtggagtaaaaataaaatatgctggacctacagagagaggagccgaaagtggaatctctgaaggtgctggaggaatcactgggatctctgtggaggaagagggaggaagtgtagaagaagaaggacctcttgtctctggtgctgaagtggaagggacctcagatctcttttctttggccttcctgggtcctctgaatgttactgttggatcatcaagattccaacagttcttcttaatgtatgccaaattaatggcacgactcaggctctccaaggatctcgagttagactga

SEQ ID NO: 14724 - DNA, 147 bp, Glycine max
  Peptide Sequence Number=SeqID_106409
atgtttgtattcaatagtgctttgaaaggacttgatgatactccacaaagtaaatccaaggctgctactaggtggattgttgttaaatatttcaattatgctataccattggaaccagagagattgaaggcacttcgcatccgatag

SEQ ID NO: 14725 - DNA, 222 bp, Glycine max
  Peptide Sequence Number=SeqID_106410
atggcttcaatgaaagtcggaagcacttcagcagagtataagagccagaaagtggcagatgacccgagagagaacttcgcaactcagcagcaaatgctcaccgcaactaaagagacgaatgatgaaatttcgcagatgaagtcaatgtgtactcgcatgcctgttcactatggcgttaattacttcgtgaggtactacacgttgctttttgcctgtaattga

SEQ ID NO: 14726 - DNA, 603 bp, Glycine max
  Peptide Sequence Number=SeqID_106411
atggcagagccatcgaagaagagaaagggatcatcctccaccgctgctgctgctgcccatcgccgccacggaccatccggagcatccacaacacctattcatccatctttgtcatctccaagatcatccacattgttttcttctgatgatcagcgtctacggtacctctctcaattttcttctaggatcatcttagaccctaagtacctagacgtagagttctttaatgatgaaacgtttgattgctatcaagtgtttcaaaattctggccttgttgatttcatgtcattaaaattgccacattatcctgaacttgtaaaggtcttctactgcaatttaaaaattcaggatggcattattacctctgaggtgcatggtattcctatggtcattgatcagtcattgttcttttctttaactcatttacccaatcaaggtgcaccttttgagggcaccattttgttcatgactggaaatttgattattctagtcatgatgctcgtcgtatggctaaaggcccaagtggagaaggacgaaggcctaagtggagaaggacaaagcccccgagtggagaaggatgaaggcccaagtggagaaagatga

SEQ ID NO: 14727 - DNA, 334 bp, Glycine max
  Peptide Sequence Number=SeqID_106412
atggtagcatcccacaacaactgcaaaggcttgaggaaaagctgcagaaaggctatacaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcactg

SEQ ID NO: 14728 - DNA, 495 bp, Glycine max
  Peptide Sequence Number=SeqID_106413
atgtggcgcaacgggaagatgccgaccgacatgcccttgagcaggttgacatcgaaggtgcgcaccatgtcgagccagccttcagcctgcgcacgtgagccgcgcatgaccagaatgttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14729 - DNA, 219 bp, Glycine max
  Peptide Sequence Number=SeqID_106414
cttgggaggattgatggggacccggtgttgagaggaacaaggataagggctacgtgggagtacgtgagctcagtgaagagtggtacctggagatatgtcgcgggggtcaagagaccttggggacgtcaggcgagctcttggcagtcaaccgataaaagaacaaagaccacaaagcaagggggcttatgtggtggctggccagctgtgaatcttgtgtga

SEQ ID NO: 14730 - DNA, 261 bp, Glycine max
  Peptide Sequence Number=SeqID_106415
tcaaggttggtgttgaggaagttagagatgcagatgctcccattcctatacccactaaaaagttcattgtgggaccgatgaaacctgcagataggccagatcatgatgttgattatcccttatatctgatgacattaaccattccacaactttttctgaagccgttgcaggttatgtgggatgctatcgtgtttggggactttaatgacaacttccccttgtacataaagcatgaaggcttgtttgaaatagcacacgatg

SEQ ID NO: 14731 - DNA, 243 bp, Glycine max
  Peptide Sequence Number=SeqID_106416
atgaagaaaagagatacaggccatcaaagtgtgtcattaaagaataagacaggagattcaactatgctgaagataggagattcggctaaagttgtgataaaacaagacatgaagggaagaaggcataaatatgggtttaacaacaataaacgtgagaagccagagaaggtaagggtggtggatgatgaaactggtgacaaacatcagccagatccagtgggcacagttttatcttcgagttag

SEQ ID NO: 14732 - DNA, 321 bp, Glycine max
  Peptide Sequence Number=SeqID_106417
atggcacccggcgctgttcaacctggcgctgtacgggatcgtgcttggcctgctgttccacctcctgcgttggatgcaatcgtgaacaagatccgcagccgtgatcgtcgccctgctggtgctgcgccagctgtgggtggcaccggacgtgtccgggctggtggaaacggtgaacgtggccgacaaccaggcggtgaagaagggcgacgtgctgttcgtgatcgaccgcgcgcgctaccgcatcgcgctggaacaggcccaagccagcctggccgagcgccaggcctcggtggcgcagctgcgccgcgaaatcggccgtga

SEQ ID NO: 14733 - DNA, 392 bp, Glycine max
  Peptide Sequence Number=SeqID_106418
aaacaccggtgtgcggatcgatgatgtaggatttacgctgctagatctaaagaaatttgcttaccagaatgacactttgatcatggcagaacaagccaaacaggtattttatgttcaagacccttgtgatgaaaggcaaatggctacaccacccagctctcctccttctcctactgttgcagaatcacagtcgccatctaccttgaagcggacaagaaaagccacacaactaagatcattggcgactagactagttggggcagagagaccgatggtccatgtcgatcctgggaccgggaaggccaacaatccccatagaaagaagttaagaacatatttgggaatcgtcgctcgtgataaggtcgatgtcacatacgagaatttgaaaacaa

SEQ ID NO: 14734 - DNA, 375 bp, Glycine max
  Peptide Sequence Number=SeqID_106419
gatttgcctaaggtccaagagaagcttgtcgtagcggttatgcgagatcgagaccaacatgttaaccatcgtcagcaagtaccaagaagaattaaatctagccaggcccacaagcacaaagtggcagatgaatatgcccgagtgtacgcggaaaaggaggctagaggaagggtgattgactcgttacatcaagaggcaacgatgtggatggaccgattttctcttactttgaacgggagtcaacaacttccccgattgctggccaaggccaaagcaatggcggatgcctactccgctcccgaggagatccacgaactcctcaactattgtaagcatatgatagacttaatggcccatataattaggaaccactag

SEQ ID NO: 14735 - DNA, 651 bp, Glycine max
  Peptide Sequence Number=SeqID_106420
gggcagaatcaactggccgtggtcagatgccaggatgaagttggaggccgaaacccatcaaggctagggtcacgaccaatgggtcgtcgtcccttgcctagctctggacaaatgaaaagcgccgctgcaaggcaacctaagggcgccaactgtgcgaatacaactagagagggaggctatcacgcagctactatgcatactggggcaagatttcacccgtgccgctgcaaaaagacaagtgcggatcgtgcgcaccaacatgaccactcttacacagatatgggtcatgcccacaagacacccagtggactcggagaagtccaacagggccctggggtttccagttctaggatcgcgcccgcaggacaccccgtggacccaaagaagtccaacagggtcctggggcttccggctctgattacgggcctttgtcagttctacggagtgcccgtcacccccagcaaggtcatcaggcctcctactaaccgagctttcatcaagaagtattgcgcccccaggcaggcagagggcaacaaatgcaccgccgccacctccagagcccctcagctcatccacagaaaggtccgtgaccgacaagtcatcaggcgtccagctcaagacgttaaagaagcgctactaggaggcaaccca

SEQ ID NO: 14736 - DNA, 420 bp, Glycine max
  Peptide Sequence Number=SeqID_106421
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatttgaaaggaactgcttag

SEQ ID NO: 14737 - DNA, 690 bp, Glycine max
  Peptide Sequence Number=SeqID_106422
atgtatgaagtttatgggattaagatggtcattgaccaatccctattctatgattcaacccaattgccaagtaaaggtgtaccatttgaaggtacactgattgacgattggaagtttgatttttctgtgcatgatgcccgccggttggtttgcaccaaccaagcggatatgaccgaaaggcttcttgccggttcattggcttttgaaagtcgcatccttcattatctaattgttcgcatcttgcttccaagatcttcaaacattgcacaggtttctgaagaagatctcattgttatgtgggattttcataaagtcaccctcttccttcaacactttaacatccctcttgattctgaaccctattttccaatcaagagatcctttctaataggcgcttcagtcattgcatcctttggttatcaaaaagagcatgatggctcttgggtgaaaaagggtgctcgacatgttggtgaagaaggacacgatgaagaagattcatctcttctttcaaagattttggataggttcgatggtcttcaaacctttgttggtgaaaggtttgatactttggaattacaagtggacatgcgcttcaatgagatggagtcaagaatcaccaaggtcgaagaagatgtttcttatattcgttcaagctttggtctaccaccgccgccgccaccattatcttag

SEQ ID NO: 14738 - DNA, 198 bp, Glycine max
  Peptide Sequence Number=SeqID_106423
atggcttcgaagatacaaatattaccagtcgtaggcgtggtggccatgtatatcatgaattcaattattacattcttgtatttcaacggaagagtatatgaagacaatgatggtgtaatatttgaaggcagtaaaaaagcgattcagattaaacgcggaattagtttcaatgctttgaaaaaaaaaattggagataag

SEQ ID NO: 14739 - DNA, 375 bp, Glycine max
  Peptide Sequence Number=SeqID_106424
atgtctgttggatcccttatggggagcaccgagaggtccgggacttccacgtcagatcatgctattccggtctcttgcgctgggggcctgttgttgtttattaccgaccggaaagggtcgtgcgacagtttggctacacgtagaccattcctgctcctccagtcgattcatgggtctcgtgaggtgtgcgttgtgctaggggcatgttctagtgactacatggactggttcttccgcatctcccatcctttcatgacaccaagtcacgcattagatcatctgcctcatggtcacgccccacagccccgagtcgcccctcaggccccgcagacggatatccctcgtcgacatttgcggaggagcccaaacatgtag

SEQ ID NO: 14740 - DNA, 1055 bp, Glycine max
  Peptide Sequence Number=SeqID_106425
ccgttgaggtgtttcacgtttggggacttccaaatggtaccaactattgaagagtttgaggaaatattaggatgccctcttggggggagaaaaccgtatcttttctccggctttcttccttccttgagcaagattgcagctgtggttggagattcagcaaaaaagttggatcgcatgaagcaaactcggaatgacgtagtgggcctgcctcggaaatacttggaaggcaaggcaagggatatggcaagccaagagaagtggggcccgtttgcggatatattagctttgttgatttttggggttgtcctctttccgaacgttgatggtttagtatacttagccgccattgatgctttcctcgatatcaccatagcaaggaaagtccagtggtggctatcttggcagatttgtttgacacctttgactggagaaaaaggaagagtcgattgggaccaacatttggcggagatagggggcagcgcaatcaattggtttcctcgttggaagaaaggcaaggaaggagttcatttctcgtgtggggactaccctaatgttccattgatagggactagggggtgtattaattataatcccgcgctcgccataagacaactagggtaccccatgaggggagcgccaacggaagggagtctctcacctttccttgtgaaagatttaggcacgcaaggtctcaaggttatacaaagaatccacaaggcgtggaggagtccgttgaggaaagacaaggagcttaggggcatccgtaatggcgtcatcggaggttatcatggatggctaagaattcacacgcgagggttagattggctctccaagttgaaagttatcgatgaggagaactttgaagctccggaggaagatgaagaagtccgagctctaaaattggagctagggaaggcaagactcgccaaggagaagttcaaatcagctgctacacacatccggaaagagtgcactgagttacaagaggaaaacgcggccactgcaagagcccttgaacaagaaaccaaaagggatcgaagagaggaaagagatcg

SEQ ID NO: 14741 - DNA, 183 bp, Glycine max
  Peptide Sequence Number=SeqID_106426
atggcgactaagatgaaacaatgcctatttgaagccttgggttcgatagccccaatcatgtatgtgacccacatcgagaacggccacggtgctgacaacacattcaacggtacgggtggagcattaacattatccacaaaggacatccctactcaggaggaaactggctgccaacctctgtaa

SEQ ID NO: 14742 - DNA, 153 bp, Glycine max
  Peptide Sequence Number=SeqID_106427
atggctagacatgaatacattggtcggggtttggttgttcgggccgccgcctctaaggatgaaaagggtgcggataaccataagaggaaacctgggaatttcgacaaaaataggaatcactcaaagtgtatcaatctcgcacaggacttctga

SEQ ID NO: 14743 - DNA, 759 bp, Glycine max
  Peptide Sequence Number=SeqID_106428
atggtcattgaccaatcccttttccatgacttaacccaattgtccagtgacggtgtaccatttgaaggtacactgaatgacgattggaaatttgatttctctgcacatgatgcccgccagttggtttgcaccaaccacgcggatatgaccgtacgccttcttgtcggttcattggcttttgaaagccgcatccttcattatctaattgtgcatattttgcttccacgatcttccaaccttgcccaggtttttgaggaagatcttgttatcatgtgggcctttcataccgggcgtcaacttgactgggcacacttagtcagatatcgcatgcataaggcattgcgattaaatgctccattgccatatccacaccttgtcactctcttttttcgccattttcaaattcctcttgattctgaaccttacgttccaatcaagagatcctttttaattggtgctgctgtgattgcctattttggttaccgcaaagagcatgatggctcttgggtcaaaaagggtgctcaacccgctaatgatgaagacaacctaccagttgaagataattcctctcttcttcgaaagcttttggacaagttcgatggtcttcagacttttgttggtgacaagtttgatgccatggaattgcaagtcgacatgcagttcgatgccatggaatcaaggatcaccaaggttgaagaagatgtctccttcatccgtacttgctttgatccaccaccactgcctccatcatcctcttag

SEQ ID NO: 14744 - DNA, 770 bp, Glycine max
  Peptide Sequence Number=SeqID_106429
atggtgaaagttggaacctcttacgtgccgatcaacgtctcattttcgccaaaagttggccccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14745 - DNA, 349 bp, Glycine max
  Peptide Sequence Number=SeqID_106430
ttggacctcttacgtgccgatcaacgtctcatttcgcccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 14746 - DNA, 946 bp, Glycine max
  Peptide Sequence Number=SeqID_106431
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccaaacagctgcatctaaaggaaaagcaattgaaatggaggatatggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 14747 - DNA, 171 bp, Glycine max
  Peptide Sequence Number=SeqID_106432
atggccggagattggcccgaggcccaagcaggagaggcaccccagaagctcccggcgatggagaagaagcccacgaggatgaggagatggccgatttgcttgacttcttgggagggagtggagacacgtgactgggagatccccagattcatcgcatacatttttgcttag

SEQ ID NO: 14748 - DNA, 399 bp, Glycine max
  Peptide Sequence Number=SeqID_106433
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggcaagcgtcatcccgagacaaccgattttaaggaacaatgtgggggcactagaccacccacgttcactgcatgcaccgcatccgagagaacaatcaccacacgtgtgccacaggaagccgttatgatggacgactaa

SEQ ID NO: 14749 - DNA, 249 bp, Glycine max
  Peptide Sequence Number=SeqID_106434
atggtgtttttcctaagctacacgaaagcaaaggctgaaaatgctcaagtgagaaatggtcttggacacggaaacatcgcgcacactctagacatcttctcgaagatcccaatggtcagatcgtggacaagtgtcttggtgttacaacaatcatatttcatagcatataagatagtaaagcttgtaagacatggatttagaaaacaagccaaacttgagtggaatcatattgaaatgcaaaccacatag

SEQ ID NO: 14750 - DNA, 348 bp, Glycine max
  Peptide Sequence Number=SeqID_106435
atgcatatgacacagatgcaatttacgaatacgggagcccgagaaattgtttccttcttggatacaacgtttgggcagcatggcacccaacgtatgttttttaagaaggcgacacggaccctccgtcggtttgctaaaaagaatctaacaaggctgcttcaaatgataaacatttgcttcaagaataattcaagattgcttcaacaaacaaagcccttgtttcaagattcactaaagaccaagccttgccttaaaacaaagtgctttcaagacatgcaaggctctggtaatcgattaccaggaagtgtaatcgattaccagaagacagggttgagaaatagctgttga

SEQ ID NO: 14751 - DNA, 207 bp, Glycine max
  Peptide Sequence Number=SeqID_106436
atggtgaaagttggaacctcttacgtgccgatcaacgtctcattttcgccaaaagttggcccagggcttcccgtggctatctggtttctatcagctgttccctcctgttcagctactgacggggaattggttatccgctcaattcgcacacaagcactacgagccggaagcatcagcgctggcaagtgtaaagcctggggtgcctaa

SEQ ID NO: 14752 - DNA, 171 bp, Glycine max
  Peptide Sequence Number=SeqID_106437
atgactaaagcacgccaaaagggggtacggaaagggaaaagagggaggtggttgccgcccagctcgcccaggcgagctgggttgcttccaccagcaggcaccaccttctgttggaagatcctggaaggcccaagtgggcctaattgctatttgcacacccttgtttactaa

SEQ ID NO: 14753 - DNA, 312 bp, Glycine max
  Peptide Sequence Number=SeqID_106438
atgcgtagtgattgcttagtgcaattctccattctcaatcttttcaggagccccatgaattgcgttttcgttcaggtgtcccccaccttcgagtttggagccatgcgtagtgattgcttagggcaattctccattctcaatcttttcggagccccaggaattgcattttcgttcaggtgtcccccaccttcgagtttggagctatgcgtagtgattgctttgtgcaattctccattctcattcttttcggaaccccatgaattgcgttttcgttcaagtgtccccccacttcgagtttggagctatgcgtaa

SEQ ID NO: 14754 - DNA, 294 bp, Glycine max
  Peptide Sequence Number=SeqID_106439
atgattattgaagaatctattcatgttgttttttatgagactaaccctataaggccaagaaagaaaacacttgatgatattacaaattctttagaagacatgcacattcataaggaagggcacaaagacaaaggagatgaaaatgatgaagactctcaaattgatgaaactaaaacaaatacagatctttcaagagagtggagaacttcaagatatcatcatcttgataatatcatcggtgacatctcaaaagggataacaactcgtcactctctcaaagatgcatgggaataa

SEQ ID NO: 14755 - DNA, 150 bp, Glycine max
  Peptide Sequence Number=SeqID_106440
atgaccatgattacgccaagctcgaaattaaccctcactaaagggaacaaaagctggttaaagacccaagtggagaaggacgaaggcttaagtggagaaggacaaagccttcgagtggagaaagatgaaggtccaagtggaaaaggatga

SEQ ID NO: 14756 - DNA, 219 bp, Glycine max
  Peptide Sequence Number=SeqID_106441
atggcagcggaatggagaaggaagagagagaggagacgccacttcaaggagaagatgagtctagaagaagctcaccaccataagaggccatggataatagcttggaggaagaaggagatgaatgaagggagagggagagaagagcacgaaattttcccactaatccaagatcaattccaagattctccactaagtgtgcttaggtgtcatgaggcatga

SEQ ID NO: 14757 - DNA, 180 bp, Glycine max
  Peptide Sequence Number=SeqID_106442
atggtgaaagttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatccgctctccctcctgttcagctactga

SEQ ID NO: 14758 - DNA, 1085 bp, Glycine max
  Peptide Sequence Number=SeqID_106443
atgaaaaccatcacccgcacgctggccggaaatgcagcaggagacaggcgctgcgttctccatgccaacgctgggctgacaggaggcgttatgcaaaccgaacgtatgactatggcccaggcgctggtccggttccttaatcaacaatacgtcagcgtggatggcgacgaaatgcccttcgtggagggcgtggcgactattttcgggcacggtaacgtgctcggcatcggccaggcgctggaacaagatccgggccatttgcaggtgatgcagggctgcaacgagcagggcattgcccatatggcgacgggattcgccaaacagcaccgccgtcagcgcattttcgccgtcacctcctccgtcgggccgggcgccgccaatatggtgaccgcggcggcaaccgctacggcgaaccgcattccgctgctattgctgccgggcgatatctacgccagccgccagccggacccggtgctgcagcagatcgagcagtatcacgatctcagcatcagcaccaacgactgcttccgtcctgtctctcgctactgggaccgtatcaaccgtcccgagcagctgatgagcgccatgctaagcgcgatgcgaacgcttactgaccccgccaataccggggcggtgaccctctgcctgccgcaggacgtgcagggggaagcctgggattatcccctgagcttcttcgcgcgccgcgtgcaccacatcgaacgtcgtccgcctgacccgcagcgtctggcgcaggcgcgggcgctgatcgcccgcaagcgtcgtccgctggtggtgtgcggcggcggcgtgcgctattccggcgcgcatgaggcgtttcgcgaatttgtcgagacgctgcagctgccgtttgccgaaacccaggccgggaagggggcgctggtaagtgaccacccacttaacctgggtggcgttggggtgacggggggactggcggccaaccagctcgcgccccaggcggatttagtgattggcatcgggcacgcgtcttacgggactttaccaccgggctccaaggcgctcttttcccatccggacgtcgaatttctgctgctgaacgtggcgga

SEQ ID NO: 14759 - DNA, 876 bp, Glycine max
  Peptide Sequence Number=SeqID_106444
cttctagagaggaatgttgagatttatcatactgagtttgacgagtttaaagcagagttggagaggcgtaactttcacaaactcctcgccaaccttcaagaagggagcatagatgtggcggtggttaaagaattttatgccaatttgtatattctagaagaccaagctcccaaatatgccagagtaagaggccatttaatcaagatagatgcagacagcctgaatgagtctcttcagactccagttttattagaggagggggaatctttacccgcttattctagattttgcatattaaggtctgatcctagagagatggaggctagcctatgcattccaggcaggggttttattctgaacactaagggacaaccatggaagctcttcagaaaagatcttacaacccttgcccagacatggagtgtcttctcttactctaacctagctcctacctcccacacctcagatttgaacacagacagagctaggttggtctatggcttaatcacaaggatggacatgaacattggctgtttgatctctggacagataaccatggtggctcagcccaactcttctcgcctaggcttcctagctttaatcacagccttgtgggcaaggaagaccaaactcagagcagttgatgttccctcttcctttacaccaatagctggcatcccttcatcttctactccagctccacctccagcattagcagacccattttcccaaagcttccagacttcaaatgctaggttgcatagcttgtttgaaggaccgattctcattatacgtagcttgcaagaattggcccaacaaaggccaatcatgagtgtagagcaattcattgagaaggtggcctggcctagagcttaa

SEQ ID NO: 14760 - DNA, 162 bp, Glycine max
  Peptide Sequence Number=SeqID_106445
atgtcacgaaaccttacggattacgcaattgtcccctctttggcttttggaatgttacagaactttacggattgcgcattaacgcttcctttcgactcccgacatgtcgcagaacttcacggattgcctaacgatgggagaattataagcaatttggcttga

SEQ ID NO: 14761 - DNA, 315 bp, Glycine max
  Peptide Sequence Number=SeqID_106446
atgtcagctcggtggctccacaaaagaatctcaattctcgtactctactgctatcattatgctcccacaaacaaaggttcacgatcatcacaagtaccaaccacacggtacaaaaattgtgaggggaaaactcggcagcaagtgtcaaggtcaccctgtgctgcacaggcaactccccctcagggtgatcagcctgagtctcaagggagttccaaactgagtgacaaggccccaagtacaagcattcctcctcatgagaaactacaagtacttactgacaaagtttatactatttccatatcatatgaagtatga

SEQ ID NO: 14762 - DNA, 513 bp, Glycine max
  Peptide Sequence Number=SeqID_106447
atggacaaagcgaggttcgtttatggactcgtcacgaggatggaaatggatgtgggctcgttcatctctagacagatatcacagatggcccagtccaactcctcccagctcggcttccctacccttatcactgctagaggatttgtgcctgactcgttgaccttcaagtcccttagccctgccattaatatggcttatatcagaaagaactgctgcaacccggatgatcccacgatcacatatctggggacccgacacttctgctccttcctcctttgctctccctgctccagctccaccagcaccaccagctcccgtaccagcaccctccgacacctccgctcagagcacatagatcttacggccgatactgcagagccatcaccatggcttatgcctggtgatgcagagcattcacgatttggctcagcatcaaaccattgtgaacatggaggatttcatggcacatgtggcctggccaggagtccagccttctcctgtgggggaaggtga

SEQ ID NO: 14763 - DNA, 426 bp, Glycine max
  Peptide Sequence Number=SeqID_106448
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatgctcaatgtttcaactcaccccacactcatctctttgcttctttgtatccccccagag

SEQ ID NO: 14764 - DNA, 111 bp, Glycine max
  Peptide Sequence Number=SeqID_106449
atgatggatacctcagagccctacactggggcaatgaaaggcaccatgcgtgagcctcaggcgaacctaggggcagggggagtgacaaaccctgggattttagtggattga

SEQ ID NO: 14765 - DNA, 896 bp, Glycine max
  Peptide Sequence Number=SeqID_106450
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacagggagaggggataataactgtacagacagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14766 - DNA, 248 bp, Glycine max
  Peptide Sequence Number=SeqID_106451
atggtagcccgggtgatgttggggaatggttatgatcccggaatgggtttaggcaagaacaacggcggcagaaccagcctgatatgcaccagaggaaactgtgggaagtttggcggaagccaaggctcacaattgggacgaaaagtcaaagggggcccgccctgccacatcaataggagctttataagcgcgggtctaggacacgtaggccaagttgttgtgatatgcgaagatgactctctgagtgg

SEQ ID NO: 14767 - DNA, 830 bp, Glycine max
  Peptide Sequence Number=SeqID_106452
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggaatatacaactcgccatttaccaaaaagtcacagggatggaattcgatcaatggtaaatgggttgttggcgacggagtacaatacagtcctgcaatagagactgagatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14768 - DNA, 180 bp, Glycine max
  Peptide Sequence Number=SeqID_106453
atgggtcaacttcaacggcaagccttcgcaaagcctatgggttctacccctcattggccagaatttctaaaaagtccaaatctcggcgcaggaattagaccgccaaaggcaagtcgaaaatggggtggtcggaatatcgagaaaatatttggaggtaaaagcaagaatcttggcagataa

SEQ ID NO: 14769 - DNA, 615 bp, Glycine max
  Peptide Sequence Number=SeqID_106454
atggggacaaatcaaatcggaaaaagattctatcaagtcaagattaagggcctagatgtcaccagccttaaggagttgggacgattgatgggacccctccaaaggcaagccttccgcaaactgtacgaaaagattttagatttgaccacagcggaggtatttacggaagccgttgtatccctcgcccaatactatgaccagccgttgagatgcttcacgtttggggacttccaaatagtaccgactgttgaagaatttgaggagattctaggatgccctcttgggggaagaaaaccgtatcttttctctgggtttcttccctccttgagcaagattgcagctgtggtcggagattcggcgagagagttggatcgtatgaagaaaactcgaaacggcgtaatgggcctacctcggaaatacttggaaggcaaggcaagggatatggcgaatcaagaggagtgcgtcccgtgtgcagatatactagctttgctaatctttagggttgtcctctttccaaacatggacggtttggtggacctagctgcaattgatgctttccttgcatatcaccatagcaaggagagctcagtgcaaggagaacagcgcacagattga

SEQ ID NO: 14770 - DNA, 481 bp, Glycine max
  Peptide Sequence Number=SeqID_106455
atgactaggggcaatctaggtgatttacaaccctttgatcctgaaatagatagaacctttcatagattagttaggcatagtatgcatcctggtcattctatgcattttgggcattttgagctttttgagcattctgcgtattctgttgctggtgattctgaacattctgattttgagcattcgactactaattttcatactgagaacatggctcaacctccacctcatgagaggactcttagggagatggctgcacctgatttcacttatgaaagcttttgcattcaatatcttgatgaggatgttccatatgttctcaagactggactaatacatttgctacccaagtttcatggtcttgcaagtgaagatcctcataagcatcttaaggagttccatattgtctgttccaccatgaaaccccctgatgtcccacgacgatcatatctttctaaaagcttttcctcattcactagacgga

SEQ ID NO: 14771 - DNA, 486 bp, Glycine max
  Peptide Sequence Number=SeqID_106456
atggcagcccgccataggctggctgagtgtatgactagaggcaatccatctgacttacaaccctttgatcctgagttagataggacatttcatagattagttaggcatcattttataccttttgagcatcctaagcattatgttactagtgagtctatgcattctgttattggtgattttgaacatcctgattttgagcattataattttgaacattctgattttgaacattctgagaacatggcacaacctccaccccgtgagaggactctaagggaaatggctgcacctgatttcacctacgaaagcttgtgcatccaataccctgatgaggatgtcccatatgttcttaaaactggactgatccatttgcttccaaagtttcatggccttgcaagtgaagacccacacaaacatctgaaagaattccatattgtctgctccaccttgaaacccccagatgtccaggaggatcacatattctaa

SEQ ID NO: 14772 - DNA, 225 bp, Glycine max
  Peptide Sequence Number=SeqID_106457
atggcagaggtctccacggaggccatcgcccaatattatgaccagcctttaagtcaaaatctcgacacaggaattagaccgcagaaagcaagtcgaaaatggggtggctggggtaccaaggaaatgtttggaagcaaaggcgagagtcttggcgagtcaaggcagcaattaatgcttgttttgccttttacgaccgcaaggaaagcccggttgtcgctatcttag

SEQ ID NO: 14773 - DNA, 201 bp, Glycine max
  Peptide Sequence Number=SeqID_106458
atgtaccctctacttgtaccacaaaggatgtaccctccaatgtgttgggacaagaattctcaggcggttagtcttttgaatctttgtaaaggggaaacaaaagatatctcaggcgggagaagagagacacaaaagaattcaggaggtgcaaaggcagatgaaggccgacatggaggagaagagaatgaaaaagatgaatag

SEQ ID NO: 14774 - DNA, 102 bp, Glycine max
  Peptide Sequence Number=SeqID_106459
atggtcaggatcactccgttttgcgagaatgctccaaccatatgggatcaacataggcttaaagaagcactcaaatcgagtgtctttacccccaaggcctag

SEQ ID NO: 14775 - DNA, 699 bp, Glycine max
  Peptide Sequence Number=SeqID_106460
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgactgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggttcagtgaagtgcttcatgtggcaggagaaaaaaggctgcaccggtgcgtcagcagaatatgtgatacaggatatattccgcttcctcgctcactga

SEQ ID NO: 14776 - DNA, 435 bp, Glycine max
  Peptide Sequence Number=SeqID_106461
atgaccatgattacgccaagctcgaaattaaccctcactaaagggaacaaaagctggctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14777 - DNA, 354 bp, Glycine max
  Peptide Sequence Number=SeqID_106462
atgagtcttcattcttcatctagtgttaatggtgagggttctactcctaaggaccccttgtataagatattagatgagttgagatcccttaagttgtggaaagaaaaacaagagagaaaagaaaaaggtaaaaaaagagtggaagaaataagtcaagatgaaaaagagaaaataagagagaaagaaagaagaaaaataatgaaagaaatgaaaagagaaaaacatgcctcctttagtagtcatgactcttgcaagagtttaagtgaagaacttagcgactattacagagggcgtcatagctcacatactaaacatcactcccatagaagagaagaggataacaggcctccagag

SEQ ID NO: 14778 - DNA, 330 bp, Glycine max
  Peptide Sequence Number=SeqID_106463
atgaagagaatcaaaatcaaacatataatcatcaacaatatgatcaagtatctcagcatgaaaaacagaatgatcctcggatggatgtttcatggcatcaagaatgttaaaatgaacaacaatatcgccaaattccatagacaatatgccaaaataaacatctatcttggttcaggttgcaaaggtccaagagataaagaattgaaaatggacagaggcatgacactaactgatgctcctagatctagcatggcattctcaaatttgttgttcctaataatgcaaggtatacagaaagtacctgggtccttacatttctcaagaatgtga

SEQ ID NO: 14779 - DNA, 728 bp, Glycine max
  Peptide Sequence Number=SeqID_106464
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggctcagacttgaaagggcatttagtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14780 - DNA, 285 bp, Glycine max
  Peptide Sequence Number=SeqID_106465
atgaccattggaagcattgggttcgatggcccctatgacgtctatcccccacatggaaaaaggccaaggggcggacatgacattcagaggatgtggcggggcattgacattgtccatgaacgcttgacatttatggcatttccttacatgggtgcagcaatcactttccacgaagccattctcttatcctgggttatggagaattcgtccctaacagtcaaccacttaatccaaccctatttcaatttactaagcgaaaatcaacttagggttttcaatacgtga

SEQ ID NO: 14781 - DNA, 468 bp, Glycine max
  Peptide Sequence Number=SeqID_106466
atgggtctaggcaaggactgcctcgggaaggccgacgtggtcgatatcaagggaaatccatacaagtatggattagggtacgaacccgggatgccggggaggaggaacgtgccatcaagatttcgggcggatagggtatggcccggccgtattagccagtgtttcaccagcgctggaatggtgtccgaggaggaggtggccgtaatagaagaggagttccctcaagacccaccatgttttgtgcaaccatgccaccccgattcccaagtggggaactggcacgtgataagccagtcagaagtctataccgctgattcgatatgtgagggtcgattctttgaagaacctaacaacgagggtttgacaatcgatttcgatcgagatataagccaaacggtaaaacggggaagaggaagaggacgtcctgtcaccagagttggagaggttggtcgctcaggaagaacgtga

SEQ ID NO: 14782 - DNA, 435 bp, Glycine max
  Peptide Sequence Number=SeqID_106467
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaacttggttgcatcttccaatgcaattagcattcactatatgatgtgtcctcaatga

SEQ ID NO: 14783 - DNA, 472 bp, Glycine max
  Peptide Sequence Number=SeqID_106468
atgagtgatggattttgcggtactcatttgcaaatcatggttaggactagaggattaggtagtgccttaggtcacgttactgccagaggtgtgggccgaggagatcatgatgattctgatgatgctccgcagcgtcgaaggcctaccgcatccgcacagaggcagcgagtcgctgtgactgcggcacacgatgagccagtcatccctacgccagatgttcaggatgacccgatggaggcaccagctgctctagaggacattcttgcggacacaggtgcagaagcttctgaggataagcatgagggattttcgggtggtccgagcgacccatccgtgttgaccctgtatgcggatcacgttgcttgcagcgtatggacgggggaggagtgtcctgaattgaagctatcctctcatgggaggaaggtccacagtttaggcaggcctgtccctgccattgagggacttgttgctg

SEQ ID NO: 14784 - DNA, 387 bp, Glycine max
  Peptide Sequence Number=SeqID_106469
atgaaaaatggaattgaactagataacagatttgttgtaccatacaatccacaactcttattgaaatataaaacacacctaaatgtggaatggtgtaatcaaagtacatccatcaaatatttgttcaaatacatcaacaaaggttctgaccgtatcatagccactcttctaaatcatcacacctcgaatggtgaccactctcaggttcaagatgaaactaaacaatatcttgattgcaggtatgtatcttcccctgaagcatgttggaaaattttcgcattcccgatgcacagacgttccccagcagtggagcggctatatttccatcttgaaaatcaacagcatgtttactggacagatgatcaacaaattggtgaagtcctataa

SEQ ID NO: 14785 - DNA, 222 bp, Glycine max
  Peptide Sequence Number=SeqID_106470
atgagtctgatggtagaaacgagacttttttgcggtctcggccggaagacgctgacatctccgggaaaggtgcagatgacgaagttagtcactgcgagctaccagacccttgagtctgacggtagaaacaagactttttcgcggtctcagccagaagacgctgacatctccgggaaaggtgcagatgatgaagttagtcattgcgagctaccggacccttga

SEQ ID NO: 14786 - DNA, 324 bp, Glycine max
  Peptide Sequence Number=SeqID_106471
atgttaagtggtggggtcggctggtggcaaactacatgccgaagcaggctgccaaggtataaacgagtccacaagttggggggtaagcgagtgaacgaatggagagcatgtcccttcagcgacgacgggaatactctacagaagattgcatcatctgtggtgtacaagcttacctggtttgaaggaagagtcgcttccatgatgtcgggcataaaagggttcttgaattgtagcaactgtctccccaaaatgtgcattttcacgtcgaagggcgatgacttcttcggcgtgatgacgatgcatgtccaagacctaagcttgtag

SEQ ID NO: 14787 - DNA, 90 bp, Glycine max
  Peptide Sequence Number=SeqID_106472
atggccttcctgttggagctagagggaaggttggttatgggatttagaaaggcttcaagtgtcatgccatctgatcaggtatatcattag

SEQ ID NO: 14788 - DNA, 951 bp, Glycine max
  Peptide Sequence Number=SeqID_106473
atgatgatatccactgccaaaggtgcacagtcttacagtgacattagaacagtcaatggtgtggtatatggtacatttaaggaaacatgttttgcaaaaggctttctaggtagtgatcaagaatttattagtgctttacaagaagctaataattggggtactgcacactacctaagaaaattatttgtcaaaattttatttatgaacaccatggacagaccagaatatgtttggcaacagacatggcaatggatggcagatgatatcacattcgatcatagaaaacaagatgagcaaaaaactattgtcgataccattatccgtatagttaacactcaatcagctgtagtttacttcctctatggatatggtggaactggcaaaacatttgtttggacaaccttatcatctgctatacgctccaatggtagaattgtttgtacagttgcttcaagtggaattgcttcattactattgcctggtggtcggacagcgcattccaaatttgctataccagtccctgcaacacaaaattcgacatgcaatattcatcaaggcagtgagttagctgaattattaaaggttacaaaactaatagtctgggatgaagctccaatgtgtcacagatttgcatttgaggcactagataaaagccttaaagacatcatgccgaacaatctgccttttggaggaaaaattgtagtttttggtggagatttccgacagatcttgcctattgttccaaaaggtaatcgctcagacattgttcatgcaactataaatgcatcatacatttgggaccatttccaaattcttaaactcacaaaaaacatgagattgttatcaagtgctcccgaacagcccgacaatcaagagctcaaacaattttcagaatggctacttgacataggagatggaaaaattggacaagataatgacggattttcataa

SEQ ID NO: 14789 - DNA, 285 bp, Glycine max
  Peptide Sequence Number=SeqID_106474
atggagattaagaaggagacatatttattttggattgattcaaggagttttgatgataacaaaaatgatgacaaaaatctcaaaagtcaagatcacttcatgataacaaagatgatgacattcaagaatgagttcaagattgagtcaagaacacttcaaagatcaagaggaaatttgatttcaagaatcaagaatcaagattcaagattcaagaataatcaagatcaagattcaagactcaaagattcaaaaatcaagagaagacttaatcaagataagtattaa

SEQ ID NO: 14790 - DNA, 681 bp, Glycine max
  Peptide Sequence Number=SeqID_106475
atggcagcggtgcgcctgcagctggctgctgctggccttcctcctgctgctgggcatgcaatatttctctatgaaggctttgctaatgggaggccggataagcttggtgggagtgaccaacactttatagaattggcacaagatcatgatcaaagtaggaaaccccagtgccctgttggacttcttcaagtccattgggtgtctaggcgaccaactgacacttcggcagtgggaggtctaaattatggtcgttggggagaatgcttggctcctcctttggctaaactcacaatgctggccttcctccaagaccaatggatgccccagaaactggttgatggcatcctcatcgaaggggatccattagcccctcgcccaggagtgtttgtctctaacttcctcctatgtaggccatgcgctggcataaaactccatgactatcttgggatcgtatttagccatgggttgatggaagcttgcttgtggggcttctatggaggctggatctttgagcttcaatggggtcttttaatggtgattttccaccatggagatgcagcggaagacaaagaaaaagagcttggagaggatgcttcaatggaggaaaagaaagagggagagaaagagagaggggggagcacgaaattgaaggaagaaaaagggagagaagttgaactttga

SEQ ID NO: 14791 - DNA, 441 bp, Glycine max
  Peptide Sequence Number=SeqID_106476
atggagtgtggtgcaaataaaaggataaggagcttaggggaagcagtaatggggtcatcggctgaaacccctgaggagagcgaagaggtgcaagccttaaaggtggaacttgaaagagcgcaagcggtcaaggaaaagttcaagacgatggccatcaaggtccataaagagtgcgatgagctgagggacatcaacattgccacgaccgaagcattggaatgggaaacgaagagggcccgaaaagaagaatggggccaaaacaagacgaaagagaacatgtgggctatcattgaccaatacaaagagaagctaaatctagctgcgacccatgaacaaagactagaggacgagttcgctttcaccttgaatggaagccaagagcttccaagactgttagccaaagccaaggcaatggcggacgtgtactcggctcccgaggaa

SEQ ID NO: 14792 - DNA, 549 bp, Glycine max
  Peptide Sequence Number=SeqID_106477
atgattagccctcttatcaaattgccatggtctccccaagaatttggcagactgaggatagatcctcaagagatagtggcttgcctctgtattccaggcaggggatttgttctaaatgctgaaggaatgtcgtggaggttgcaaaggagagacctcaccaccttagcacagacttggagtgtgctatcatattctaacctggcccctacatcacatacatttgacctgaacttggacagggcacgattagtttatggctctctgcaagaattttcaaaacttagctcagcatcagccactcatatccttggaggagttcactctgtcggtggcctggtggcctggctaggagcccagccttctcctattggagggggtgaggactccacagcccaggagcctcggccacatcaagatgagtcttcctcatcttcagagtcagagaccgtaccaccagagccattcatctatgaggcaaatccaggcaccacactagaggagactcaggaggctactacaccagagattaccccacaacaagcagcataa

SEQ ID NO: 14793 - DNA, 225 bp, Glycine max
  Peptide Sequence Number=SeqID_106478
atgcagagtgggtcccccagttgggctaacctcagtagctgggctaagcgcatatccaccgctaagcatagcttcagcgtgcttagcgcaaaggagaatctgacagagcatcagcatcaaaggccgcgtgctaagcgcgagatcagtgcgctaagcatagcaagtgccttcagccaggctaagctcgagactggcgctaagcccaatttcacttactcgcgctaa

SEQ ID NO: 14794 - DNA, 558 bp, Glycine max
  Peptide Sequence Number=SeqID_106479
atggcaagtgaaactgagcaagaggctccataccaagataatgagcttgtagggcttcaacaagtgttagaagttgaccttgtcgtcattaatgaatctcttgtagatattgatggaggtggagaagagatagatgtagatttacttaaacaactagacttggttgaaccagacgaggatgaatgcatattaatgaatatgaaagagaatataagtgacctattttggtgtagaaaacatgtttatatggcagacagaggtagatgtggtggtcgcaaaacattcaatcgtggtagaagatgtggtgttagtttaggagttctaattaccaccaacccttccacctcttccattcacatatcaacctcagagttgatgattcatgtcattgcgccgacaccaaacacacttcctacaactcaagaccaaccaaatccaacctttgtaagggagttaattcccactaccgccattggagatgtttcacctttagcactagatgattctcttacacctgagtatccacctgatccaaattgtgaacatattgttgattag

SEQ ID NO: 14795 - DNA, 261 bp, Glycine max
  Peptide Sequence Number=SeqID_106480
atggcttctccaccagcctcgcctcctcctcctcctccttctcctcctccttccgacacatcagcttcgccgtctaccgtgaaacggacacgcaaagcctcacgtctacgatccttgtctactagaccacctggtgctgagagaccagtggtccatgttgatcctgctactggcaacggtccccacaggaagaaattaagaacatatttggggattgtggcgcgtgataaggtggacgtcacgtacgagaactggaaggag

SEQ ID NO: 14796 - DNA, 135 bp, Glycine max
  Peptide Sequence Number=SeqID_106481
atggttgtttatgcaatcctcccaaggaggggacctatcaccagagccatggctaggagactccaggaagattgggttagggatgcaggagaagatcctatggttctcatgagacttagggggttcatagtgtag

SEQ ID NO: 14797 - DNA, 534 bp, Glycine max
  Peptide Sequence Number=SeqID_106482
atggcaaaacttcattactgttgttcaagacatacagtcctcttgaacccttaccacccactttgtcatcatgctgagactcaggaaggccaacagatgcacaatcaagtgaatcatgatgtcaaagaaagcagggggaaaatacatctccaactggcacagtataattgcggcctcattttgcagctcatcaaacttgacaagatcaacgattttgctacatatggcatggaagaaaaagtacagatttacttttcagaatatccatatggtgctaatggagttgtgattgaaattggatgctggattgatcatacaggtgtgtgtgtgtgtgtgtgtgaagagcacaaggtggatttcaaggataacaggtcagtagacccagagaaatacactttcagcctaacaggaaggaagcctattagtttggaagagaaaaggaagcttggtgaaaggtatattccactgctgcaaacctctataccagagaaaaaggagacacttacatcacattttcgtgttagagtaggatga

SEQ ID NO: 14798 - DNA, 291 bp, Glycine max
  Peptide Sequence Number=SeqID_106483
atggctatagcggatcatgttcgcatccaacatggcagtgacttgcctctcgagttcatttttcaaggaaaaaggttactgatgggtgggttcctagaaaatacctgtgtatcgctgaagaagacgatccagtgcagggtgggtgtgaatagtgggagtgggtgtgatgttggtagagggggggtggggttagtaccgcgggccgaagctgggctaggatgtatgggtacatctgcacatagcgtaatgggttggttctcgtatgtgaagctcatcgtcaacgatgaatag

SEQ ID NO: 14799 - DNA, 519 bp, Glycine max
  Peptide Sequence Number=SeqID_106484
atggctccgagaaagcttcctgcaaagagatccaggaaggacaaagcggctgaagggaccagagccactcctgagtatgacagccatcgcttccggagtgctgagcaccagcagcgtttcgaggccatcaaaggatggtcattccacagagagagacgcgtccagcttagggacgatgagtatactgacttccaggaagagatagctcgccagcggtggacatcgctggttacccccatggccaagttcgacccagacatagtcctggaattttatgccaatgcttggcctacacaggagggcatgcgggatatgcgatcttgggggaggggtcagtggattcctttcgatgcggatgccctcagccagttcctgggataccctttagtgctggaggagggccaggagtgcgagtatggccagaggaggaaccgggccgatgggtttgatgaggaggccatcgcccagttgctgtgcatactgggacaggattttgcccagaccgctgccgggagacga

SEQ ID NO: 14800 - DNA, 453 bp, Glycine max
  Peptide Sequence Number=SeqID_106485
atgcctttggaaggaactttaattgatgattggaaaccaatttattctagtcttgatgctcgtaaaatgcacttcaaaatctctcttactaatgaaccatctgtcaaggttaagcgtttatttacaataggagccgctacagtcgattcttttagttataagaaagatcttgatggacaatgggttcgcaaacaggattaccaagcaaaagctcccgacgaatgcactccatctccaccacatagggatccctcttctgctttactaaatgatgttctcaacgagattcgtgccacttgttcaacaactttcgctaagcccaaaaatgtctctagaagaaatcaattgttgattgggcttagcgacatcaacacgctgagcgcacaaagcctggccgctgagcatgatcagagcactgagctacaccgcacccctacaacttccaccacttaa

SEQ ID NO: 14801 - DNA, 750 bp, Glycine max
  Peptide Sequence Number=SeqID_106486
atgagaggaggtatttgtagcatacaacttcagcctcttacacctgaagctacaactgttgtcaagcaagctgtgaatcttgcaacaacaagaggccatgcgcaagtcacacctcttcatgttgcaagtgccaggcttgcaacttccacaggccttctttgtaaggcttgtcgtcagtgtcactctcatcctcttcagtgcaacgctcttgagctttgtttcaacattgcactcaaccgtttaccagcttccacttcaagccctgttctggctcctcaatattccaccccttcactctccaatgccttggttgcaaccttcaaacgtgctcagggtaaccaacaccgtggttttattgagaaccagcagcagcatattcttgccttgaagatcaaggtggagcagctcgtgatttcaatccttgatgaccctagtgttagtagggtcatgagagaagctggtttctctagcagccttgtgaaaacaagggttgaacaacctgtttcaatggaagtttgttcacaaaaggcttcttctaataggagccatgccaaagaaaatataagctgccccatcattgtgatgagtgagttggtgaggagaaaaaacacaattattgtaggggagggtgtggccaatgctgagggattagctagagaggtgatggagaggtttgaggaaaattttggaagttacatggaagttactaaaacttccatcaacggttggaagttacatggaagttactaa

SEQ ID NO: 14802 - DNA, 195 bp, Glycine max
  Peptide Sequence Number=SeqID_106487
atgacctttttatggaagtcattgaagaaaactacattgctagaaaaaagccgttcaatgtcgatccttctcggcgttcaacgacggtgcacggccgtctttgaatgcgacgtcgtcgtagaccttcggccaatctacgatggtctccaaacaccgttttataaagacgcgattcctgcgatggggatgacttga

SEQ ID NO: 14803 - DNA, 366 bp, Glycine max
  Peptide Sequence Number=SeqID_106488
atgacttctcgcaagcgtcgtgtcgtgcccacaccaggggaagcgtccaactgggactcttcccgctttacttcagagattgcttggcataggtaccaagacaacattcagcttcagaacatccttccagagaggaatgttgaacttgggcctgggatgtttgacaagttcctccaggaactcaggcggcacagatgggaccaggtgttgactcacctaccagagaagaggatcgacgtggctctggtgaaagagttctattcgaacctttatgatccagaggaccacagtcccagattctacagggtgcgaggacaggacgttcgctttgacgctgacaccattaacgactttgtcgacacccca

SEQ ID NO: 14804 - DNA, 633 bp, Glycine max
  Peptide Sequence Number=SeqID_106489
atgtggctgccttttatgagaaagcttgtgacattttcaattctgcatatatccttcttgctctctccaaatgggtcgatgccaagcctgaaaaacctaattgagaatgaatatggggcacagagtaagttgcaaggagctgctggtcaaaactatgtgaattgggctgcaaaaatggctgtggaaatgggaactggggtctcttgggtgatgtgcaaggaagacgatgccccagatctagtgattttactcaaatcagtcctcatattcaacccggggatggacttcttgtacagtagtgtttattctcaagaacagccatttgtgactaattttattctcaagattgaagatagcatagcatggtttaatgttccaatgctttctgataattatgtgtggctatatgtgaattttccaaaagaaaaacctggccctgaaggtgttcgaggtcgtaagtcagacaatacactaataaaagaaaaacttggttgggctccaactatgaggttgaaggatgggttgagaatcacatacttctggattaaggagcagatcgagaaggagaaggctcaaggtattgatatatttgttttgttaaggtggttttttaaggcacttcgtggtgcttaa

SEQ ID NO: 14805 - DNA, 672 bp, Glycine max
  Peptide Sequence Number=SeqID_106490
atggctcacaaatttttctttcaagcacttgatcaaagtttaacagacattattaaagaaaaaaaaaatccgaatcaaatttttggaggcaaagttattgtatttggtggagatttccgacaaattctgccagtcattccaagaggaagttgttcagacattataaatgcaacaatcaactcatcatatctctggccttcctgtgaagtcttaacactcaccaagaacatgcgtttacaaggcaatgcccaatcaattgatgatcaagaaactactaaatttgcaaagtggattctagatattggagatgaagttattgggaatcaaaatgatggatatgctaccgttgaaattcttgattacctactgattactgaatataatgaccccattgatgctatagtcaaatcaacattcccagatttatatcaacaccataataatcctcaattcttcaaaagtagagcaatattagcttccaccaatgaaacagttgaagagcgctgtaatagtggtgattatggagctattgataatgatggtggtgggagtaatgtcaatagtgatgataaaagtcactatgtgacgatgacaataacattggtgacaacaaatagtatcaatgacaatagtaatgatggtgatggagataacgggcgactatggatgtag

SEQ ID NO: 14806 - DNA, 279 bp, Glycine max
  Peptide Sequence Number=SeqID_106491
atggacatgcatggtcagatgctgaggtctattcacgtcggacagcagctcatcatgcagaacatgcacaggctgtccttacacttgcagatggaccccccgctcatcactccagaggcttatcgtcagcaggttgcctggccaggagaccagccctccactgacaggggggaagagccttctggagccgctgaggatcctgcggtcgatgaagacctcattgctgacttagccagtgctgactggggcccatgggcagacctgggcggaggcagttga

SEQ ID NO: 14807 - DNA, 264 bp, Glycine max
  Peptide Sequence Number=SeqID_106492
atggataaatggatctgtcgcaacatgcccttttgcgggcgagcgaaggcgaggctcacgggtgcactttccaaaggaggaaagatgcgtggagtcaccaccaacgtcgacaaaagcggagctcttgctcctacgtaccctccatcgaagaggaaatcagacctacgtagttctttcttaagggtgaatcacatgatttctttttacttgaaaggtgatcatttaaaggtgttggaccttaaaaatgatccattaacttggtaa

SEQ ID NO: 14808 - DNA, 195 bp, Glycine max
  Peptide Sequence Number=SeqID_106493
atgaggacgcgtagccctctaaaggcgagggcgtgcagccctctgcaagcgaggacatatagtcctctaaaggtgataggtactagtacccaagggtccacctttatgagaaagcaagagatcgactcatcgagagggcagcttttcatgggacaaatgaaaaaatataccaaaaaggcaatggaaacgttttga

SEQ ID NO: 14809 - DNA, 249 bp, Glycine max
  Peptide Sequence Number=SeqID_106494
atgggcggtgatcgaaagcaaaacggcattgacattggcttaaggttgggtcagcaaagggtggtaagaagtcaacgtcagaagttttggattagaagggaggaagggaagaatctacttaaacaaaatgtgtattttgcagacgagaaaaaatgtggtggcggactggcggcacaaatggaaagtggagacagaaaagatctgagtggtggggcttcgttttggtttttggtaggaagtgggatctag

SEQ ID NO: 14810 - DNA, 285 bp, Glycine max
  Peptide Sequence Number=SeqID_106495
atgtggagtaaaggcccaagaattaatgaagcattgggcttgaatccagaattgggcttggacttgaagaggactttattattgtgttgcctgttcattttgcatttatgggtttcttaccgccgtgaagttttctgccaatttcaaaaatcattcgtggagcattcttacaaggggaggaagaagaggagaggcatctctgctaatggtgattccaggcactggcagtgcacgatggctgactattggagagagaaaatcaaaggtaaatcgggtaggagttaa

SEQ ID NO: 14811 - DNA, 334 bp, Glycine max
  Peptide Sequence Number=SeqID_106496
gctttcttatgtggtggctcgtggtccacaagtgtacccctcgaatctccccaacaactggtatcagagccgatggttcaagttggtgaccggctcagacgagtatgcaagtatcgcaggtggccagaatggagagcggcacagcgtgccccgcaggtggagcggggtggccagaatggctagcgggcaggacaagtaccgcaggtggtcatggctatactcgtggatgataaagactttcgctcgagggggagactaccatgtgaaagagactcacacttgcaggggagatgtgttgggttacaagtgtgaggtgaagtcccacatcgggtag

SEQ ID NO: 14812 - DNA, 420 bp, Glycine max
  Peptide Sequence Number=SeqID_106497
atgactgaagttggcactgagtatgtggtcaaaagcatccttacaactcacaaatctggtgctccaatccttcccaagggagagtttggaactggaatcaatccggatatggagtttgatgatgtaaaggtctgggatatctgggatggctgggacgacaagtatacatgttgcgaaaatctaatttcagacgtgatatttcgatatcctgacatcagcagatatgacagaataagtgaagtgtatgatcgttcctgggatatagcatttgtattcaaatttgatggagataaagaaagcataaaagggttttgggtcttaccattatatgccacagcatcggggtttaagcaggaaacttttgaatcagaatccattgatggcgaacaacttcctgcattgaagaggaggagggcttag

SEQ ID NO: 14813 - DNA, 144 bp, Glycine max
  Peptide Sequence Number=SeqID_106498
atgcaggattctattgaaaacattattgatgtcaaagcggacggtttttttacaagaccattgtcctttaccaccattggcgttgttgtggaatacacattgtcattctctggcaaagcagtggcccaccctgtacataggtag

SEQ ID NO: 14814 - DNA, 501 bp, Glycine max
  Peptide Sequence Number=SeqID_106499
atgggtcagctccagcgacaagcttttcgcaaagcttacggtaaaatctgggacctagccatggcagaggtctccacagaggccattgcctccctcgcccagtattatgaccagccgttgaggtgcttcacctttggggacttccagctatcacccatcgtggaagaatatgaagagatcctaggatgccctctaggaggaaggaaaccatacctcttatcaggattctatccctctttagctagagcttctaagatagtccaaatctcggcgcaggaattagaccacagaaagcaagtcgaaaatggggtggttggagtaccgagaaaatgcttggaggcaaaagcacaaatcttggcaggtagaggcgaatgggccccgttcatagacatcctcgcacttttgatctttggaggagtcctttttccaaatgtggatgggttcgtggacctagcggcgatcgacgcttttctcgtctttcatgaccgcaaggaaagcccg

SEQ ID NO: 14815 - DNA, 711 bp, Glycine max
  Peptide Sequence Number=SeqID_106500
atgacttgtccgtacgaatcacttccttactcctccacaccgcgctttgtcttctacctcttcttcttcctcattgttcctttgcttcttatttcttcttcgtttttgtttgcttcttgtcatgcacattgttggttcctccgtcgcgctcccttatgcttcatcttcttcgttgctgctcaatgttggttgctggttgttcttgttggcttcatcttcttccaggccgaacaattggggaggagacaagcgagtgatgatgataatgatgcccccaacggtgaagacctaccgcatttggccgcatgcaacgacatcaagagcgtgttgttgaggatccttctaaggctgcaaaggaattgcacaaagagcagcaagaagcacctgttgaggatcctcctactgatgagagattatgaaattcacattgctctcagaatctggaatggagaggaacgtcctgagttgaagctatcttcccatggaaggaagatggctaagttcaggaggccggctccaaagattgaaggccttgtgaatgctagcagactaagtccgctgatcgtatattccctagatacgggcgatcgaggactaatgtccgcttttgtggaatgttggcataaggaaactagtagtttccatttgcccgtcgaaaatgttggatcaagtggcctcgaaataattaagaagggaggggggttgaattaa

SEQ ID NO: 14816 - DNA, 141 bp, Glycine max
  Peptide Sequence Number=SeqID_106501
atggatatttgtaatgagcaagaaactttatgttgtcaagaaaaagaaacattatttcatcattctagtgttttggctggaggagctacattagctgctagaaggctggtggaagagaatggaattcttaaggtgaattaa

SEQ ID NO: 14817 - DNA, 321 bp, Glycine max
  Peptide Sequence Number=SeqID_106502
atgggacacattttgtatagaatcacaatattgagttacaattgcattggtataaaaaagggtgatgactcttgggtaaaaaagggtgctcaaccaaatgatgatgaaggacaattaccagtcgaaggggactcttctctccttcaaagtattttggacaggtttgatggactccaaacctatgttggcgaaaggtttgatgctttggaacaacaaatagacatgcaatttgatgcaatggactcaaggatcacaaaggttgaagaagatgtcaccatcattcgcgattgccttgatttacctccaccaccatcagtttag

SEQ ID NO: 14818 - DNA, 585 bp, Glycine max
  Peptide Sequence Number=SeqID_106503
atgggcccgaaatctaccctaaggctcataagaaccctagggccttctcttgcatctttggcccattctacttggggtcttctatccaatgcccttgcgggtcaggcattccctccacacgctctcctctctcgtgtcaaccttgctggctcccaccaccatgcccaacctccttgcactgccattgattttcccgaaaccggggaacactaccgtcaaaccacagcgccaccaccacaacctcccctctacaaccgtcgtctggccgcaaatctagtcagggaatttgcagatctggtcacgacattgttgtatgacgtgagctactgttctttggcattgtcgttttcaaaggagaatgtttgggttctccagttggatttggaatttgggttgaaacatagaatggaaagtgtggaggtcgtgggcattgttggcggtggctggagttgccggcaagcggagagtgcggagggagggattgttggggaaaaggaaggagaagaggctgaaggagaagaggctaaggagaagaggatgaaggagagggagaggagggagaatgatgtgacactaatgtgttag

SEQ ID NO: 14819 - DNA, 405 bp, Glycine max
  Peptide Sequence Number=SeqID_106504
atgcgaaaggttgggtatgttcaaactattcctccacactcttcgacttcaagattatgcttagaagatattgacgacagatggatgcatttctctgagtaccttgcacctgtgggtcaaatttatgttgtgtctggacagtgtgcaccagactacatcgactggttctacatgatttctcaccccttcatgagaatggcacagcccggggatccagttagacatccacctgtcgtgcaagatgatacatatgatgcttgccaagcaatagctgaaaggttagaacagttgttgaacctgaggatagtgacaaaaggtatagaagcatacagtgtgatggaagaatgcctaaggatcaccagaggtgtcactatgaaacgcaatgtatatgtgcggtcacgatga

SEQ ID NO: 14820 - DNA, 1011 bp, Glycine max
  Peptide Sequence Number=SeqID_106505
atgtcatcaggtggtgttgaccctccccgagatagtttgacatcatctacctcatcctcgtcttctgtttctatcctagttaggtctcctgatgttgcacctatacaatcaccacctccgactgaagctagacaatcttcatgtcatgttaatgcacgtggaccatctctagaacctacacccacaccatctccatcctccattgatgcacgtggaccgtccccagtacctacatctacacctgtcccctccccacctgtaggcaatatgcctacagatgaagatgctataaatttggcaacggaagagcccctcccccccccccccccccttaatgatcttcttatggtcacgctaattaatggatcacaagttgaggcaaaggctgccactttgtccattaggcaacaatttggtcagccttggcctacatggggagcaattccaaaagatcatcatgaactttttcccagcattttaaggatgctcgaaatgaaaataaaaggtcatattggattggagatcgtgtttggaacaatctattatcacattagaatgcacctgagtatttttccaagtgtgcacaggccaaaaacaatcgggcatatgaaaagtgagggtgtttacacacaggtggttctatcagcttgcaagatcatgccattcgcttgtcagatgagcttggtcgatcaatatatatggatgaggtttttcagcaaactcatttatgaaaggatactggaagaatttgaggctagactatctcaagctaggtctgatgttgcattaagtgttggtgaatcccaactcactcccttagaccctgatgaagaacaaagacttaggagtcgataccttgttcatacttacaaatgcggaaatgacaacttcatgcaacatacacaaggatcttccagtcacgctgaagatgctgtagagattaactgcctgaaggaggagttgcatcaatcaaaagaggagatgcacgtttttcagtcagtagtcttttag

SEQ ID NO: 14821 - DNA, 414 bp, Glycine max
  Peptide Sequence Number=SeqID_106506
atggtgagcctcgggtatggcatgacggagacatcagggggtggtggtgtcatgctcatggaaggagcgaggcaaaaagtgaggacggtgttgatgacggaggtggaggcggcgaatccgactaccaccgttagggagaagcgcgatggggctagtggcgtcgctatcgaagaaagaggtggtggagttttgcagacagagatgaagaagcatattgatggtgaaaaccccggtggggaagctagggaggtgggaggcgttagcgtcagtgttcaggggcagggcacgaagtggagagttgttgttgcagctcctgagagatccaacgcattggggacttggagtttttggaagacgatggtgttagagcaagaacatgagtacaacgattgccgaagaaggttgccgaaataa

SEQ ID NO: 14822 - DNA, 216 bp, Glycine max
  Peptide Sequence Number=SeqID_106507
atggtgtgtctactcatgaagaaaatgcgtggagttacaaccagcgtttattcgaggaaaacattagaaaaaccaaaaagacaaaggtctgcagattttgaatataagggttcgggagttgtttacgcacggagaaggcgttggaccttgaaacaacctcaagtgatgtttgatgaaaaacggagagaatcgttatggtgttggaccttgaaatga

SEQ ID NO: 14823 - DNA, 921 bp, Glycine max
  Peptide Sequence Number=SeqID_106508
atggcagaggctcactcactgagcgagccccatgtgctaagcccaaaaccttattggcctcaagcttctaagcctgtatggtggcttaaggagttgaggctcacaagcctcacgttctgggtttgcgatgaacttgctaagcgaggttgtttcgctaacgagtcacactcgcttagccactggtctcttctagctaagcgagttagtggcgctaagccattgttactggaactgtgttgtcgcgctaagcacaccctacgcgctaagcgcctgatggtcactctgcaagattggctaagcgagccatgcctcaagagccctatgatacatccagattcatgcttgaaattgcttgggagcgatatgagacaaatagcaccgccagtggcacaagaacctcacgcagcaatggagaaccatattgatctagccttggtcaagaagttctactccaacctttatgaccctgaagaccgctcccccaggcagtgcaaaatagcccaatccaactcgtctcgattgggctttccggctcttatcaccgccctatgcttagccagaggggttgtttctgacttccttacttttgagtccctgagcccggccattaatttggaatacatcttgaagaattactggaaccctgatgacccttcgattacatttctagggtcccgcaaggccaaggttcgggctccatcagcagatgcaccagtccctccacctccagcaccagctccagtaggtccttctatgtcatccaccgccaacaatgaccacatcatgcctatgctgcagagcatccaccatggcctctacctggcagctgagggcactccagaggacgaggaggctgctgaggacaccctagaggctcagaatacaactcaggaggctaaggaagacataggtgcagcggag

SEQ ID NO: 14824 - DNA, 255 bp, Glycine max
  Peptide Sequence Number=SeqID_106509
atgacagccaaagttacttactcagaaaaattgatgatggtgatgcaagaatggtgtgtgcgcatgtcaatggaggttatgggctccatggttcgtcaaaatgatgatgatggtaggaggtggcgcgtcagtggtgatggtggcatgtcgatgatggaacaagtgttgagtggtggtgtggatggtgttgagtggtgtgatggtggatatggagtggggggttctaaaatagaagaagaaggagaagttgcgtaa

SEQ ID NO: 14825 - DNA, 1614 bp, Glycine max
  Peptide Sequence Number=SeqID_106510
atgtctgtacttgttgaagagaacttgtcactacctgttaacatcactggtagtgatacttggtatcgtgtacagagtgataaaaaagttgctgtatgtagcatacatccatcagagcaagccaccctgcaatgcctaggctgtgttaaggccaaaatacctgtttccaagagttaccattgcaccacaaagtgtttttcggatgcatggcagcatcatcgtgtcttacatgatcgtgccgcaagtgctcttaatgaaaatggaaacgaggaggaggaggtatttgggcgctttaatagtactgggtctggggcaaccaattccagtttatctgcctctgcatcaagtgctagcttgacaaatgggtctgcaacacctttgtatccagcagctatcacacaaagaagtggtgaaacttggtttgaagttggaagatctaagacttacacccctactgctgatgacattggccatgtccttaagtttgagtgtgttgcagttgatgcagagacaaaactgcctgtggggcatgtcaacactatactaacttcacgtgtcattccagctccctcgcctattcctcgccgactgatacctgttgatgggatggcgcatttagatgtggatgggagaatgacatcttcaggaacttttactgtcctatcatacaatgtattgtctgaagcatatgcctcaaatgatctatacaattactgcccttcatgggctctttcttggccatatcgcaggcaaaatttgttacgggaaattattggttatcgcccagacattatttgtcttcaggaggtgtacagtggcaacacaaatacaattgatgggtgtgcaacatttttccgtagagacagattttcacatgttaagaaatacgaggttgaatttaacaaggctgcacagtctttgacggaggctacaattccaaccactcagaagaaaactgccttgaatcggctggataatgttgcactaatagtggttctagaagcaaaagttaacaatcagccatttgataatgctgggaaaagacagcttctttgtgtggcaaatacacatgtaaatgtctcccaagatctaaaggatgtgaaactctggcaggttcatactctcttaaaaggtttggaaaaaatagctgcaagtgcagacattccgatgttggtttgtggagattttaattcagttccgggaagtgctcctcatgcacttcttgcaatggggaaggtagatccttcacatcctgatttagcagttgacccgcttaacattctacgtcctcacagcaagttggttcatcagttaccactggttagtgcatacacatcttttgcaagaacagttggccttggatatgagcagcataaaaggagactggatggtggaacgaatgaacctttattcacaaatgtcactagagattttattggcactctagattacatattttacacagcggattcattggttgtggagtcattattggagttgctggatgaggagagtttgaggaaggacacagcacttccttcacctgaatggtcctcagatcacattgctctcttagctgagtttcgctgctgcaagaataaatctaggcgttga

SEQ ID NO: 14826 - DNA, 636 bp, Glycine max
  Peptide Sequence Number=SeqID_106511
atgtctgcttttgtgaaacgctggcataaggaaactagtagtttccatttgcctatcgaagaggtgaccatcaccttggatgacatcgcgtcattgctacatctgcttattgtaggggcattccatagcttcgagctacttcatgtcgatgatgctgtcgatatgttggtggaattactcgagagtgagagttacgcttggggcactgctatacttgtgcacatgtatgataatttaaatgacgcatcgaagagcacggtgagacagcttgattatgatgaaaggagaccgcgtgcatgtcgatggacctctggcaaggcactgctcgtttccacatatcgcaggcatttggacagattgacccctgacatgtttggctacatccaaactatttttccacatcttactgcgtcttcgctctctgctaaagaaattgatgatagatggatgcagttcagtgagtacattgcacctgtagggcaattatgtgtagtgcctgaccactttttggcagattacatggattggttctacatgatttcgcacccattcatgagtccggcacagtcaggggatcctcatagagtttcgccgattcagcaatatgacacatttgttgaaccaaatgtgtattaa

SEQ ID NO: 14827 - DNA, 273 bp, Glycine max
  Peptide Sequence Number=SeqID_106512
atgccgactacagagcttgtatgtctctgtcttgcttctgttttggaactatacgtgagtaacgctgttctattcgatatggttggaaaccttcgggttctcctttgtgctacttcttttgctcacgatgacattaatgagtcacgaacccatcttattggagaggatggagatgtccgtgcatgtgacgccgaaccactggcatggcatcgcgtcactatcattccaatcggagaaagtggcggtgccaaaggcatccacgacggactttaa

SEQ ID NO: 14828 - DNA, 214 bp, Glycine max
  Peptide Sequence Number=SeqID_106513
atgtgtgttcaagaagaggaaagattaattatggaagagggcgaaagggtgaacttaactattcatggaaaggagaaagggaatcaacccaaaaacaagggcaagattcctgctcagtcagtcataaagaaagagtctaagtgtttcttttgcaagaagaaaaatcacatgaagaaagacttcttaaagtttaagagttggatggacaagaaag

SEQ ID NO: 14829 - DNA, 648 bp, Glycine max
  Peptide Sequence Number=SeqID_106514
gcattaacgacggttgaaaaccgtcgtgacatggccataagaaccgacttaaaatccaatttttctagtagtgggagtactggatgtgctgacatggttgttaatgcaaccttagctgcaatggcaaggcatggaatgaaccaaaagccagatatcaatgtgtaccaaattgcttcatctgtagtgaaccctctagtcttccaagacctggcaaggcttctatatgaacactacagttcctcaccatgcattgactcaatgggtaggccaattcaagttccactgatgaagttttttagctccacagaagaattctctggtcacctgtggagagatgctattcagaaaagaggcatcacagctatggcctcctcaaaggcgaagatgtctcagaaacttgaaaacatgtgcagaaaatcagtggagcaagcaaagtacttggccaacatttatgaaccatacacattttatggtggaaggtttgataacagtaacacacaaagattgatggaaagcatgtctgaagaagaaaagagggagtttgactttgatgtaaagagcatcgattggaatgactacatcaccaatgtccatatacctggactaaggagacatgtcatgaaggggagaggaatggggagtcagtga

SEQ ID NO: 14830 - DNA, 192 bp, Glycine max
  Peptide Sequence Number=SeqID_106515
atggatttcattggaggcttaccaaaagctcaagggaaggacactatattagtggtagtggataggctgactaaagacagacttttcatgagtctcttttggaaggaattgttcaagagaccaggaacccaattgaagatgagcactgcctattgtcctcaaatagatgggcagactgaagtagtgaactga

SEQ ID NO: 14831 - DNA, 762 bp, Glycine max
  Peptide Sequence Number=SeqID_106516
atggaggaagaagttgatccttcgatgaagagggagaaacacaaggaaaacagtgtgaagaatgtgggctgcacagaccattttcttgataacccaataccaaaactgatcaagaaggaagctgaagctggggatgcaaccaagcctcattcttttcaagattcagatttccataaaaagattgttatgattaaacagaaatcattgttgggcctaaattcaatcatgaaggtggatggaacattaatgatgttggaaccttgctatgtcaacttgctgggtgagcctttagcattaaattttgttatgtctatggctgaaatcttagcagtggagctaaggcagaaggaatgtactgaggcagtcatgctacaagggatgcagttgtcttccaacaatcagagaaaacttgaggaagtttctgtgtgcaattccagttttcaaattccaaccttgaggacaaggttgatttttaggaggggtgtattgttagggtgcaaggagaagggaaagttagttaagataaggaaccttggagcgttggtggcagcgttggctgcaaaaggggataccctgagattgggagtgggggagcgcggcgaggcaggagtagcaggcggcgcgggcggaggaggaggaggggtggcagacagtgggggtggccgtgtgtatgaggtcgccggaggcgatggggcgagtggcgaagaccgcgcggcccacggactcggtgagcgcgactcggatgggaggcggcggcgatga

SEQ ID NO: 14832 - DNA, 459 bp, Glycine max
  Peptide Sequence Number=SeqID_106517
atgcaaagcctggagagcaaattgaaacgggagagaattcaaaacccacaatccaaaaggcacaatggaaatggaaaatggaaaactggaaaggcgtgtagcaatggaaatgaaaagacctttttgggcgggaagttggatcgctggcatggtgacccgttagccctggcaatgccacgtcagcattgtcagggccttgtttgtatcatgatagatgataagaaggttggggatcgaaatgttgttgtcgtaccattgcgttgccatgacagtctcaatgttgttggcaatgaggtccttggacgggaggctgtagcacatgccacatgtgcccatggagatggggtcactgacgccaacgatgttgaagtggaagggcaccatgccggtggcgatgccgtctcgcatggccttgaagaggtggaggtgcatgttgtaggtgttgctctcgtattatag

SEQ ID NO: 14833 - DNA, 723 bp, Glycine max
  Peptide Sequence Number=SeqID_106518
atgtcactacatgatgttcatgtttgtaacactgttgactacgatattcatcatgttcagtccccagatttggaaaatatgactgactcacctatgttattcacattcggtatgacataccaatttaaggttgtatttcatattgacaggaatatcattgaggtaccctcactttatcataaacaatgggctccagattacccaaattatgtggtgttggactacaatggaaacaagcaccatataagagttagaaaatttaataaccgagtctacattgttgatggtctcaaacactttaggagggatatgagaatatatgaaggtgtgatgatcacatttgctgcgccggacaagaattggaagtttgatatccacttctcaccgccactccatgcacaggcatgtggcaagcctccccattatgccagagaatatgtgtttactatggatgtcgataatcgcatgattgttagactttatccattggtaacactttggagacaatatattattgtccttggtgttcgtgggcgtcgtcacttttggaagttgagtatccataatgggcttcaatgtcttgctgagccatggttccaattgttaacagaaaatgatttgatggtcggtgacgaagttgtcttttatttcaggccgaatcaacttctttgggaggtcattgccagaaagcagacagtgtgggacgaggacgactccccttga

SEQ ID NO: 14834 - DNA, 1086 bp, Glycine max
  Peptide Sequence Number=SeqID_106519
atgtggtatgatgagaggattaataaagataaacagacaaaaaacccaaagttttcattatgttgtggtgatggaaaaatacaactgccaatactacatgatgctctgcaacccttgcggcaactactctttgacagcagagattcacaagcaaagaaattccagcaaaacatatgtttatacaacctaatgtttgcattcacatctcctggtgtcaaagtggacacatcctataatactggaagaggtcctcctacattgcgcatacatggtcaatcgcatcaccttattggaagcctcctacctatgcctgataactcaccaaagtttgcacaactatatatttatgacacggaaaacgaagtcaacaataggctttcacaataccctatcaaaaataatgttgatgaagacattataattggtatcaagaatatgctagatacccacaatccatatgcacaaaaattcagaatggcaagggataaactggaatcttctgcagtgtgtgacctgaaactaaagctcattagtgacagacaatcagatggcagattatataatttgacaaatgcttctgaagtggctgctttaattgttggtgacgagcatacagtgaataacagagatatcatcatcgagaagcaaacaggcatgctgcaaagaataaatgaacttcatcctgcatatttacctttgcaatatcctcttttgtacccacacggtgaagatggctacagaccaaacattcttcataaggatcatccgaataaccatgctgcaaagaggaacaaatctcaaaaactaaactatgttagacaacatcaacaagaactccgagttgacaagtacatcaatttaaatgactgtaataatcagcccctaacccaaggcaatgaaaaagttgtttacaccattgagcggcaaaaaagaggattgcctcatgctcatatcttaatctttttgcatccttcaaataagtatccaaatccagaagacattgacaacataatttctgttgagataccaaacaaggacgcacatccagaattgtatcaaattgtctccaaccatatgatgcattga

SEQ ID NO: 14835 - DNA, 621 bp, Glycine max
  Peptide Sequence Number=SeqID_106520
atgtatgttgaagctgcagaagaatccttggagacggcttttcagtcctttgaggtggtgagcaacgcttctgtggaatccctcccgatgcgaccccccatgtctaatgctatgatgatggtagcccgtgtgatgttagggcacagatatgagcccaaaatgggcttagggaagaacaacgatggtgtggccagtttggtagaattcaaggaaaaccacaggaggtttgggttaggctataggcccacgcgtgctaatgtaagaaaaagcgccctagaaaggagaagcaagggcatggaccaacaacaaaggccacaagtgaaagaggctcctccatgtcacatcagcaagagcttcgtgagtgcgggctggagatccgacgacgagtcctgtaaaggtattaataccgaggaccctgacgtcaattttgaacgaatagcaagccaagccgaggatggagaagatgaggatgcggggtttcccctggagctagaaaggatggtcactcaggaagaccgagaaatgaagctacaccaaaaagagacggaaatcgtgaacttgggtgttggcgaagaaaggaaagaggtaaaggttggtaggggcatgactacaccggtctga

SEQ ID NO: 14836 - DNA, 804 bp, Glycine max
  Peptide Sequence Number=SeqID_106521
atgtctatttggcacacctcagtccacaatggagagtttgtgccgccggagaagccggtgatgatgtcacggaggagtgaaattgagaatggggagattgccggtgagagatggaagaaaggggaggcggagaggggggagtttgtttctggaaaatggagaaagttggtttcaaacttcttaatattacaagacaggttagtagcaaaaatccggcaaagtgctactgagtctcctaatccaaaacctgaggttggagagattgacactagcccaccttttcaatctgttaaagatgttgtctctctatttggtgaaggtgctttctctggtgaaaaacctatctttaagaaggcaaaaccttattctgctgaggagtctgataaattagcagatatgaaagtggctgctgccaaggcacaggttgaagctgtgaaggctagtgaaaatgaggctctcaaaaggttggagacaactcaaaaggagattgaggatataaagggtggttctccttcttatctgcctggtgagaaccctcgaagcaagcaattatatgatgctcggaagtcctcgtctattctctctagagatgctcaaacaagacgatggtcaattaagaaatctgaaagtggttacaacaggatggaacaatttcttgcttcaagattgagggaaattatgaaggcaaactcctgcgacttttttatgcccaagggttttggaggggaagaggggagaatgggggtggaggaggaatgcggagttgagggtggtggtggcaccgagaagaagatgaagagatga

SEQ ID NO: 14837 - DNA, 1818 bp, Glycine max
  Peptide Sequence Number=SeqID_106522
atggcaccgcattcaaaaaaaccgcagaagaagaacgactctgtagacaaaccgaaaatcgataaagcctctaagaaaatattcaaaccgaaaaagagggaacaaaacatcgccgtcgccgccgcaaagtccgaagcactctctctgccactagaagacgaggttcccgatttccctcgaggcggagaattttccgcgaagggtaggaatgattatgatgagtttggcgccgaggatccctccaagaagacgaggaagaagaagaaggggaagaatgcgtcgggtaagagtaatgaagccgcagatgactggggctcgctttccggcaacggtatcaccggaaagttgccgcggcgtgtgaataaaattactctcaggaatataactcctggaatgaagctttggggtgttgttgctgaagtaaatgagaaagaccttgtagttagtttaccagggggtttacgtggtttagttcacgcttcagatgcggtagatcctatttttgacgacaaaattgagctggtttcttgtgttgtactgagattggatgatgacaagaaagagaaaggaagcaggaaaatttggctttctttgcgtctttctttgttgcacaagaactacaacttggatgttgttcaggaaggcatggtccttgctgcatatgtgaagagtattgaagatcatggttacattcttcattttggtttaccttttttcatggggttcttaccaaaaaacagctctgctggtaaaagtcaagctcctgctgtgaatttgctgctcatcttgtctggcatgattgaaccaagctcaatttgtgaaggctggggtggtgaagtaaaaattgggaaacttctgcagggtttggttagaagcattgataaagttcgtaaagtggtttacttgagttctgaccctgatacaataaccaaaagtgtgaccaaggacctcagaggtttatcaattgatcttctagttccaggaatgctggtaaatgcctgtgtgaagtcaatccttgagaatggtgttatgttatcatttctcacatacttcacaggaactgttgatctgtttcatttgcaaaatatttatcctggaaaaaattggaaggataagtgcagtgaatctcagaaggttgtttctcggatattattcattgatccatcaagtagagctgttggtttgacactgaatccacatcttgttcagaacagggcccctccttctcatgttaaaattggagatatatatgacaactcaaaagttgttagggtggatagaggattaggactattgcttgaagttccatcaattccggagccaactccagcttttgtcagcatatctgatattgctgaggagatcccaaaacttgagaagaagtacaaagaaggaaatcatgttcgagttcggattcttgggttaagatatttggaaggaattgctacaggagttttgaaggttgtcattgtctttttgtttggagaatgggttatgtggagaatgagaatgggttatttggagagatggagagaatctgctagtgctttagaagaggaagtgtttactcattctgatgtcaagcctggcatggtggtgaaggctaagattctttcagttgacagctttggcgctatagtgcaaattccaggtggtgtgaaggcactttgtcctcttcgacatatgtctgaattggaaatttcaaagcctggaaaaaaatttaaggtgggagctgaattggttttccgtgtgcttggttgcaagtcaaaacgagtgacagttacacacaagaaaacccttgtatgtttctacatgtga

SEQ ID NO: 14838 - DNA, 378 bp, Glycine max
  Peptide Sequence Number=SeqID_106523
atgaggattgtggcttcatgtctgcattggatacaggagcgtcgagttccaacagcggcccaggtggtggaagatgaggatttggagacgattggaaaaaatttgtttaaggagaagctaaaacttctaaaaacaaaactctggggttggcatgtggaggtgttcgatggtttgggtgctaatataaattctaaagtggaggagctggaggtggtgaagacaaggttgtgtgtgagagttgaagatgtaggagggaggaggttgattctttctaaagaattttggagatcgttgaagaaatggcccaaaaatatagggtgggatggatttatgagggtaatgaaaaactctatgttctttcattcttctttgaaataa

SEQ ID NO: 14839 - DNA, 399 bp, Glycine max
  Peptide Sequence Number=SeqID_106524
atgtcagttatagtgcaaagcaaggaaccattcggtgtttcgatcaggaagacaaaagacaccaagaaaggagggcaaaaggcatttggctcgcctgggccaccagataacttcaaggctaagggactagctttcctgggcgagctcactacttcaaggttaagtttcagctcgcctaggcgagttgcaaccgccccaaggtggccttttgatgaggacatggcaaagactaagggcaaggaacctttagaaggaattggacgacctatgacaagtgctagaacaaagaaggccaaggaagctcttcaacaagtgttaaccatgctatttgaatttaggcccaagttacaagtggagaaacttcagattgtcaattgcaccatgttccaagaagagtag

SEQ ID NO: 14840 - DNA, 1638 bp, Glycine max
  Peptide Sequence Number=SeqID_106525
atgtctttcatttctgactttgccactggcatgggtggtagtgattccggggtctcacgccgtgttgttggaggcacttctcgcctccgcacaagggcgcaacctcttgcttcttctctcgacagggaacccgttctagtcaccatgattctcccccctatgtttctggggaagcaagaaggagtgatggtggggacattagcgcttccttcgtgtgccccagagccacaggacaatgttttgaaatatcgatcctcccttacttctatggtgagtgtcgccactcttcagcaccaagtgaaattggccaatccagaaggttccggcatgctagccgtccaggcttgtgggagtgacgatttcctttttctgagggcggtgtcgggcagtctgcccttgagtgcattccagtgtgctctacttgagcacttgaatgtagccacttctcaactccaccccaatagttggttcctagtgaagcatgatgaaccttctagtgggattgtgccattgtctactgtcattcctcctactggagaaggggttgttgaggtctcccctagcatgccttcctctattttggctaagaggaagtgtgacaacgacactagggtatcaggccgcaagaagtcgagggccccttctagccttcgagctgtgaggcaagctggtctgcctatggctccttcaactgtccaagctcctgcatctgccgctcctgctgttgccactcatgctcctccaccttctcctgttgcgtttgttcaggagatttctacttctcttattgctgaagttagtgcatcagccgctttggtcggtcctgtcatggctcctccatccaccattgttgtacccttgctaagtgccagtgtggcaaccacgagtgctcctgagatgccgcctcttcctttttcaactccattggtttctccctcggctgtgttggcatcaacgtcgccttccttttcttctcaccctaatcttcctctagagaagtatggcgatcttcgcggagaatggataacgacaccaggaggctctgagcaaagtggcatccttggaggctgggtgaagcgtcttaaggtggccaacaccactgtcgcctttgacgagcccatgaggtcgaaccatcggctatcatccaaggttggtagtgttctagccaagtttttgtgctctagattggatggtgatgagttgtttgagcgctacaagggcttgtggagagagaagaatgaattggttggtgaggtggagagcgctactgctgagaaggataagcttaccaaggtggttgctgacctagaggcccaattgaaggagtcagagtctgagcttgaagaggagctgttgatatacaagaaggaggccgtggaggagaatgaaaaggactttcataaggctattaggcaggtcgggttcttcgacaaggatcttgacttgggtctttttgacccattcaaggacatgagggacgttgttctacttgacaagaaagatatagttgctaagaaggaggatgccgtcgaggagcaggatgttagggccagtcttgctgaccagtcgggtggcaacttgctttgccttgtggaacttggaccattggctatactaatcgtagttccaaaggagtga

SEQ ID NO: 14841 - DNA, 426 bp, Glycine max
  Peptide Sequence Number=SeqID_106526
atgtataagacaaaaggagtagagcccaacccaagagttgaaaggaacaaaaaaaaagagaatcctcgaggtttcacacttgcacatttgagaagaaaactcattcgaccaggagctcgtggaaaatgcccaaagacaattatgaaagtaggaagcaagcttcatgatgaatcaagattgattcaaagaagttttgatgataacaaaggtgatgacaaaaagctcaaagaatcaaaggatgagttcaagatgttcaagattgaatcaagaacacttcaaggttcaagaggaaatttgatttcaagaatcaagaatcaagattcaagaatcaagattcaaggttcaagcttccaagaatcaagatcaagattcaagatcaagattcaagaatcaagatcaagattcaagaatcaagagaagaattaa

SEQ ID NO: 14842 - DNA, 357 bp, Glycine max
  Peptide Sequence Number=SeqID_106527
atgcaacatacgcctgttgctattgcatacgtgtcactcgtgaagtggtcgactaacggtgttgaatgccagttacagtgcaaagcaaggaaccattcggtgtttcgatcaagaagacaaaagacaccaagaaaggagggcaaaagggtcttttccttgtttttcctaggccccagctcgcccaggacagcatttggctcacctgggccaccaaataacttcacggctaagggactagctcgcttgtgcgagctcactgcttcaaggttaggcgacatgcaatcgccccaaggtggccttttgcctataaataggcatcctatgggtgttttaaagggttccaaggttcagaagtag

SEQ ID NO: 14843 - DNA, 294 bp, Glycine max
  Peptide Sequence Number=SeqID_106528
atgtcctcgacccacttcttcattaacctccaaccttcctttaaaatcaaatgcttcctcctagtctttggggcaatccttggtgtgggcactgctcttgacgaactggacgtccttgatttgggaatcgccgacgtagggtccgacgacgatgttggagctgggaaggaccgtggagtcatcgaccttgcattgcttgaatgggaaagagggtggcggaaggagaagagagaggtgggggttttggaggcgttgcttgaatgggctgtgcacgacactgaaggttatagctag

SEQ ID NO: 14844 - DNA, 1023 bp, Glycine max
  Peptide Sequence Number=SeqID_106529
atggagctctcactctctccaacttcacatcgtgttccttccacaattcccactttgaatttcgctaaactatcatccactaaggccacaacgtcccaacctttgttcttaggattttccaaacacttcaactcaattgggttgaaccatcacagttacagatgctgctcaaatgctgttcctaagagaccccaaagacccagttccataagggaaaaaaaattgatgggttttgcagaacagttcatggcctgcactggagttggagctgctggttctgatcgtccattagctgaaagacttttagatttgaaagatgcttgctggagatttttaaggccacatactatacgtggtacagcactaggttcatttgctttggtggcaagagcattgattgagaacacgaatttgataaagtggtctcttttgttcaaagctttctctggtctttttgccctgatttgtgggaatggttatatagttggcatcaatcaaatctatgacattagcattgacaaggtaaacaaaccttatttacctatagctgctggagatctttctgtccaatctgcatggttcttggttatattttttgcagcagctggcctgtcgattgcagggttgaactttgggcctttcattttttctctttacacacttggccttttcttgggaaccatctattctgttcctccattgaggatgaaacgctttcctgttgcagcatttcttataattgccacgttgaaaagattgacagaagaggcttatgcagagcttcccttgggcttgcatttgaatggaggtggctctcctgtggtttttatcacaacatttgtaacatttttcgcactggtaattgctataacaaaagatcttcctgatgttgaaggtgatcgcaagtatcagatatcaacctttgctacaaaattaggagttcggaacattgctttccttggttctggaattttgctggtgaattatattgtttctgttttggcagcaatttatatgcctcag

SEQ ID NO: 14845 - DNA, 234 bp, Glycine max
  Peptide Sequence Number=SeqID_106530
atgatatgtgaaaaagggaggtacaacaagcaaaaaggagtagaaataaagaaaaaaagaagaaaatcagaagaagcccaagtccagcaaggagaccatccctccattgacaggggggaagggccttctggagccgccactgaggatcctgcagttgatgaggacctcatggcagacttggctggcgctgattggggcccatgggcagatttgggaggcagcgcaggacattag

SEQ ID NO: 14846 - DNA, 372 bp, Glycine max
  Peptide Sequence Number=SeqID_106531
atgtctgcttctttcgttcatcgtcttccaagaatccctcgaagtgaagctttcatatttgcgttcaatctctgcgaagcaatgccagaaaagttcatttgtgaagtctccttcaaattccccaagcgacctgcgatccttgagatttcttttcaaccttgtaaaaatcattttacaagcaaagatccacaagggatgtatcctcccttgttctctttgaacaacctagtggatgtatcctccactagaactgatccacaagagatgtaccctctcttgttctcagtcaacaacccaagtagatgcactctctacttgtaccacaaaggatgtaccctccaatgtgttaagacaaagttttcaggcggttag

SEQ ID NO: 14847 - DNA, 144 bp, Glycine max
  Peptide Sequence Number=SeqID_106532
atgaccaagagcaagggcaaggatccacttgaaggacttggaggacctatgacaagggctagagcaaggaaagccaaggaagctcttcaacaagtgctgtccatactatttgaatacaagcccaagttagtaggtcattactaa

SEQ ID NO: 14848 - DNA, 117 bp, Glycine max
  Peptide Sequence Number=SeqID_106533
atggtggtatggaagggaccagtcactagaaccatgagcaagaggctccaagaagattgggctagagctgctgaagaaggccctagggttctcatgaacctcagggtagatttctga

SEQ ID NO: 14849 - DNA, 783 bp, Glycine max
  Peptide Sequence Number=SeqID_106534
atgttgggtggccatgtttggcaagacattgttggtgtggttactgatctcattgatgttaagacagttaatccccctcacaggatgacagtcaggctcagggataacaataactgcgacattctaatgactgtttgggaggactatgctattcagctccatgatgctattgacaaaaaccttctgcttcaggaaccattggttgttatgttgaccctaggtaaaatcaaggatgctacaggtgaaatcaacaacctcagacaggattgttactacttgactgttgggacagttgacgaaatcatcattgatgctccatggagttatgacagttgtcctaactgtaccaccacatttgatccatcgaaagatggctcagcttgtcattcttgccaaaatagtgtgaccaatacagttccacggttagccatgatcattttttgctctaattatttacttacatgtttcactgttttaccaaattttcctgacactgctatggatgccaaggatggggacgatattaaggtgtttccaacctgtgttgatgaaatcctgtccaaaacttgggctgtcatatttaagttctgttcacaattgcgccaatcatctgtgttggatgtcagtgaagaaccccatcatattcaaacattgatagccacccttgggttgaaggaacaatcaagtaagggaaaggcaatagctgttgagcctaaaagttcaccgccaatttttcttcccacgatgcttatcactttaccagggatgcaacttccagtttga

SEQ ID NO: 14850 - DNA, 402 bp, Glycine max
  Peptide Sequence Number=SeqID_106535
atggagtttggatttcgatttagagtgagaacttaccggttacgagtggataaggtgaagatcgaattccaaacccgaagagcaaaaaagcaacgggatgaggaaggaaacggcttttttttcgtcaaaccaaacggagaacagcgaaatccgaacacagaaaacgagattcggcgaaagcgagactcagagcttccatctccatctatagaaccaaggaaacattggaagagctttgttgatcggagagagagagagagagacagacagagagagatccaaatgaagtcgcggaggtgcagcggggaaccggaagggccggtgagagggaaagcggggacaagaagggtttggggaagaggacagtgggttgaaacggttgactgtaaagggactgattaa

SEQ ID NO: 14851 - DNA, 891 bp, Glycine max
  Peptide Sequence Number=SeqID_106536
atgaatggtctacggtttgagaaaaaggattcgagagtcgtttacgcacggggaagggttgacttggacttagtcaacactgacagagtgctgacatggctcaccatcctaagtggcaggggtgcacatataaagaaggagggtggaccttgggtttgtcaagccttggaccagaaacatgtttgccctgggttttgtcaagtttgcggagttgtgctgaggcttaccaaggatgggccttggattttgtggacctgtaaggattggcaagcgtgggagcataggtttgaagagtcatgcgtgcaacataagtgttgtgctcttgcatacatggcactctccgtaggtgtgggactcactaagggcagaccttgggttttgcgagccctttggaggattgaccagggaattgtccaacttgggttttgggaaccatgctcttgcatacatgccactcgccgtgggagacataatgatgtgctcttgcatgtatgccactcgctgtgggtggcacacaccggaggcttagtagggcttattagggttctcatgcgcacatgtcactcgtcgtgggtgacatatactggagtcacaatgctaggagaagggctcaccaagggtggaccttgggttttaagagcttcagaggttagctatgaccctgaaggaaccttcccagttgggaccaagctttcccgctcagggatcttttctggcttcacctcggactcgccatacgagtctccttgtcgatggttccccaacttcaaaggggatcatagcgtttgtgccatatgtgagtcgggccctgaggatgactctattagctacctttgcttgtctgttagtctaaggatgttcgacagagatgactacgtgcttgatgcctag

SEQ ID NO: 14852 - DNA, 282 bp, Glycine max
  Peptide Sequence Number=SeqID_106537
atggcgtatgggaggccatacctacagatgaggtgtttccaatggtcccgatatgtccattccccacatggcgaagggttaaggggagctcagattgtgaaggttattggaaggagtgtgtgggagtttggtttctcttattctatgaccataatttcctcaacttctatggtgggagtttggagtgtctcctggatgatggtcttgaggtgcccgaccttcttagtgttgaccaacttaaatagtaggtccacttgggtgttgctttccctggggatgtag
